United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 4

SEQ ID NO: 14853 - DNA, 459 bp, Glycine max
  Peptide Sequence Number=SeqID_106538
aggcaccctttggatccggagaagtccaacaaagccctgggattttcggccttgatcacgggcctctgccagttctacggagtacttgtcacccccagcaaggtaatccagccaccaatcacccaagctttcatcgagaaatattgcacccctaggcaggcacagggggacacacagcaggctgcggacgcaccaacacctcagcagcccgatccggttagaccactaagcgtggagcagtatctacggcatgtggttcgccagcaggcggccaaccaccgtggggagcagttcagggctaaggtcgcgtggcctggagattggcccactgaggagggaaccggacccgcaagatccccgggcaaagcggaggaagcccacatggatgaggatatgactaacctgcttggttacctgggagagggtggagccacacgaccaaggtcaccgcacttgtga

SEQ ID NO: 14854 - DNA, 333 bp, Glycine max
  Peptide Sequence Number=SeqID_106539
atgacgaaattaagggtgacaatcacgaaaacattgtatcaagcaagtgatgagcataaggaaagcatggggtgtttgaccctcgacaaattgtttgttatgtctggtggccttgcattgaggaagtggatgatggacagagatacactggggtatagtgggcggagaggcctcactttgccaatcctaatgggcttcgagactatgctttttgagttgggagacgaggggttggtgtacaatgtatctgagcagaggactcacccctacaaccaacaacttttaggtattgatgatgtcgagtacactgaggcgtcaacgggctcgatgtag

SEQ ID NO: 14855 - DNA, 240 bp, Glycine max
  Peptide Sequence Number=SeqID_106540
atggtgaagaaaccaactcgcttgggtgagcttattacttcagcaccaagttttaactcgcctgggcgtcttatgggtgttttaaagaggttagaaggtcagaagttgagggaattgagagaagagagaaagaacaagaagaaagaagaggaaatgaagccgaggtgctaccgaattgcgaccgcaatcattccttatgtcattttctggttctgcattcttcgtgcgaccgtcggttag

SEQ ID NO: 14856 - DNA, 132 bp, Glycine max
  Peptide Sequence Number=SeqID_106541
atgattaccgaaaggcatctcaagaagcttggaataaggtttgttgatcatgaatggataatggttggagagtctgctggtagaaatgttgaagagatggaagaagatgatgaagttgaagctcaacattag

SEQ ID NO: 14857 - DNA, 449 bp, Glycine max
  Peptide Sequence Number=SeqID_106542
ctgaacggtctggttataggtacattgagcaactgactgaaatgcctcaaaatgttcttacgatgccattgggatatatcaacggtgttggaacctcttacgtgccgatcaacgtctcattttcgccaaaagttggcccagggcttcccgggaatggtgttatccgtaacggcaaaagcaccgccggacatcaggcggcaagtgtaaagcgggtgcactggctgagctacaccacacccgccgcgcttaatgcgttgccgctacaggctgcgcccattccatcagggaaacctgcggcaactgtaatgaggaacgggcgatcgagtgcgggcctttgcgtattcgccagctggcgaaagggggatgtgtcaaggcgattaagttgggtaacgcagggtgttcccagtgaacgtgcttctgtggcaggagaaaaaacgacggccagctga

SEQ ID NO: 14858 - DNA, 276 bp, Glycine max
  Peptide Sequence Number=SeqID_106543
atggtgaaagttggaacctcttacgtgccgatcaacgtctcattttcgccaaaagttggcccagggcttcctcggtatcaacagggacaccaggatttatctattctgcgaagtgatcttccgtcacaggtgctccagtggtttctgtatctatcagctgtccctcctgttcagctactgacggggtggtgcgtaacggcaaaagcaccgccggacatcagcgctggcaagtgtagcggtcacgctgcgcgtaaccaccactcccgccgcgcttaa

SEQ ID NO: 14859 - DNA, 205 bp, Glycine max
  Peptide Sequence Number=SeqID_106544
gtcgaagaaaactaggaaaggaaagagtcccagaaagggtgggaatcaattttggaagtccattgtgcttggctttaagactcccagggaagccatcgaaggtttcaagtatcttccaaccattgttttgtgtgaagactcggtgccattgatggtagaagccaaagacactaattgtttgtcatgctgctccaagtttaagtag

SEQ ID NO: 14860 - DNA, 426 bp, Glycine max
  Peptide Sequence Number=SeqID_106545
atggccagaggaggaaccggtctgatgggttcgatgaggactgctgcagggaggcgagtgcgaatcatgcgcatcaacatgaccaccctgactcagatatggatgactttgctgctcagcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctttggatccagataagtcgaaccgggccctgggatttcccgcgttgatcacaggactctgccagtcgtttggagtccccgttgcacctaccaagcgcatacatttttgtttggattgttgcgttagtgtttatatcattactatcaatgatgtttga

SEQ ID NO: 14861 - DNA, 426 bp, Glycine max
  Peptide Sequence Number=SeqID_106546
atgggtgatcaagaggagacacaagaacagatgaaagccgacatgtcggctttgaaagagcaaatggcttccatgatggaggccatgttaggaatgagacaacttatggagaataacgtggccaccgttgctgctgttattttggctgccaaagcagacccaactctcccagctaccgcacaccatcctctcccaaacgcgcccgacgaggttcacgaggatcatcaagagtatgcccaaggggatgtcgatttctacaccccagtccccgtcgaggggccgatgcccaacatattgcctcagcacaacctcacaacacagccaatattcttgtccacagaaggaccacccccgacggcggaagaaagaaggaaactcgatctcatcgaggagagattgagagctgttgaaggctttggtgactag

SEQ ID NO: 14862 - DNA, 168 bp, Glycine max
  Peptide Sequence Number=SeqID_106547
atgactccggtaacccgaaaggcaggaacaggagagcgcacgcgggagccgccagggggaaacgcaaggggggcggagcctatggaaaaacggctttgccgcggccctctctcttccctgttaagtatcttcatggcatcttccaggaaatgtccgtcccgttcgtaa

SEQ ID NO: 14863 - DNA, 1494 bp, Glycine max
  Peptide Sequence Number=SeqID_106548
atggtgccgcgcccgcacgaaccgccgctgggcgcgggggaatctgcgtcggtgcccagcgccgcggccatcgctaacgcggtgtttgatgccactggtatccgttttcgcgaattgcccattactgctgacaaactgcgtcaggcgctgaacggccccgatccgcagccggagccgcagctggccgcaccggcccaaaccgtccgccgccgcagccgaaaatgggcgctgggtggcgtaacaggattgctcggcctcgccgctggcgtggcgattaacgcgctgccgtggcgcgcaccgattgcgcccgtgacacccccggccgccggaagctggtcggcagagatgctggaacgtggccgtcaggtggccgccgccggtgactgcgcggtatgccataccacggaaggcggcgcgaccaatgctggcggcctgaagatggagacaccgtttggcacgctgtacaccaccaacatcacgccggataaacagaccggcatcggtagctggtcatttaacgccttcgatcgcgccatgcgccagggcatcagccgcgacggccatcatctctatccggcgtttccctacaccagctttcgccagctgagcgaaggcgatatgcaggcgttgtacgcctggctgatgtcgcagccggcggtacagcaggcaccgccagagaaccagatgcgctttccctataacctgcgcttcctgatggcgggctggaacgcgctctacctcgggcgcggcgaataccagcctgacccccgcaaaagcgccgaatggaatcgcggtgcctatctggtgaacggagccggacactgcggtgcctgccactcgccgcgtaatttgctgggcgcggaaaaacgcggggacaatttcctcgccggtggctgggtggacggctgggaagcgcccgcgcttaatcagctgagtaaagccccgcagccgtggaccgcgcagtcgctgtataactacctgcgtagtggttacgatgcgcagcacggcgttgccgccggaccgatggcaccggtagtaagccatctcgccaccctgccggaagccgatgtgcgcgccatggccagttatctggcggatatcaatggtcaggcagcgcgccctgtcgctgtgccggcggcaaaaccggcatggaacactgctgcgggggaacggctgtttaaaggcgcctgtcaggcctgccacagcgccagcgagggcggaccgcagttgtttggcgtcagcccatcgatggccaacagcagcagcataaccagcgcgacgccggataatctgttacaggtggtgctgcacggtatcgacaaaccggcaaccgatgcgctcggttatatgcccggctttgccgccagtttgtcggataagcaggttgcggatattgctgcctggctgcgccagcgctacgcacctgaccaaccggcgtggcagaatctgagcgaaaaagtggcgcaggtgcgcgctaatcccggcagccactga

SEQ ID NO: 14864 - DNA, 204 bp, Glycine max
  Peptide Sequence Number=SeqID_106549
atgagggttgtggttgggggtgatactgagggccttccgaagtgttttcaaggggtataccaccaactgctttcccttcagtggcatattcgagccaaggctcgaagtcggctagattgtgatggggaatttcatgtgtctcccccacggtttaagagacatgtgcatgatcagttcggggttgttggctctcaatgggtatag

SEQ ID NO: 14865 - DNA, 228 bp, Glycine max
  Peptide Sequence Number=SeqID_106550
atggctccgaagaaactctccacaaagaggtctagaagagacgccataggagaagggtccagtgccgcccgcgagtttgatagtcatcatttccggagtgccaagcaccagcagcgcttcgaggccatcagaggatggtcgttccacagggagaggcgtgtccagctcagggaggatgagtatacagactttcaggaggagatagctcacagatgttggacaccgctg

SEQ ID NO: 14866 - DNA, 851 bp, Glycine max
  Peptide Sequence Number=SeqID_106551
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggcggagatggcccaacctattttgacgatgtggcgatactggataccagaacctttcaatggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 14867 - DNA, 915 bp, Glycine max
  Peptide Sequence Number=SeqID_106552
atgaggggagcgccaacagaaaagagtctctcgcctttccttgtgagagattttggcgcgcaaagtatcaaggtcatacaaagagtccacaaggcatggagaagtccgttgaggaaagacaaagagcttaggggcatccgtaatggcgtcatcggtggttatcatggatggctaagagttcatacgcgagggttagattggctccccaagttgaaagttatcaatgaggagaacttcgaagctccggaggaagatgaagaagtccaagctctaaaattagagctagggaaggcaagactcgccaaagaaaagttcaagtcagccgctaccaacatccgaaaagagtgcaccgagttacgagaggaaaacgcgaccactgcaagagcccttgaacaagaaaccaaaagggcccgcaaggaggaacatggccgagataaattccgaggagctttgtggggtagcaacaatgagctcaagctctggagagaggaaagagaccagtcacgggtacatggcatgatcttaaaagaagagttagctgcttgcgcaagatctaagaggagtttcactcaacacttggaagccatggagcaaagcatgctagctatcatagggcagtacaaggaagagttaaaccagtctgtgacccatgaacaaaagctagtagaggatttcgcacaagtgtacgccgaaaaggaagcaagagggagggtgattgacgcattgcatcaagaagcgactatgtggatggataggttcgccttgaccttgaatggaagtcaagacctcccgcgactactagccaaagcaaaagccatcaccgaagtgtgtacatcccccaaggaaattcatgggctaatcaattactgtcaacacatgatagatttgatggcccatataattagaaaccgttag

SEQ ID NO: 14868 - DNA, 469 bp, Glycine max
  Peptide Sequence Number=SeqID_106553
atgaaggccgacagggaggccatgaaagagcaaatggccacaatgatggaggccatgatgagcatgaagaagataatggaagccaatgcggttgcacttgccgctaccagcgctgttgataaggtgaacccgacgcccccatctgggctcaaccaaatgaatcatccaatctcagatattgtaggcaaagatttgggaagtacaggtggcccccattatgtgcaaattcaaaacaagcacgccttcccgctatatggcttgcctgccaactatacaccacccaatgtggcatacactcccaatgagaatgtcaataactccactcccatacttattgagagccaacaacctcaatctgatcatgcacatgtctctcaacccatgggggagacacatgaaattccccaccacaatctagccgacttcgagccttgcctcggatatgccactgaagggcaagcagttggtg

SEQ ID NO: 14869 - DNA, 139 bp, Glycine max
  Peptide Sequence Number=SeqID_106554
atggccaccacaccccccgttttgttgaaaaatgggattccggggcttccgggacacccctcgcctgggcgagctaaggtcgcctgggcgagctgggcggcaacctcctccccccttttttcctataaaaaggctgaag

SEQ ID NO: 14870 - DNA, 505 bp, Glycine max
  Peptide Sequence Number=SeqID_106555
atggcaaaaggtgcagaagatgatgttagtctctgcgcgtcaacgggctcgtttgccccttggttgacgaaaggtgcgggtaaccatacggttcagaggacgatgttagtctctgcgcgctatcgtgctctagaaattgactgtgcggagaaattacccttgtatctccgcatgtcaactgactttagggtcaatgtgacagaaagcgcggaagacgacgtaaatctccgagtgtcaacgggctcgtgggccgcgattgacaaaggggtcagcgtgacagaaagcgcgaaagacgacgtaaatctccgcgtgccaacgggatcatgggccgcaattgacaaagggtgcagaagacgacaaattgactgtgcggagaaattacttgtgtatcctcgcatgtcacctgacttcagggtcagtgtgacagaaagcgcgaaagacaatgtaaatctccgcgtgtcaacgggctcgtgggccgcgattgacaaagggtgcagaagacgac

SEQ ID NO: 14871 - DNA, 242 bp, Glycine max
  Peptide Sequence Number=SeqID_106556
atgtatctttacacaaaacaaaaaattgttaacgctgatggctccgatattacagcagccgatcaaagcgatgctgcaccagttaattatgctctccatgccatgtggtctcaaattgacgtcaatcttaatggaactgtcatctctcagtctagtatgacttacccctatcgggcatacattgaggcaaaactcaactacaacaaacatgccaaagaatcgcatatgcaacagcgactctg

SEQ ID NO: 14872 - DNA, 207 bp, Glycine max
  Peptide Sequence Number=SeqID_106557
atgttcttcttcgctataggccagatagtcgcctttaccgggaataatcgcgccgggggggacattttcggtatacagcagagtatggcgcgacagcagacgcaggaaatagcggcaatgtctgtcggtccaatcaagcatgggcgcgatagaaaaacggtgggcggcaaaagcggtagacgtggattctggcatcatggcgaataa

SEQ ID NO: 14873 - DNA, 831 bp, Glycine max
  Peptide Sequence Number=SeqID_106558
atgtctcttaaactaccatactttcctaaattagttaaggttttctataataatttgaaaattcaagatggcgttctttattctgaggtgcataacattcctattattgtttatcagtccttgtgtttttcattgactaaactgcccagtcaaggtgttccttttgagggcacttttgttgatgactggaaatttgattattcaagtcgtgatgctcgcaaaatggtctgcaatgatcagactaacatgaccggcagatcacttgctgggtcatttactttcgattgttgcatcatgcactatatcattgttcatattttgcttcctcgatctctaaatcttgcccaagcctctgaggaggatttgattttgttatgggccattcaaactggtcgtcaaatcgactgggcccatctagtttggtactggatgcataaggcattaagggccaatgcacatctcctgtatccccaccttgttactctttttcttcatcatttcaatgttcctttggatgatgaaccatatgtcaaggctaaaaggtctttctccattggtgccggtgttgttacctcctttggttaccggaaggatgttgatggtcagtgggttcgcaaacaagacttgccaccgcctattcctgacgaacataccccatctcctccaccacaaagggatgcttcttcttctctactaactgaagtcctcacagagctctgcaatcttcgagcatttgtgggtgaacattttgatgtgatggatactcgctttgatgggatggatactcatatcactaggcttaaagattatattgaattagtttatggataa

SEQ ID NO: 14874 - DNA, 297 bp, Glycine max
  Peptide Sequence Number=SeqID_106559
attcaagggactaaccgcctaagaattctttgtctaaaaacattggagggtacatccttttgtggtacaagtagagcgtacatctacttgagttgtaatactcagaacaagagagggtacgtctcttgtggatcagttcaagtggagggtacatccagttggttgttcaaagagaacaagggagggtgcatcccttgtggatctttgcttgtaaaggattttacaaggttattggaaatctcaagaatcggtggttgcttggggactggacgtaggcttgggttgtggccgaactag

SEQ ID NO: 14875 - DNA, 1358 bp, Glycine max
  Peptide Sequence Number=SeqID_106560
atggccatcaaaaactcaagggctcaaacacaaaccctcttctctattctcgtgctcattatttccttccttgcgttggtccacaacgttaaatcagtttctttctcattccctagttttggctcctacacaaacgacatcaccctccaaggcgatgcctatgtcaattcagaaggcgccataaagctcacacctgttgcccccaacagcgttggtagagcgtcctacgctgcacccgtgcacctttgggacgccaaaaccggcaagctcgccggtttcaacacaaccttctccttcgtcgttatgccgaatgttcctggactctttggcgacggcatcgccttcttcctcgcaccgttcaactccaacatccccaacaactcaagtggtggattcctcggactcttcagccctaactatgccctaaatgtatacaaaaaccaaatagtggccgttgaattagactctttcagtgggaacccctgggaccctccctctgcccatgtgggcattgatgttaactccattgcttcggtggcgacgagaaaatgggaaactggaaatgctgtgaatgggtttgttgcatatgcgaatttgaactatgagcccgttggcaagagtttaaacgtacttgtaacataccctggaagcaaagtgaatgcgactagcctctcgtttgtgattgatttgagaactgttctgccagaatgggttacagttgggttctcaggtgccacaggacaattggttgaaatacacaagattttctcttggaccttcactcacactgatttagctgcatttcatgctctatatatagtgtttgagctgaaacagtggttgaatctaatggaggccttgaacaacgtctggctcaagttgataagccacttggccaatcttcctcaagatcttgaaagacccatggagcttgtcgaggcgtgggaagtgaacgaagcagacgaggcaagagtgggacttgaggcggcgaagggcggtgtaggacttgacgttgaagacctagatgaggtcagagaggtcggaggcggcgaggagaatggcgtcggagcggaaggaggcgcagcttgtgcttccacctccatcaccagcagcagccgctacgagaaccagaagcgccatgactggaacaccttcggtcaatacctcaagaaccacgaagttatggaatgggttgagcttaaaccaatcaaagatgcacttgtgggtcttcaaggcatagatggtctatcaacggaacaaaggaaaaggcttactattgctgtagaattggttgccaacccttcaatcattttcattgatgaaccaacatctggccttgatgctacaactgcttctat

SEQ ID NO: 14876 - DNA, 237 bp, Glycine max
  Peptide Sequence Number=SeqID_106561
atgaagaagagggtggtggataagctcatcgagcttgtgggtcatgtgctggagggtgtcactaagggaaagctgatgggtgttgtctctagaatatttccattggatttaatgatgaaatttgtgcaatttcaagttaaaaagaggctaagtcatgaagtgctaaaagtgacagttgagctcagctcagtagttggtctaagtgcgcatccatcgttaagcacaacttcagcgtga

SEQ ID NO: 14877 - DNA, 279 bp, Glycine max
  Peptide Sequence Number=SeqID_106562
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccaccacagatttagtagaggaaaaccgttatttgcagtccaaggaatcagcattagaggctacatttctcatgaagatgatggaatcttag

SEQ ID NO: 14878 - DNA, 699 bp, Glycine max
  Peptide Sequence Number=SeqID_106563
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgtcttgctggaggttccaagatcaatgtccctattcagcatctcttggtcaatagtatcatcaaaacttgggatgttcagagggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 14879 - DNA, 164 bp, Glycine max
  Peptide Sequence Number=SeqID_106564
actcatcttctccttgaagtggcgtctcctctctctcttcctttctccattctgctgccattcatctttcaagaagcaaaggaatccattgatgaagaagatcctaggcctacaagctccaatggagcttacatcacaaatgatagtccccagatcaaattagg

SEQ ID NO: 14880 - DNA, 297 bp, Glycine max
  Peptide Sequence Number=SeqID_106565
atgttgagcctaaccaagctaaactcttcctccttggacaatcctctatctggtggtgatgttgaagaagtagaggggtggtggaagaaaagggttggaggaggaggaggaagacaggtttgtgcctatgatgcgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 14881 - DNA, 300 bp, Glycine max
  Peptide Sequence Number=SeqID_106566
atggttcctgaggatattaggacaaagagaaaaccctttgtgaagcacttgaagagtagctgggattggaaggtccaatcctatgttccaatggaacttggagaggatcacatagatgaagaacaaaggagtgaaaaatgtgttccacaatctgagaatcacataaatgaagaacaaaggagtgaagaatgtgatcctcaaccaaagaatttgaggtctcaaagaaataggaggctgccattaaaactcaatgattgtcaaatgattcctgataatatgatcacaattgatgggaaattg

SEQ ID NO: 14882 - DNA, 180 bp, Glycine max
  Peptide Sequence Number=SeqID_106567
atgaagtttgggaatcaagaattacccgtacttacaaatgagtttactaccctggacctgatgcaatcctaccccccaagggcattggatagaagactccaagaatattggaccaaagatgcaaaagaaggccctagggttctcatgagtcttagggtagatttcgggcccatgggctaa

SEQ ID NO: 14883 - DNA, 588 bp, Glycine max
  Peptide Sequence Number=SeqID_106568
atgcccagaacacaaggtttaggtcgtgccataggtagagttgtaggcagagatagacctgttgatgaggatgctggcgatgttcccgagaggcgtagacctactgcctcagtccgtaggctacacgttcatcagatgactacggagggacgtgatatggctgaggacgttgctgacatgactgacgatgtccctgagcagcctacggaggcacctgagatgcgtacgcacagggtgctgatagtggtgaggggtcagatggaacatcctgatttgaagttagtgtcacatgggaggaaggtgacactgattgggaggctagtgcctgagattgaaggcctggtggttgccacaggattaagtccactgatagattgttcagttattactggcgatcctggacttatatccgcatttgtggagaggtggcacagtgagactagcaccttccaccttatttttccaagctctttctacggaggaggccagattcttgcttacggagttgctggaagtgcctgtcgaggaggccagagtcgagacaacactcacacgtggagcatatgtacgattaggatgggttcgtga

SEQ ID NO: 14884 - DNA, 462 bp, Glycine max
  Peptide Sequence Number=SeqID_106569
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggtaatcgattaccagcagttgaaaatgttttaa

SEQ ID NO: 14885 - DNA, 408 bp, Glycine max
  Peptide Sequence Number=SeqID_106570
atgggttctccacctgcctccactactcctcctcctcctccttctcctccttctcctcctcctcctcctcttacttcggacgcatcggcttcgacgtctgccgtgaagcggacatgcaaagcctcacgcctacgatcgttgtccactaaaccacctggtgttgagagaccagtggtgcatgttgatcctgctacagggaaggccgacggtggacatcacctacgagaactagaaggaggtccctactgctcagaaggacctgatttgggaggatattcagacctcacgaggaaatgggcccttacagccgatcaagatggtgtcgaggacactgtctgtgacaaatacggcatcagcaaggaaaagtgggcccagttttgccagactcgcagagacccttcttgggag

SEQ ID NO: 14886 - DNA, 1584 bp, Glycine max
  misc_feature (1549)..(1549): n is a, c, g, or t
  Peptide Sequence Number=SeqID_106571
atggagcaaggattaaaagacgtggatgtggtgatgatgttacgcctacaaaacgagcgcatgtccggtgccctgctgccaagctcacaagagttcttccagacatttggcctgacccctgagcgcctggcgctcgctaaaccggatgccatcgtcatgcaccccggcccaatgaaccgtggcgtagaaattgattcggccgtggcagatggcaaacaatcggtcattctgccgcaggtcacatatggtatcgcagtccgcatggcgttgatggcaatttctggggggaggcaacgccgcatgaatatcgtaattaaacaaggccgcctgatggatgccagccagtcactggaccaggtcaaggacctttatatcagtgcaggcaaaatcgtcgccatcggtgaagcgcccgcaggctttaaagctgaccaaacactggatgccagtggcaaatgggtgttacccggactggtcgacttgtgtgcacgtctgcgcgaacctggtagcgagtacaaggcgacactcttaagcgaactacgcgccgccatggctggtggcgtcaccagcctggcctgcccgccagacaccgacccggtgctggatgagcctggcctggttgaaatgcttaaacacagggcaaaatcacaggcactggcgcatgtctatccgctgggggctgtcacacgccagctagaaggccagttactcactgaaatgtacgccttaactgccgccggctgtgtcggcttttcgcaggcagacaccgccattgtcgatacgcaagtcctatggcgcgcctttgaatatgccgcttcttttggctataccctgtttatgcgtgccgaggatccttacctagccaaaaatggtgtcgcccacgatggcgaagtagcttccagattaggcttgaagggcattccttctgcggcagaaagcatcgctttgcaaaccatgctgcgtattgcgcaagccactggcgtcaggttacatatcgcccgcgtctctaccgcagaatctgtggaattgatccgccaggccaaacaatccggcatgcaagtcacggcagatgtcagcatccagcatttgcacctgactgatatggacattggctttttcgatggcatggtaaatctgaaaccaccagtgcgcactcaacgcgaccgtgatgccctgcgcgcaggcttgatggatggtacgctggacgcagtttgctctgaccatacgccagttgacgatgacgccaaagctttaccatttgctgaagcgcatccaggcgcctccgcactggaactgttgttgccattgaccttgaagtgggcggcccaggccaaactggcgcccgtacaagccttacaaaaaatcacgcaaacccctgctgacatccttggaatcaaggcaggcaatttgcagctaaatagtaccgccgacgtcgtgatctacgacccggagatggagtggcgtgtggatggtcgcgtactcgtcagccagggcaagaatacgccttttgtgcatcatgcactcactggcaaagtcacagccacgctgacgnaaggaaatttgtcttccggggatcctctagagtga

SEQ ID NO: 14887 - DNA, 636 bp, Glycine max
  Peptide Sequence Number=SeqID_106572
atgactccacctaaaaaaattgtgaccatcatttaccacaatggtcacattgtagatgatccagttcaaggatcgatgtacacatctgcgaacccaatatttgtttacatcagtcgttctattacgtttacacaaatcattcaaaaaattaacaatcgtctccctgctcgagcaactgaacaagttgctcaattgttattttgtgtccctatttcatttcatatgggtcagacacgttttatttcagcacaactattcgacaatgatgatctcaaaggcgcaatggaaacaattgtccagaatccacaattgaattctgccaaattctatgttgttactggccttattcctcaaccacaaccatcatctccacaaccctcatgtccacaactacaactatcgcctccacaacagttactgtacaacaacataaacctcaataatccaatatcttcatacaacaaccttgaatcacaagatccctttgacatttatatttcatacacacaactattatccaaaaatgattctttttttcatgcccaacaaacctcctttgaccaacaaaaccatcattcatccccctttacgccaccttcacagctaccacaaatgcaaacatcaaaccgagattaa

SEQ ID NO: 14888 - DNA, 153 bp, Glycine max
  Peptide Sequence Number=SeqID_106573
atggggaccaccaaggaccgaagaacgacgaagaacgaacgaaagatggcgaaaaatcttcacggaatcacccacggaaatgtttcggacgcgttacggaagctcctcgacttggattttcttcacggaaacgattttttcactaatatctag

SEQ ID NO: 14889 - DNA, 118 bp, Glycine max
  Peptide Sequence Number=SeqID_106574
gtcgactctagaggatcccctttctagttgctctggaacattaggagattctctagaagaaatacggagttttgcttttggtggcaacatgctatggggtggtggtcccacttatggg

SEQ ID NO: 14890 - DNA, 561 bp, Glycine max
  Peptide Sequence Number=SeqID_106575
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggtggcccccatgatgtgcaaattcaaaacgagcacgccttcccgtcatatggcttgcctctcaactatacgccatccaatgtggcgtacactcccaataagaatacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 14891 - DNA, 387 bp, Glycine max
  Peptide Sequence Number=SeqID_106576
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaaagatgcgcggagtcgccaccaacgtttatttgtggaaaacgtcggaaaaaccgaaggaaaccggtcgaaacgaaaattctaagttcgggagttgtatttacgtttgaggaaggtattagcacctctcacgtcgacaaaagcggggctcttgctcctacgtaccctccatcgaagaggaaatcagacctacgtagttctttcttaagcgtgaatcaagcgattatttttacttga

SEQ ID NO: 14892 - DNA, 1476 bp, Glycine max
  Peptide Sequence Number=SeqID_106577
gctcatgagaaccctagggccttctcctgcatctcttgcccaaccttcttagagtcttctatccaatgctcttgtgggttaggattgcatcagacgaaccttgggttagacaagcctttggagaaacgagactcaccaagggcggaccttgggtatgacgagcctatgagactcaccaaggacataccttgggagcatgtttgccctgtgttttcttcgttttgttgttcttgggaaaaaagcctcgttgtcgatggttccctgacttcgacggggatcaaggcgtttgtgccatatggccttgaggataactttgttggctgcctctacctaacgattagtctgaggatgttaacagaggaagtcttcgtaagactgagctttgaattgggtgttgttgttggtgacaatggtgtaagggaggccatacctacatatgaggtgtttctagcgactaataaatatttgacagctcttggggcctttggcagtggtcctacatcgcttggtgaagtcaggggtgtttgccctgagtgttggccagtagtagctgtcacacaccactttggtggcaagggagtgtcccctggtgtgaaggctgcacatctcttcatgaagctctcttatgacatagtctgctattggctattcaagcattttaacaagggtattgtcaaacctcttttgaatagtttgccatcaaggatgacgggttatccggtctggttccacctcttctccaattataacttcctcggtgtctatggtaggggttgggagcgtctcctggatgataatctagaggtgctcggtctttttggtgatgaccagtttggagagcaagtctactctagtgttgctttccctagtatctactggcaacttgcccctggacaagctatgggtgacattgttaaagccttcaaggatgattcctgccttacttcccttcatgttggatgcaccgtcaacatagaggctccaccagtctccggtgcgcttctcggtgccatgaagtatgcagctggtgaagtagatgggaagttggtgtttcccttcctcttaagtaagggtactcctgacctaggactagtgaacagctttgcttttttggcgagcttggtgaggaacttggacatggatgctagtgtgccattcagcttctggacttcttggatgttggtaggattgtgcatctccaatatggctattcatttgtcagggttggcttttattccccgatgtgtgatcatgaagcctgggaacttgtctccgccgacctcgaaaattggtgtagttggtgcaaatccgccatttgttgttggcctttttgaccaagacgacattggcgagctaggtggaatacttgacttctctgatgaagttggctttgaggagcttgtccactattctctaaccattttgcgtcattcttctcccatcttcctcttcttctatgataccggtttggcctag

SEQ ID NO: 14893 - DNA, 435 bp, Glycine max
  Peptide Sequence Number=SeqID_106578
atggaatcatctcttttgacattggataacctctttcgctcgcaagccggctcagagcttggggggacttatgtactgtctagggcctacaaaacacatgggtctagctacatgacactcaaatctattatctacaagccggtaattatctacaagggttattacaccaccataacaggcccctacaagcaaggactcacaggtcctagtctacactataattaccaggtcgacaaaagcggggctcttgctcctacgtaccctccattgaagaggaaatcagacctacgtagttcttttttaagggtggatcaagcgattctttttacttggaaggtgatcattttaaggcgtttggaccttaaaaatgatccatttacttgtttccaacgtggttacggtacgacggaacggtcggatttcattttagcataa

SEQ ID NO: 14894 - DNA, 1161 bp, Glycine max
  Peptide Sequence Number=SeqID_106579
atgccattgaagctatttgagttccacttgaacatatttcgccatttcaaggaccatttctttaaggtcctggctactaatgtcgtggttgatggcttgccattgatgttcaatcgagattggggagccccgcttccagttctagtggatctattgacccttgtggagagggtcaacaaggccatcttggagcagttgtcagccatgttggatgcgtggggcattttatctcttcctttggtggatgatctttatgctgccttggatgataaagtgccaaaccttgtgctcttttgtattatgggtgacttcgctaggaggccactagtgaagatggttttacctgctggtgggactataccatcgtctactgttgttcctcctgctagagaagggggtcaacctgttgtcaaggatggccctgttgctgaagttgctgaggtcacccccagcattccttcctctattttggctaagaggaagcaagatgggttgacgcctccattggtcgtcaaagtttctgctcttgttgctaccgctattgttgttcctgcttctccaccttcttctgttgtgcttgttcaggaggttgctcctgctgtggaagttagtgtaccgaccactttggctggtccaaacgtggctcctatgtccaccatcactgcacccttggtaagtgcttgtgtgattaccacgagtgatcccgagatgccgcctcctccttctttaactcctcgagttcccccctcggccggtgtaggttacaagtcggagcagaagacccctgttagctttgtggtggccaggaggttcaaaatgctactgattctggcaaggttttcctccagagaagttgccaagtggaaggtcactactcaaattgtttggcgagtagagcatcttaaggtggccaatgccactattgcctttactgaggcagtaagaggcccgattgaaggagtcagaaaccaactggaggagttcgagctacaggcattcaaggaaagggaggccaacaaggagcttgaagaggagccgctgatgcaggccgggttcttcgtcaaggaccttgacttgggtctttttgacctattcaaggatggtgttctgcttgagaatgaagatattgctactgaggagaatgctattgaggaggagtag

SEQ ID NO: 14895 - DNA, 318 bp, Glycine max
  Peptide Sequence Number=SeqID_106580
atggctatcttgcaagagtcctcagtacttgccaatttcacttggcattacagagtagcaacagtcgccatagagttgctggaggacttatatattagacgttgtacctcactcactcaaagccaacaacgacaaggagggatgatggcgacccaacactatggctacatcacaccaatagaagggggaagaatcatagtgactgagataggttccctaatcgaggaagtagcggaaggttacaccctcccacggaggcaagaaatgcctctaccagtatggggcgaaaccctcaacctctctgaggaagaggattag

SEQ ID NO: 14896 - DNA, 97 bp, Glycine max
  Peptide Sequence Number=SeqID_106581
gcattctcggtagaactcgctaagcacacctaccgcgctaagcgagttcatcctttgaggatgaacactcatgctcttgctgagctacctgtgctaa

SEQ ID NO: 14897 - DNA, 505 bp, Glycine max
  Peptide Sequence Number=SeqID_106582
gagagccaagaggtggtccactcatccaagggaaacatttggaaaacctgtgaagaatgaagcattggagagattcagaggcttgttgagaagaactcctactcatgggttttctgagccaatccaattgaatatgtttatagatgggttgagaccacaaaccaagcaactattagatgcttctgcagggggaaagataaaactgaagaccctggaagaagcaactgagctaattgagaacatgttgttaccatctgtggtgaggctcatgaaacaggccaatgtattcccactgaagaaaacactcaagaaattcattatatgggaaatcaacagtgacaagggtatactcaaggaggattttcaggcttccagtagggtccctccctataatcaacaaggacagtggaggacacaccctggaaaccagttcaacaaagaccagagtaggccttcaaacaagccaatccaacaagggcctaacaaaaaaccagaggactactaa

SEQ ID NO: 14898 - DNA, 429 bp, Glycine max
  Peptide Sequence Number=SeqID_106583
atgcgcagaatcgccaccaacgtttattcgaggaaaacgttggagaaaccagaaaggtgcagagaaacgcgaggaactggaaccaaagagccggcacgcaaactgaggcaggatttcagcatccaaaaaggtccagtttttttctcctttatagctgagtatgaggtcaaatcaaaggaaaagaaacttccagcagccctctttctccctccatgttgctttttctcctcttcttctccaccattgttgcctcccttgaagctccaaattcctcttcatttctaccccaaattgcaaggaaaaactattttcggagtcttggagcctacctctacttcgtggggccttaaatttcaggtggaaaagtgtgagattttgaaggttagaaaagccaaatttggggttagtggaaattggagtctaaagtga

SEQ ID NO: 14899 - DNA, 228 bp, Glycine max
  Peptide Sequence Number=SeqID_106584
atggcactggaggacatggaaaagacaattttcgtcaccttatgggggacaagaacactgtggcttggtgtgggcagcccatcgtctaaggcagtacatgctgagctacaccacttggttggtatccaagatggacccgatcaagttctgctgtcagagtttgacattgtttatgtcactcaaatggcgataaagggaagtgccttggtagattatctagctcaatag

SEQ ID NO: 14900 - DNA, 261 bp, Glycine max
  Peptide Sequence Number=SeqID_106585
atgatgctctcctacaacctaagacaagatgaatggcagcggaatggagaaagggaaagagagaggagacgccacttcaaggagaagatgagtctagaagaagctcaccaacataggaggccatggataagagcttggaggaagaaggatatgaatgaagggagagggagagaagagcatggaattttgtgctcaaaaagagctctgaaatctgaagttcatattccaatgatcaaagttgaccaaaatgcacacacatga

SEQ ID NO: 14901 - DNA, 315 bp, Glycine max
  Peptide Sequence Number=SeqID_106586
atgtctcttgcaactttatttggaaaacttcaggaacacgaaatggaactaatgagactgaatcaacatgaggagaatgataagaaaaagaaaggaatcacacttaaagcttcatcttcaattcaagaaggaagtgataaagaagatttgaatgaagatttagaaaatgaagttgtgaatctgagtctgatgggtagaaattatgaaagcgatgaagaggtaacatcttctgacaataacttatctatttcctttgatgactacaagatgcattcactaatttacataaagaatcagttaaacttgcaaaactag

SEQ ID NO: 14902 - DNA, 649 bp, Glycine max
  Peptide Sequence Number=SeqID_106587
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaacttcggaaaaagagttg

SEQ ID NO: 14903 - DNA, 237 bp, Glycine max
  Peptide Sequence Number=SeqID_106588
atgagattgactcggtcctgcaattctgtcattcttccacaccaggttgccatcttggcatacagaggacattcacaaggtttggagtccctagagtcatcgttagtgatcaaggcacccatttttgaaacagatccatgtatgccttgctcaaaaagtatagggtcgtgcacagaatttccacaccttgccacccccaaactaatgagcaggatgagatttcaaacagggagataa

SEQ ID NO: 14904 - DNA, 204 bp, Glycine max
  Peptide Sequence Number=SeqID_106589
atggccatgagccatgggcgcttgtatccacaaaggataaagaacgcattcgacaaaaagatatcccatgctgttaaagataatcgagggaagtgggccccgaattacgaaggacctttcgttgtgaaaaaaggctttttctgggggggctctggtgctcaccaatatggatggcgaggcgctaccctcgctcgtgaactctga

SEQ ID NO: 14905 - DNA, 558 bp, Glycine max
  Peptide Sequence Number=SeqID_106590
atggatgagcgtccacgtggcccaggtatgccacccaccaggcaccctctagacttggataagtctaacaaggccctgggatttctagcattgatcacgggcctctgccagtcgttcggggttcccgtcacccccaataaggtgatccaaccgccgatcacccgggccttcatcgagaagtattgcacgcctagggaggcggatggtgatgcacctcaggccgcagatgcaccaccaccacctcatcaggatggatcactaggcatggagcattatctacagcacttggttcgccagcaggcggccaaccaccgagggcaggtgcagatacatgagtgtctctaccggttcagcctcagtcagcagggacagggtttcactccttttgcatgccctactctagagcagtttggggatgaggtcgcatggcccggagattggcccgaggcccaggcaggggaggagcccgcaggatcccccggtgaggcaaaggaggcccgtatggatgaagaaatgacggacttgcttggtttcttgggaggaagcggagtcacgtga

SEQ ID NO: 14906 - DNA, 467 bp, Glycine max
  Peptide Sequence Number=SeqID_106591
atggcctccaggaaacgtaagagcattggggcaaggccaactgctcagtatgatactagacggttccattcacttgattcttggaaccgttatacagataatgtcttagggaggagtatttttacagagaggaaggttgagatataccacacggagttcgatgacttcaagacagagttggagaggcgtaatcttcacaaacgcctcatcaacttggctgatgggactattgatcttgctttggtgaaggaattttatgctaacctctacagctctgaagacccttcaccaaagcaagccagagttagaggccacttggtgaagatagacggtgatagcctcatcacatttctagagactcttgtagtcctagaggaggggaagacattacccatctactctaggtattgcaggttacccacagatcacagagagattgaggctgctctatgcatacctgggagggg

SEQ ID NO: 14907 - DNA, 296 bp, Glycine max
  Peptide Sequence Number=SeqID_106592
ttgagcttaactcatcagtgggctaagcgcgcatccatcgctaagcgcaacttcagtgcgcttagagcgatagaagaatctggaagggcatcaatatcaaggtcgtgcgctaagcacaagatcagtgtgctaagcacagcagttgtcttcagccagcctcagcgcacgattggcgctaagctcaacggtacaactttaagaatacccagggcacattccacagcacaccagagtgcctatttcgggaaaagagctctggaggcagcaagaggagcagcttttgcagagatacctag

SEQ ID NO: 14908 - DNA, 174 bp, Glycine max
  Peptide Sequence Number=SeqID_106593
atgtgcccccatgcaggcgcaaggcgagacaccacagcagcctggggatggccggcagtgggcaacggacgcaccgccgccacctccagagcccctcagctcatctacaaaggctggagcattgcctatgacccatggttgaccagtaggcaaccaagtccaaagccaaagtag

SEQ ID NO: 14909 - DNA, 533 bp, Glycine max
  Peptide Sequence Number=SeqID_106594
gacggcgggacccgatgacaagcagagaccaaagtttggtcattctgcacccatgatacgcggagatactttatggttattcgcacccttttgtcatccagaggcggcgggcccgatgacaagcagagaccaagtttggtcattctgcacccatgatacgcggagataccttatggttattcgcacccttttgtcatccagaggcggcgggcccgagactttttcaagtcaaaccaacggcggccttttgatgactcaagcaagttggtcattgcacccagtcgcggagataccttatggttattcgcacccttttgtcatccagaggcggcgggccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccttgtatcatccagaggcggcgggcccgatgatacgcggaaatacccgagtg

SEQ ID NO: 14910 - DNA, 388 bp, Glycine max
  Peptide Sequence Number=SeqID_106595
gtacatcatgaattcggttataacagtgttgtatttcaatggaagagtatatgaagagaatgatggtgtaatatttgaaagcagtaaaaaagcgattcagattaaactttctggaaaatatgatgctttgcaaatttgtgatgacgaagatgttgaaaccatgctcgaaagttttcaacaacaagatcaaatgtcagttctggaattgtacatagaaaaggatgtgactggtggttctatgtttcattctgcaaattctcttacatcatgtgaaaataatttatctaataatgaggcgcaaccgccaagaaatgtgagtaatttacatggtgataaagatgatgattatcttgtgtctaactcatacgttgaagagtctttagattaa

SEQ ID NO: 14911 - DNA, 372 bp, Glycine max
  Peptide Sequence Number=SeqID_106596
atgttgcatcccccactatgcatggctgaaggaggttgcactacatgctcaatcatagaggatggtgtgatcactggctatcatattctctatcagctccatggcttcttctcgcatcttcagcttgatcttcccaccgacggaggaatcgaggagctgcttggaatggggtcacaagccatcaatgaaaatgagtcttccggagtaacccatggaagtggtcaagtgcttcactcaacgattcatcagggtgttggtggaagaatgagatctccaccttaccctcaacggtcttggactccgggaagtacttcttcaggaacttctccactacctcttcccatttccgcaggctattccttgaacgagtga

SEQ ID NO: 14912 - DNA, 328 bp, Glycine max
  Peptide Sequence Number=SeqID_106597
atgaaactcttaaaatacaatacgaaagcgcctgaagttctcacattatgtgagcttctttataagttgggatatcctattaaaatttcagattctttcagcctggaagtagatgcggcagttaaagatttccaaagcaaaaatgctttagtaatagacggaattgtcggaataaaaacatgggcagtattattgcagaaaaattctaatccgattatctcaacggataaattccttaaagaaagtgaccttatctcttttgctgatcagtacgatcttgaattagcagctgtaaaagccgttaatgaaattgaaagcagtggaaaag

SEQ ID NO: 14913 - DNA, 348 bp, Glycine max
  Peptide Sequence Number=SeqID_106598
atgacaattgaggaatcaatacatgtttcttttgatgaaactattattacctctccgagaaaggaatttcttgatgatattgcagattctttggaagatatgctctatcaagaaagaaatctaaaaaggaagagaaatgaagaaaacaaggatattcaagaggacatagcccaagaaaatgatgatcttcccaaagaatggaaaacttcaagaaatcatcctcttgacaacagcatcggagatatctcaaaaggggtaatgtcataccctaatttcgtccggggacctttgctcgatgacgtgcgaccattctttggtcctcgtgaggtgcttggcacccatcattag

SEQ ID NO: 14914 - DNA, 264 bp, Glycine max
  Peptide Sequence Number=SeqID_106599
atgcacaagaaaaaccgtgcgtggttctcatcacacaaccacaagaagaagcattcttgccagcataatgtacacgctaaaaatcagcagcaatctcatttaaagcgtaccttgaaaccattccaagaagcctcttgtgatgcaatcctccctaggaagggaccagtcactagaaccatgagcaagaggctccaagaagattgggctagagctgctgaagaaggtcctagggttctcatgaaccttaggggctccatattgtag

SEQ ID NO: 14915 - DNA, 297 bp, Glycine max
  Peptide Sequence Number=SeqID_106600
atgtcttttgaggtgatgtcttcattgacatcctttattttaaagggagaggcaatgacaggtttatcattactttccttgacctttggcaattggtactgtgttgttggaggtatactagaagttgtatctaatccttggaggtttatacaaggaaactggttatgtgactcaaatctagataaccctactagaattgaccgggttcttactgagaaagactttcttgccaattcatactcgaatcttgaggcttctattctagatgagaaagagtttgtcctattaaaggtctag

SEQ ID NO: 14916 - DNA, 50 bp, Glycine max
  Peptide Sequence Number=SeqID_106601
atggcgccaaaaacttgttcggcttccggcaagtgcaccggatcgcacaa

SEQ ID NO: 14917 - DNA, 159 bp, Glycine max
  Peptide Sequence Number=SeqID_106602
atgaaaccccaagcgtggtttagaggaacgagaaacagggaaaccgattatcaccaggaggcgcaagaggtgacttatatgttctttcccctaggccagaatcatatttttataatcgtttcaaatcaggatcagcagacatttggcatcaacgtctag

SEQ ID NO: 14918 - DNA, 114 bp, Glycine max
  Peptide Sequence Number=SeqID_106603
atgtggttgttccttcaagcttcgtgggaaaccagtgattggagggcaaggtttcacatcgacaagaatgtcaaggccaaatgcaaatccttaattggtcaaaaaaatgcttga

SEQ ID NO: 14919 - DNA, 819 bp, Glycine max
  Peptide Sequence Number=SeqID_106604
atggggatgaggggttgcataagttacaatctcgttcttgctataaggcaacttggctaccctatgagaggggcaccactagaggaagagatcgcgcctgtcatttcacgaggtttcaataagaccaacatggagacgcttcagaaggtccgcaaggcatgggagatggtgcgaaagaaggacaaagaactcaggggcagtaacaatgggcccatcagtggctaccgtaagtggttgaaagcccatgtgcaaggtttcgattggatcctgagtttgagaaccgctaaaagggaggaagttgaggcaccggaggaagatgaagaggtgcaggcccttagggcagaactcaagcaagcccaaacaatcaaagaaaggttcaaatcagcggctctgaaaatccgaaaggagaatgccgaactgagagatataaatatagcaaccaccaaagccttggaacaagagaccaagagggatcgtagggaagagcacggccggaacatgttccgaggggctctgtggggcagcaacagcgagcttaagctccggatagaggaaatggaccaatcgcgagtagacagtttgatcttgaaagatgagttgaaggtttgctcgaggtccaaaagaaacctgtctcagtggttatgcgagacagagaccaacatgttagccatcatcagcaggtaccaagaagaactaaatctagccacgggccacgagcatagagtggcggacgagtttgcccaagtgtacgcggaaaaggaggctagaggaagagtgattgactcgctacatcaagaggaaacgatgtggatggactga

SEQ ID NO: 14920 - DNA, 435 bp, Glycine max
  Peptide Sequence Number=SeqID_106605
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatatgtgccttggagaggacttcttttgtgttgcatcttgtttag

SEQ ID NO: 14921 - DNA, 228 bp, Glycine max
  Peptide Sequence Number=SeqID_106606
atggcatacaccaactggcacttaggtagagggaggtcggagttgtggtcgctaagcaagacattgctgaggagcagtgtcatccatatctgggtcagggtagtcatgctggtgcgcatgatccgcacccgccttcccgcaatggtccgggcgaaatcttgccccggtatgcacagtagctgggcgatggcttcctcatcgaagccgtctgcctggctccttctctag

SEQ ID NO: 14922 - DNA, 887 bp, Glycine max
  Peptide Sequence Number=SeqID_106607
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaatcccatacagtatttcttgaagaagactcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 14923 - DNA, 120 bp, Glycine max
  Peptide Sequence Number=SeqID_106608
atgtcgttgtcgacaggcgatatcccaccccacatgaacaaagaggaaaagaccgaaacacccagcttcctctccaagaacactaccctcgagaaaatcctattggtccgtgatccttag

SEQ ID NO: 14924 - DNA, 615 bp, Glycine max
  Peptide Sequence Number=SeqID_106609
atgatacgcggaagataccttacggttatccgccccccctttgccattcagacacagtcgtgttcgatggcaagcagagaccaagtttggtcattctgcacacatgatacgcggagataccttacggttatccgcccccctttgccaatcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccaccccccctttgccattcagacacagtcgtgttcgatggcaagcagagaccaagtctggtcattctgcacacatgatacgcggagataccttacggttatccgcccccctttaccattcagacacagtcgtgttcgatggcaagcagagaccaagtttggtcattctgcacccatga

SEQ ID NO: 14925 - DNA, 606 bp, Glycine max
  Peptide Sequence Number=SeqID_106610
atgcagcagttcatgagcgagcttgcgcaacgcatgcagaatgcgccgcaagccaacatgaaccaacaggcacagaacgtgctgcgccaacgcgatctggaaaacatgatgaaccagatcgagaatctcgcccgttccggaaaccgcgatgccgcgcaggaaatgctctcgcaattgcagcgcatgatgaacaatctgcaagccggccgaccgcagcgtcaggggcagcaaggccagcagcagagcagcaagatgcgccagcagatcgacaagcttggcgaaatcctgcagcagcagcagaagctgatggacgaaaccttcaagctggatcaggcattgcgcgaccggatgcagcgcggtgatccgcagcagggcggcgaaagcgacgaccagcagatgggcgaaaacggccagcaacaacctcagagccagcaaggccaacagggtgagaatggccaacagggcggacagcagcagacggaccagatgaccgccgagcaattgcgcgaagcgctgaaaaacctgcgggcccagcaggatgccctcggcaagcagctcggcgaattgcagcaggggacttcgcgatctcggcatggagccgggtga

SEQ ID NO: 14926 - DNA, 800 bp, Glycine max
  Peptide Sequence Number=SeqID_106611
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgggccgcacagcaggaggtgagcagcaggagcacaaatcctattgtgaactgtacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14927 - DNA, 492 bp, Glycine max
  Peptide Sequence Number=SeqID_106612
atgaccatgattacgccaagctcgaaattaaccctcactaaagggaacaaaagctggaggggaagctcaagcagtaatgctcacccacctgctgctcacctcctgctgtgcggcccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14928 - DNA, 231 bp, Glycine max
  Peptide Sequence Number=SeqID_106613
atgaccaaagtgaacaaagagccatttctaggagttttctgcctttgccctgttttcttggttgtgatgcttgggaggattgatggggacccggtgttgagagaaacgaggatatgggctacgtgggagtacgtgagctcagttggaggtgggcaacaggggatggtgggtttatgcgcgctttgtggatgtggaaaacttgttgtgcaccatcgcctgatcgccacctag

SEQ ID NO: 14929 - DNA, 501 bp, Glycine max
  Peptide Sequence Number=SeqID_106614
atgacctctagaaggtttagctacaaagccttacaaaaggcgggcatgattccccgtggcgggcacaagaaggattcgtgtttaatgcatccgagcgtgctgcataacatggaaatgtgttcggcggtaagaaatctattacaacaaatgatagaccaaggccggcttgaggtcagcaatgaggggaaggaggaacaacatatatgcatgcagtcggcagataaggaagatcctaaaaagcctaaacccttggtaatacacttcaccagggacacagctccccaaaggccccaacacccctcggtagtatcgagcgttagacctattcctttcccttacaagaatagccgcacagttccttggaggaacgcccctctgggcggcaggaaggaagaagctaccgacatcggctcactatcggccaaagtaaccaacatcaccggtttgagcggcataacccgtagcggtcgcgcattcgcactccccggcctgccaacgtag

SEQ ID NO: 14930 - DNA, 144 bp, Glycine max
  Peptide Sequence Number=SeqID_106615
atggaaaagcttggtttgagcaaaataggggagaagcttgccgcccagctcgcccaggcgagcaaggttgcttcctccagaagcaatagccttctggagggcccaagtgggtctggttgctatttacacccccctgtttactaa

SEQ ID NO: 14931 - DNA, 489 bp, Glycine max
  Peptide Sequence Number=SeqID_106616
atgaaggaaggcataggtcacatcttagacctcactcccataggagagaaaaggaaagaaagcctcaagaggctaacattaaccttccatacttccatggaaaggacaatgaagtctacttcaaaatcttttggctctcactcttatccaaagaaagaccaaggtcaaggcatcttaggggtgacaccttctaagccgaaagatgataaggggaagacaatagaaaagcaaccccttaaggctagtatgcaagagaagactagctccataaagtgctttaaatgtcttggaagaggacacattacttctcaatgccccaccaagaaaaccatgattataaggggtcaagacatttctagtagccaagataaggctactaattcaccttcctctagtgaaagtgaagaagcaaaagggaaagaatctagtgaagagatctactcccaagaagaaggacaacctttaatggttaaggaggagtataaggag

SEQ ID NO: 14932 - DNA, 162 bp, Glycine max
  Peptide Sequence Number=SeqID_106617
atggggaagagaaagctggagttaggttttgaagaccagaaaattgattttgacttgtttgttgaagacaagcctgctctagaacacaatgtttgcttgcagcatatcagactccctttgaatggtaaaattaagggtttcaatttcttgggaaaggactaa

SEQ ID NO: 14933 - DNA, 429 bp, Glycine max
  Peptide Sequence Number=SeqID_106618
atggatcgtgcccacaagacacccagtggacccggagaaatccaacagggccttagggtctccagctttggttacgggcctctatcagtcctacagggtgcccgttccccccagcaagggatcgcgcccgcaggacaccctgtggacccaaagaagtccaacagggtcctagggcttccgactctgattacgggcctctgtcagttctacggagtgtccgtcacccccagcaaagtcatcaggcctcctaataatcgagctttcatcaagaagtattgtgcccccaggcaggtagagggcgaaacaccactgcagcctggggatggctggcagcgggcaacaaacgcaccaccaccacctctagagttcatctcagttcatccacaaaaaaggttagagcattgcctacgacacatgaccgaccaatag

SEQ ID NO: 14934 - DNA, 570 bp, Glycine max
  Peptide Sequence Number=SeqID_106619
atgtactccagggggcattttgttcttaatgccgatgatctcccctggaagctgctgaggaaggatatgacgacactcgctcagacatggagtgttgtctcttattatgatcttgcgcccacttctcacacatctgatgttaatcttgacagggcacgcttgatctacggcttggtgagccgcatggatatggacgtgggcagctttatatcgcagcagatcagtgagattgcccagtccagcacctcgaggctcgggttcccagcgttgattacagcgctgtgtgacattcagggggtggtttctgataccctgatctttgagtcactcagccctgcgatcaacttggcttatgtgaagaagaaatgttggaaccccgccgatccatcgatcacctttccagggactcgccgcacacgcaccagagcctcggcgtcggcatcagaggcccctcttcctacccagcctccgtctcagccttcttctcagagaccgcgacctccacctgcttccacctcagcatccatggacatgcatggtcagatgctgaggtccattcacgtcggatag

SEQ ID NO: 14935 - DNA, 448 bp, Glycine max
  Peptide Sequence Number=SeqID_106620
aggcggcgggcccgatgacacgcagagacaaaatttggtcatttctgcacccttgtgtcatccagaggcggcaggcccgatgacacgcagagatatcttacggttatccgcacccttttgtcatccagaggcggcgggcccgatgacacgcagagacaaaatttggtcattctgcacccttgtgtcatccagaggcggcgagcccgatgacacgcggagataccttacggttatccgcacccttgtgtcatccagaggcggcgggcccgatgacacgccgagacaaaatttggtcattctgcacccttgtgtcatccagagaggcggcgggcccgatgacacgcgaagataccttacggttatccgcacccttgtgtcatccagaggcggcgggcccgatgacacgcagagacaaaatttggtcattctgcacccttgtgtcatctag

SEQ ID NO: 14936 - DNA, 435 bp, Glycine max
  Peptide Sequence Number=SeqID_106621
atggatcttattaaaaatatggttgcaagtgatattgctattctcagagatagagcccacataccaacaaagaaaagtcttctggaacttacatcacaagatgcgttgttggcacaaaaaaagttattgtccaagcaattggaagcattgaccgaaacactaaggtgtgccatctgtggtggagctcacaattccggctactatatccccaacgaagaactagctcatgaagtcaattatatggggaatcagccaagacaaaatttcaatgcagagactctagctcaatttatgaaggtttctatgtctaaccaaaagagcacagagtctgccataaagaatttggaaatccaagtgggacagctcgcaaaacagttggcggataggccgtcaagcagctttagtgctaacactgagaaaaatccgaaggaataa

SEQ ID NO: 14937 - DNA, 279 bp, Glycine max
  Peptide Sequence Number=SeqID_106622
atgggttctccacctgcctccactcctcctcttcctcctcctcctccttcggacgcattggcttcgccgtctaccgtgaagcggacatgcaaagcctcacgtctacgatcgttgtccactagaccacctggtgctaagagaccagtggtgcatgttgatcctgctaccgggaaggccgacggtccccacaggaagaaattaagaacatgtttggggattgtggcttgtgataagggggacatcacctacgagaactggaaggaggtccctactgcttag

SEQ ID NO: 14938 - DNA, 246 bp, Glycine max
  Peptide Sequence Number=SeqID_106623
atggaggagttgattaacaaaacacaactctctccaaaaataatctcaacgtcatcacgtcggcttggcggctccacaaaagaatcttacttctcgtactctactgctgtcattctgctcctcgaacaaggttcgcgatcatcacaggttccaaccacatggtacaaaaattgtgagggcttatcgataccgtcgacctcgagggggggcccgggaccagcttttgttccctttagtgagggttaa

SEQ ID NO: 14939 - DNA, 789 bp, Glycine max
  Peptide Sequence Number=SeqID_106624
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaaaccctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 14940 - DNA, 423 bp, Glycine max
  Peptide Sequence Number=SeqID_106625
atgaaaacagctcgaaccaagatagatgtttatgctggcacattgtctattgaatttggtgatattgttgtccattttaacattcttgatgccatgaaacatctatctgaggatcattctgtttttcgtgctgagctaattgatcagattgttgatgattatacgtttgattttgattctattcttcatggtaggaaacatccatttttatctgatttgcatacttgttattgcttatgcattgagtctgaatctgagtttgaatttgatcctatggctgactttcatgctgagtgtgaatttgaatttaagtctgatgttgtacctcttgatgtcgattttttagagtcagaatgcactaaccatgttgcaggtgttggatcaagtggcctcagaatatttaagaagggggggttgaattaa

SEQ ID NO: 14941 - DNA, 463 bp, Glycine max
  Peptide Sequence Number=SeqID_106626
caccatatgtagaggcagcggaggaatcattggaagcaacttttccaatccttcgaggtggcaaggttatgagcccggaatgggtctgggcaaggacagccacgtgaatgtcgatgtggttgacattaggggtaacccgtacaaatatgggttggggtatgaacccgggaaagctggaagaaggaatgcaccatcaagactccgggcagatagggcatggcccggtcatgttagccagtgttccacaagtgtcgggataatgttcgaggaagaggtggcggcaataggagaagaggctccacaagatccgccaagtttcgtgcgatcgtgccatcccaatttccaagtggggaactggcgtgtgatgagccagtcggaagtctataccgttgattcaatatgtgaggatcgatcctttgaggatcctaacaatgagggtttgataatcgattttgaccgagaa

SEQ ID NO: 14942 - DNA, 522 bp, Glycine max
  Peptide Sequence Number=SeqID_106627
atggcatgcagagacaaattatggtcattctgcacccttttgtcatccagaggcggcgggcccgatgacatgcggagacaaaatttggtcattccgcacccctttgccattcagacacagtcgtgtccgatggcgcgcagagacaaattatggtcattctgcacccttttatcatgcagaggcggcgggcccgatgacatgcggagacaaaatttggtcattccacacccctttgccattcagacacagtcgtgtccgatggcacgcagagacaaattatggtcattctgcacccttttgtcatctagaggcggcgggcctgatgacatgcggagacaaaatttggtcattccacacccctttgccattcagtcacagtcgtgtccgatggcatgcagagacaaattatggtcattctgcacccttttgtcatccagaggcggcgggcccgatgacacgcggagatttacatcatcttccgcacttacaagatctgtcatactgacttttgagtcacgctga

SEQ ID NO: 14943 - DNA, 498 bp, Glycine max
  Peptide Sequence Number=SeqID_106628
atgacaccggtaaaccgaaaggcaggaacaggagagcgcacgagggagccgccagggggaaacgcctgtttctttaagatcgaattcctgcagcccgtgggtaagccactagttctagagcgtgccgctcaccgcggtaggagctcaacaattcgccctatagtgagtcgtattcacatattcactggccgtcgctttttttcccacaacgccttcgactgggaacaccctggcgttacaggccaacatagtaacgccgtatgcacacatccgctttgcgccgctggcgtaatagcgaaaggcccgcctcgatcgcccggttgcctcattaagcagttgccgacaggtttcctgaatggcgaatgggacgcgccctgtagcggcgcattaagcgcggcgggtgtggtggttacgcgtcagcgtcagaccgcttacacttgccgcgctgatgtccggctggtgcttttgccgttacgcaccaaccccgtcagtagctga

SEQ ID NO: 14944 - DNA, 807 bp, Glycine max
  Peptide Sequence Number=SeqID_106629
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctgggcggctccctcgtgcgctctcctgttcctgcctttcggtttaccg

SEQ ID NO: 14945 - DNA, 379 bp, Glycine max
  Peptide Sequence Number=SeqID_106630
atggagaatgctatgcagttcttgatggggctgaatgaatccttctctaatatcagaggtcaaattttatccatgaacccctttccctcagtaactatgacttcttctgctgcacgcaatcatcctgacaatcgcttcaaaggatcttccaagaatcgccccttgtgtgctcattgtgcaaagaaacattcttcttcttctaaaccaccacacaaggttgctcaacaagtatctattgatatgtctccctcacaaccttcctctggtgactcaggttcccagtttcagcttactgtccagcaatatagccaattgatgaatcttttagaaagtcatgctaccaatgttgtcatccctcaaggtgtttcttctgccagtg

SEQ ID NO: 14946 - DNA, 1075 bp, Glycine max
  Peptide Sequence Number=SeqID_106631
gaaagaaatttcctcatctgactctgatgatgatgtcgaactagatgttcccgacatcaagaggaccaagacatcagggaagaaggtgcccggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcatggctgctggactgctgaagactgtcaccaagttgggagattgctatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccaccaatcatacttccactgttgccacagaatcctttgctgtcaaattacccattgccttcccaactgtattgtgtggcattatgttgagtcaacatcccaatattttaaactacactgactctgtgatgaagagagaatctcctctatccctgcattacaaactgtttgaggggacacatgtcccagacagtgtctcgacatcagggaaagctgctgcctcaggtgctgtgtccaaggatgctttgatttctgaactcaaggacacatgcaaggtgctggaagcaaccatcaaagccaccacagagaagaagatggagctggaacggctgatcaaaaggctctcagaaagtggcattgatgatggagaagcagctgaggaagaagaagaagcagctgaggaagaagatgctgcagcagaggaagaggaagatgcagcagaggatactgaatcagatgatgatgattctgaagccaccccatga

SEQ ID NO: 14947 - DNA, 237 bp, Glycine max
  Peptide Sequence Number=SeqID_106632
atggtttgttttcttgtgggaaatgtggctttgagtgttcttggccttttccttttctgtttttgttcaatgcgaggtggacaagccaccgacgcacaggattttgagcaaaggatggacattctcaccctggatcaaggtttacggttaagttggggattttggctcaaggcttgtagaacggctgaacatgataatatgtcagggcgtggtttggcccgcggtttcaagggataa

SEQ ID NO: 14948 - DNA, 750 bp, Glycine max
  Peptide Sequence Number=SeqID_106633
atggggacgaggggttgcatcagctacaatcccgttcttgctataagacaacttggctaccgtatgagaggggcgccactagaggatgagctcgcgcctatcatttcacgaggcttcaataagaccaacgtggagacacttcagaaggtctgcaaggcatgggaggtgttgcaaaagaaggacaaggaactcaggggcagtaacaatgggccgatcggtggctaccgtaagtggttgaaagcccacgtgcaaggtttggattggctcctgagtttgagaaccgctaaaagggaggaagttgaggcaccggaggaagacgaagaggtgcaagcccttaggatggaactcaagcaagctcaaacagtcaaagaaaggttcaaatcagcaactcttaaaatccgaaaagagaatgccgaactgagagatataaatatagctaccaccaaggctttggaacaaatgaccaagagggctcgtagggaagagcacggccggaacaagttcagaggggctctatggggcagcaacagggaccaatcaggagtagacagtttgatcttgaaagatgagttgaatgtttgctcaaggtccaaaagaaacttgtctcagcgattatgtgaaacagagaccaacatgttagctatcatcagcaagtaccaagaagaactaaatctagctacggcccacgagcatagagtggcggacgagatgcccaaatgtacgcggagaaggaggctagaggaagggtga

SEQ ID NO: 14949 - DNA, 883 bp, Glycine max
  Peptide Sequence Number=SeqID_106634
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatgcttacaaaacccacgagcataccacggacactcacggatcttactatctggatcaatatgcaagtattggcattcaggattggtgcactctcccaacttggcaaagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 14950 - DNA, 915 bp, Glycine max
  Peptide Sequence Number=SeqID_106635
atggcttcccgtaagagaaaagcaccaactttagtgtcccaggctaggtatgatagatcaagatttgtatcccaagatgcctggaaccactacgcaaacaatgtccttggccgaaagatccttccgaaaaggaatgtgaatttgtacattacagaatttgatgaattcaagagagaaattgagaggaggaattggcataaggagctcactaacttctctgaagggagcattaacgtggcattagtgaaggaattatatgccaacctttatgaccttgaagataaatcaccaaagcaggaaggggagagcttgccctcttactccaggttctgcaggttgaggccagatcctcaagagcttgcaactcgtctatgtatccctgggaggggatttaagctgaatgcagacaagctacctttgaagattttgaggaagaatcttactactctggcccaaacttggagcaccatctcttttagctccctctaccttagctctttctacctatcctctccctccagctccagcaactccaattcttccagatccttcttctcaaagcttcgagccattcttttctatgctgcagagcctgcatcagggccagctcttgatcatgcagagcttgtagaatgtggtgcaccagcggccggagtccaaccttctcctttgggagggggtgaggcctccgcagcccaggagcctcagcaagatcagcaggaggacattccagaggccgtagagcctacacctcctgagccattcactttagagtctgatccggttgttgtacaggctgatccagctatatctcctcagcctgagccatctgcaccagtgtcggacctccctctttctcaggatccatcatctgcactagcactagacctgaatgagcatgcacaagattattga

SEQ ID NO: 14951 - DNA, 240 bp, Glycine max
  Peptide Sequence Number=SeqID_106636
atggtttttcacttaaggcttgtaatgagcttcaaaacaaagaaaggggaacataggctcaaagaggctatcaaaggaattaattcaaggaagcatcaccaagaattaagccaaggctattgtgcaagcaatcaatggggcaaaaccccccaaaagattatgatgatggatggctcaaattctcacaaaggtaaacgtatcactttcaaatcgagctttcaaaactatcatgacatgtag

SEQ ID NO: 14952 - DNA, 246 bp, Glycine max
  Peptide Sequence Number=SeqID_106637
atgcggaaattgattaaggaaaggatgacgaataaggtggttaattttgtgggtcttaataaggtggttcttggcataaaatggaataatgagatgagaaaacgtagaacaagggtgaagatgaaaggaaggaaagaatcactctttccagcgagggcaacacacaaaggttgtgaatgtcctttgatacagccaggtgttcttgaatcactcaagaatttaggagaatcactctcactaagataa

SEQ ID NO: 14953 - DNA, 266 bp, Glycine max
  Peptide Sequence Number=SeqID_106638
gcaatggtaatattgtggtgattgcggtaatgataacaatgatagtgacaacaataaatgtgacggtggcgacgattgtgatgaatggtggtgatgatgagacaacggtgaccaacaacaatggtgggagtagtggtgatggtagttgcggaaaaaatggtggaaatggtggtgctaatggtgatggtgacactagtagtggcagtgattgtcaagttgaagatggtgatgatggtagtggcggtaaaaacaatggtggaagttga

SEQ ID NO: 14954 - DNA, 851 bp, Glycine max
  Peptide Sequence Number=SeqID_106639
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgagatatggtggatcaagatatggaagatcatcttcgtcaaatatgtaaccgctctttgcgtcctcattttcctctgttacatcaccaccagtgagacaatctgcattgttaagaacccaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14955 - DNA, 294 bp, Glycine max
  Peptide Sequence Number=SeqID_106640
atggcggcaagcagtgacaatccgggcagtttcctggagatcgtgccgcagcagcgcctgctgttctcctgttcagctactgaaattgttatccgcgtcacaattcgcaacaagcataccgaccggaagcatcagcgcggcaagtgtaagcggggtgccatgacgctgcagctaacctcacaccccccgcttaattgcgttgccgctacagctgcccgctttcccattcgggactgcggcaactgcttaatgaacggccaacgcgatcgggcgaggccggtcttcgcgtattga

SEQ ID NO: 14956 - DNA, 201 bp, Glycine max
  Peptide Sequence Number=SeqID_106641
atgggtgcgtcttccaagaaaggaaaatgcgtggagtcaccaccaacgtttattcgaggaaaatgtcggaaaaaccggaaaagacgtggtctagaaactttaagtgtgaaaggttcgggagttgtatttacgcacggggaagggtgtttcccttgctcctacgtattcctcaattgtgataagaaaatcagacctacgtag

SEQ ID NO: 14957 - DNA, 515 bp, Glycine max
  Peptide Sequence Number=SeqID_106642
atggatgccaagtacctcgaagtggtcaaacgagggttgcatcccaacaacggatggtccccagatgaaattagggcggcgagcccgatgacatgcggagacaaattatggtcattccacaccttttgtcaaccagaggcaagcgagcccgttgacacgcaaagacaaattatggcaagcaagcccattgacacgcagagacaaattatggtcattctgaaccttttctcatccagaggcggcgagcccgatgacatgcagagacaaattatggcggcgagcccgatgacatgcggagacaaattatggtcattcgcaccttttgtcacaagcgagcccgttgacacgcagagacaaattatggtcattatgctccttttgtcatccaaaggcgacgagcctgatgacatgcgaagacaaattatggcggcgagcccgatgacatgcggagatccttatggtcatccgcgcctttcgtcgaccaagaggaacgaattcggcagtatcaggatgat

SEQ ID NO: 14958 - DNA, 192 bp, Glycine max
  Peptide Sequence Number=SeqID_106643
tgctttgaggacttgacgatactccacaaagtaaatccaaggctggtgctaggtggattgttgttaaatgtaatagacaaaaaggaagcaccgagttatttcaatgatgtcagaccattggaacctgagagattgaaggcgcttcgcatccagtgggcaaagtattatttgaaagttagaaatgaaacttag

SEQ ID NO: 14959 - DNA, 210 bp, Glycine max
  Peptide Sequence Number=SeqID_106644
atggaatcaaacatcccaacctggcaagagctaccctccattagaatcctcaagaaaatgatccaaggagctgatataggagatccaacagaggagtcactacttaagagatcaagggagatgaaattgactcaaagccaaagggatttgcagatcccaccagaactcatccagatcatgatacaggctcagaagctctctatggattga

SEQ ID NO: 14960 - DNA, 330 bp, Glycine max
  Peptide Sequence Number=SeqID_106645
atggagcaactgattgaaatgcctcaaaatgttctttacgatgccattgggatatatcaacggtgttggaacgtcttacgtgccgatcaacgtctcattttcgccaaaagttggcccagggcttcccggtatcaacagggacaccaggatttatttattctgcgaagtgatcatccgtcacaggtgctccagtggcttctgtttctatcagctgtccctcctgttcagctactgacggggtggtgcgtaacggcaaaagcaccgccggacatcagcgttggcaagtgtagcggtcacgttgcgcgtaaccaccacacccgccgcgcttaa

SEQ ID NO: 14961 - DNA, 423 bp, Glycine max
  Peptide Sequence Number=SeqID_106646
atgtatgaacattgtgcttgcaagaagcagcgcaatcaacttccaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14962 - DNA, 231 bp, Glycine max
  Peptide Sequence Number=SeqID_106647
atgtggccgttcccccgatcgctcatgttcggctacgtagctcgggcgaccggaaccatcgatgtcggccacgacgagctagcggaggctagttttctcagccgtcaagaagtatccgaccaagttaatgctgggcgtctccagttgccaccgatcgaattcctgcagcccgggggatccactagttctagagcggccgccaccgcggtggagctccaattcgccctatag

SEQ ID NO: 14963 - DNA, 805 bp, Glycine max
  Peptide Sequence Number=SeqID_106648
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 14964 - DNA, 414 bp, Glycine max
  Peptide Sequence Number=SeqID_106649
atggctctacctaaagaaatttcgaccctcatttaccacaatggtcacattgtagacgatccagttcaaggatcgacgtaccaatctcagctattcgacaatgatgatcttagaggcgcaatggaaacaattatccagaatccacaattgaattctgccgaattctatgctgttactgagcttattcctcaaccacaaccatcgtctccacaaccctcatgtccacaactacaactaccgcctccacaacagttaccgtacaacaacatagacctcaataatccagatgaggatcaacagttctttgatcacaccaatcaccaaagcgatgaccaaactgatgacgagggtgttggcaaaccacgacacctccgtcacctccgttgcaatatcagcaacctaggtgtccagtag

SEQ ID NO: 14965 - DNA, 519 bp, Glycine max
  Peptide Sequence Number=SeqID_106650
atggccccaaggaagcttgcctcaaagagatccaggaaagacaaagcagctgaaggaaccagttccgctcccgaatatgacagccatcgttttaggagcgctgagcaccaacagcgcttcgaggccatcaaaggatggtcattcctccgggagagacgcgtccagctcagggacgacgagtataccgacttccaggaagagatagttcgccggcggtgggcatcgctggttacccccatggccaagttcgacccagacatagtcctcgagttttatgccaatgcttggcctacagaggagggtgtgcgagatatgcaatcttgggtgaggggtcagtggatccctttcgatgcggatgcccttagccagttcctgggataccctttagtgctggaggagggccaggagtgcgagtatggccagaagaggaacctggccgatgggtttaatgagggggccatcacccagttgctgtgtataccggggcaagattttgcccggactgctgctgggagacgg

SEQ ID NO: 14966 - DNA, 528 bp, Glycine max
  Peptide Sequence Number=SeqID_106651
atggaaaaacggctttgccgcggccctctcactttccctgttaagtatcttcctggcatcttccaggaaatctccgccccgttcccttttttctcctgccacatgaagcacttcactgacaccctcatcagtgccaacatagacaaaaaaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14967 - DNA, 192 bp, Glycine max
  Peptide Sequence Number=SeqID_106652
atgacaccggtaaaccgaaaggcaggaacaggagagcgcacgagggagccgccagggggaaacgcctggggggcggagcctatggaaaaacggctttgccgcggccctctcacttccctgttaagtatcttcctggcatcaactaagttccaggaaattcctgcgcccgttggggataagccactattctga

SEQ ID NO: 14968 - DNA, 929 bp, Glycine max
  Peptide Sequence Number=SeqID_106653
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcattcaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 14969 - DNA, 1203 bp, Glycine max
  Peptide Sequence Number=SeqID_106654
atgctggatttgccttgggagatcaccccggaacgtatcaccatcagcgacgggcgctggaacgcggtttatgccggctatccgcttagcgggcgggtggcgctatcggttggcgactggcaaaaaggcaccgaagagatggaaatcagcggccggctcaatgtgttaacgcacggtgaagcgggtaaggggaacgccgtgctgaacattggcccaggtaagctaagcatggatcacagcgacatgccgctcagcctgaccggcgaagccaagctcgacgatatgattttttacgccgtgctgcccgccaaactcagtgggccgctaacgacgccggagctggcttttcatcccggcgcgctgctgcgctcgcgcgggcgggtgattgactcgctgaatatcgatgagatccgcctgccgttggcgggagtgaaagtgactcagcagggggtggatggccgcctgcaggcgatactgcgcgcccacgaacaggaaatgggcgatttcatcctgcacctggatgggcaggccgacaactttatgcccgaccgcggtcgctggtcgtggcgatactggggagatggtcactttacgccgatgcaggcgcgctgggatgtgaagggcgccggcgagtggcgggacagcgccattattcttaacagcctgtccgaccgggttctaaaagctacttgggacggcgaacgcttgcgtggccaggcatggtggccgaaacaggcgctaagcgtattccagccgctgattccgccggactggaaaatgaccctgcgtgaaggtgatatgtatgcgcaggtggcgttctccgcggcagccgggcagggctttgaggccgggggccatggcgtcttaaaaggcggtagcgcctggatgccggacaaccagatcaacggcgtcgactttgttctgccattccgtttcagcggcgggagctggcagctcggtacccgccgtccggtttcactgcgtattggcgaaatcgtcaaccagttcaccgccaaaaacctgagtgccgatctccagggaacatggccctggagcgagcaggatccgctggaattgagcaacgttaatgttgatatccttggcggcaagctgtccatgcagcagctaagaatgccgcagcatcaaccggcgctgctgcgtctgcagaatatctccagcagtgagttgataagcgccatcaaa

SEQ ID NO: 14970 - DNA, 135 bp, Glycine max
  Peptide Sequence Number=SeqID_106655
atggtgaaagttggaacctcttacgtgccgatcaacgtctcattttcgccaaaagttggcccagggcttcccgggtgtcccagtgaatgcttcatgtggcaggaaaaaaagctgacgggccagtcgaatatgtag

SEQ ID NO: 14971 - DNA, 417 bp, Glycine max
  Peptide Sequence Number=SeqID_106656
atgaagttcaaggattatgtctcttacatgaaagttcagcatgatgaagatcccttcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14972 - DNA, 582 bp, Glycine max
  Peptide Sequence Number=SeqID_106657
ggttagattggctctccaagttaaagattatcgacgaagaaagcttcgaagctccggaagagggtgaagaagcccgagctctaaaaacagaactaggaaaagcaagacttgacaaagaaaaattcaagttggtcgctacagacgtccggaaagagtgtgccggttacgagaagaaaatgcagctaccgcaagagcccttgaacaagaaaccaagagggctcgcaaggaagagcatggccgtgacaaattttgtggagctttatggggcagcaacagtgagctcaagcttcgaagggaagagagataccaatcacgagcacatagcatgcaagtaccaagaagagctaaatctagccacggcccacgagcataaagtggcggacgattatgcccgagtgtacgcagaaaaggaggctagaggaagggtgatcgactcattacatcaagaggcaacaatgtggatggaccgatttgctcttactttgaacgggagtcaagaacttccccgattgcttgccaaggccaaagcaatggcggacacctactccgcccccgaggagatccacggacttctcagctatt

SEQ ID NO: 14973 - DNA, 303 bp, Glycine max
  Peptide Sequence Number=SeqID_106658
atgattggtgatatcgtagcgatgagacgggtcattacattagtggtatcagagccgatcgaaccttttcggccatgcaatgggatgatatggcaagtgatcaggaaatacaaaggatggaaaggagtgatggctggacaaaatgatcatgcgatagctgatgctctccgagccttagctcaggctatagggaatcagaataggggagaagctgctgcaactggtgagtaccaagggttggaccgcttccaacgaaacaatcctcatgctttcaatgaaggatacaaccctgatggagcttag

SEQ ID NO: 14974 - DNA, 273 bp, Glycine max
  Peptide Sequence Number=SeqID_106659
atgatgggcgatcaagaggagacacaggaacaaatgaaagttgacatgtcggctctgaaagaactaatggcttccatgatggaggccatgttaggaatgaggcaactcatggagaaaaacatggccaccgctgccgccgttagttcggctgccaaagcagacccaactctcctagctaccacgcaccatcctcctgcaaatacgataggacaaggaaggagcacactggagcaacacagcaacccccatttgggatacaaccgggtggcttaa

SEQ ID NO: 14975 - DNA, 543 bp, Glycine max
  Peptide Sequence Number=SeqID_106660
atgaggggcatcgtgcgtgagcctcaataccctcaccttcagaggactacacgtcctcgacataagaggactacacgtcatcgccttcagagggctgcacgcacttgccttcaggggactgcactcctcgaattcagaggactacacgtcctcgccttcagaggactacacgtcctcaccttcagagggctacacgccctcacctttagaggactacacgtcctcgccttcagagggctgcacgccctcagagggctacatgcccacactttcaaaggattacacgtcctcgtcttcagaggactacacgtcctcacctttagaggactacacgtcctcgccatcagaagactacacgtcctcaccttcaaagggcgacacgccatcgcattcagaggactacacatcctcgccttcagagggctacacgtcctcaccttcagagggctacacgccctcatctttagaggactacacatcctcgccttcagagggctgcacgccctcagagggctacatgccctcaccttcagaggattacac

SEQ ID NO: 14976 - DNA, 784 bp, Glycine max
  Peptide Sequence Number=SeqID_106661
atggccatcttgttggacacagggaactttgttcttcaacaacttcaccccaatgggacaaacactttgttgtggcagagttttgattatcccagcactttgatccccaccatgaagctaggtgttaatcacaaaacaggccatcaatgggtactggtttcatctttgactgatttagttttgaatcccggtgcctttagtcttgaatgggaacccaagggacaagaactggtcataaggagacgcggaaaagtttgttggcaaagtgggaaactgagaaacaatagatttgagtacattccggaggaagcacaacgcatgttgaagtatactattgtgtctaatggggatgaagactctttctctttcaactctacgaatgacaagcttacaccacggtggtcttttagtagaagtgggcggttatcttgcaacgaaggatatgtaaaggcggatctgtgttatggatataacaacactggagggtgccaaagatggcaagatttaccaaagtgtaggaatcctggcgatttgtttgtgaaaaagactcttttccccgattatgaaaatgtaacttttgaaatgaatccggcttttggctacagtgattgtgaggccagttgctggagcaattgtagttgcgatggattcagtgcattatgggttaatgaaactggatgtacattctatcattggaattcatcgaaaaattttgttgacactagtgttgctggtgtagagctttacatgctggagaacacaggcaacataaccccgcataacg

SEQ ID NO: 14977 - DNA, 1066 bp, Glycine max
  Peptide Sequence Number=SeqID_106662
atgaaaccgctgcaggccgcgttacagggcagccgtgaagtcggctttaccgtgctgtcgatgagcctgtcgctggtggcggtgttcttaccgctgctgctgatgggcggcctgccgggtcgtctgctgcgcgagttcgccgtcacgctatcagtagcgatcggtatttcgctcgccgtgtcgctcacgctgacgccaatgatgtgcggctggctgctgaaaagcggcaaacctcatgaaccaacgcgcaagcgtggctttggccgcctgctggtcactattcagggcggctatggcaaatcgttaaaatgggtgctgaagcatagtcgactgactggcctggtgctgctcggtacgatagcgctcagcgtgtggctgtatatcgctattccgaaaaccttcttcccggagcaggacaccggggtgctgatgggcggcattcaggcggatcagagcatttctttccaggcgatgcgcggcaaactgcaggactttatgaagatcatccgcgaggatccggcggtcgataacgtaaccggttttaccggcggctcgcgggtgaatagcggtatgatgtttatcaccctgaaaccgcgcgaccaacgccacgaaacggcgcagcaaatcatcgaccggctgcggaaaaaactggcgaaagagcccggcgctaatctgttcctgatggcggtgcaggatatccgcgttggcggacgtcagtcgaacgccagctatcagtacaccctgttatcggacgatctgtcggcgctgcgtgaatgggagccaaaaatccgcaaggcgctggcggcactgccggagttggctgacgttaactcggatcagcaagataacggcgcggagatggatctggtctacgaccgcgacaccatgtcacgcctgggcgtcagcgtgcaggatgccaacagcctgttaaacaacgctttcggccagcggcagatctcgaccatctatcaacctttgaaccagtacaaagtggtgatggaagtcgatccgctttatacccaggacgttagcgcgctggagctaatgtttgtcattagtaacgacg

SEQ ID NO: 14978 - DNA, 937 bp, Glycine max
  Peptide Sequence Number=SeqID_106663
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgctcccaatcaatccccagtcgtgttcaaatccaacccattgcacattacgtgcattggacaatgagtctgacaaattcagcaacaatcaaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 14979 - DNA, 228 bp, Glycine max
  Peptide Sequence Number=SeqID_106664
atggttttctcaagattttctcaagagggtacatctacttgggttgttgtaactgagaacaagagagggtacatctcttatggatcagttcaagtggagggtacatccacttggttgttcaaagagaacaagggaggttacatcccttgtggatctttgcttgtaaaggcttttacaaggttgaaaagaaatctcaaggaccgcaggtcgcttggggactggatgtag

SEQ ID NO: 14980 - DNA, 513 bp, Glycine max
  Peptide Sequence Number=SeqID_106665
atgcctctatggtgggaatttaattcgtgggttaaggaacctagagtgttccattgtaggcctatggataatttccttcagcactctcccatggcaggattaaaggataccaacagaagatggaaaatttggtggatagcagctacaacatcaatatggaagctcagaaatgacattatcttcaacaatcatccttttgtcatctcgaagctggtggataatacaattttcctctcttggtcctggatgagggggtgggaaaaggatattaatgagatcttacctcctgtggcttcttgtagtacttctgaaatagccataaagggggataaggaaaaggatttgcctcttgaggtaattctgccttacagcagcaattcgaatataaagaagaaaagcagggtcaatgttccctttggtcaatatgacttaaaggtagcaagtgaggaagtgggccagcggataagtggcccaaatcattctgccacaaaggtttatgtgagaagaaagtag

SEQ ID NO: 14981 - DNA, 309 bp, Glycine max
  Peptide Sequence Number=SeqID_106666
atggcttgcacccaattccggctttcaaaattgccccatgtgtggcacctcttgtcaatgtcaggatttacacgtgattctcctcaaatttcagccagcctgcatcaattagaccttgcaccttacgcttcaggcccctacaatgctcaatggaatgccccggggcttctccatgacaagcacacgttgcgttcgagtcgtattttcggagaaatggaggttgatgcaccttggttggggttatggctaccattgaattatcaagtagatatgggagcaagtcagcataggacaccggaattggggtga

SEQ ID NO: 14982 - DNA, 549 bp, Glycine max
  Peptide Sequence Number=SeqID_106667
atggataatgaagagggagtgcaagaacagatgaaggccgacctatcggccttaaaagatcaaatggcttctatcacagaggccatgctaaagcttcagaaaactatagaagataatgctatggcggccactttcaatacagctagggaagtggaaccggtgctacagcccgcaataaacttgggccgagacagaaacacgacggttttcggtcggaggtatagtcctcaagcctacccttatggtttgcctccggacttcactccctgtaccgctccagacgatttgagccaagcccctaccttcgaggggcaactccctcctcatgtcgactatcctctgcaagaagatgatgaaggagatgcccatctaggccctctacttccccttaaggatccggccccccatgaattgccccaaccaaacatagtccgccacgtcccgtctccacccgcacccgttaaagaattcattccctttgcaaaagacaagggaaagattgatttacttgaagtgaggctgagagcggtagaaggcctcggcaactaa

SEQ ID NO: 14983 - DNA, 815 bp, Glycine max
  Peptide Sequence Number=SeqID_106668
atggtgaaagttggaacttcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattcagtttgctgagcgacctgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14984 - DNA, 448 bp, Glycine max
  Peptide Sequence Number=SeqID_106669
atgcgggaaggtatttcaccaagttggactggcgatggggtactaccaagtgcggatagccgagggcgacgaggggtgctaacccggccacccaacccagcaggtcaggggcgggccggccataggttcgaatcctgccacctttcttgtggatcatcctgtggttaccggatgatgggaataacaaagcagaaatttggaaatgagtacgaaatgtcaatatatgaattgtttcattattcgttatttccgggtcttttcgttgcattcacttacaacaagaaacaaccaccagcgtttggtgcagcacctgcattttggtgcattcttctttctttccttggtctttcgttccgtcatattcctaataacttatccaattacaacgtattaaccgctaatgcacctttcttttatcaaatctcagggacatggtctaatcatgagg

SEQ ID NO: 14985 - DNA, 423 bp, Glycine max
  Peptide Sequence Number=SeqID_106670
atgacaggccctctcaatgagtcaatctcttgctttctcataagggtgaacccttgggtactagtactttcacctttagaggactacacgtccttgcctttagagggctacacgccttcaccttcagagggctacacgccctcaccttcagaggactacacgcccttgccttcagagggttgcatgccctctccttcagagggctgcacactgttgcctttagagggctacatgccctcgccttcagagggctacacgtccacaccttcagaaggctacacgccctctccttcagagggctacacgccctcgccttcagagcactacacgccctcaccttcagagggctgcacgtccttgctttcagagggctccacatctgtgcctttagagaactcaaggtcctctgcccttaattcttaa

SEQ ID NO: 14986 - DNA, 336 bp, Glycine max
  Peptide Sequence Number=SeqID_106671
atgggggatttcatcaacatactctccttccccgaaaacaccgagactttttcaagtctcacaagttatccagaactacgtaggtctgagttcctcattggaggatacgtaggagcaagagcctcgcttttgtcgaccgcaccgctttttgctaccatgacccaagagctagtagcccgcagagacgccttacggttatccgcacctcgtcattcagtgaccccaagtatgattgatgagcagaggccaatgtggtcatttgcgccctttccggagatgtcagcatcttccggtggagactttttcaagtctcacaagttatctagaactacgtag

SEQ ID NO: 14987 - DNA, 192 bp, Glycine max
  Peptide Sequence Number=SeqID_106672
atggcagaagtctccacggaggccattgcctccctcgcccaatattatgaccagcctttgaggaattggatcgcgggaagcgagtcgaaaatggggtggttggggtaccaaggaaatgtttggaaacaaaggcgagagtcttggcaagtcaaggcgaatgggccacgttcatggacatcctggcacttttga

SEQ ID NO: 14988 - DNA, 776 bp, Glycine max
  Peptide Sequence Number=SeqID_106673
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggccactcctgacattcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14989 - DNA, 411 bp, Glycine max
  Peptide Sequence Number=SeqID_106674
atgacaccggtaaaccgaaaggcaggaacaggagagcgcacgagggagccgccagggggaaacgctggtatctttatagtcctgtcgggtttcgccaccactgatttgagcgtcagatttcgtgatgctttggtcaggggggcggagcctatggacgaaaaaacggaaaaagccgcgccctctcattttaaaatgctttgcgtgatcgaattcctgccccgtggggtaagccatagttctagagcgtgccgctgcgaccgagcggtaggagctcattggcacgacaggtttcccgatggcgaatgggagcagcctgagcgcaacgcaattaacgtgtggtgttacgcgtcactcgcacccgctttacacttgcccctgatgtccggcggtgcttttgcgaattacggataa

SEQ ID NO: 14990 - DNA, 759 bp, Glycine max
  Peptide Sequence Number=SeqID_106675
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgccccaaaattcattgcagcatcaggttgtctttataggcaccggggagtaccagcaacaacaactccgcgttgcgtttactattccgtcatctgtcttggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14991 - DNA, 189 bp, Glycine max
  Peptide Sequence Number=SeqID_106676
atgggggagacactagttctcgagcgaacgcctacgacctctggcgtaatagcgaaaaggcccgcaccaatcgcccttcccatgggtgcgcagcctgaatggggaatgggaggcgccctgaaacggcgcattaagcgcggtgggggtggtggttacacgcagcgggaccgctacacttgccagcgctga

SEQ ID NO: 14992 - DNA, 318 bp, Glycine max
  Peptide Sequence Number=SeqID_106677
atgtaccctctcttgttctctttgaacaacctagtagatgtatactccactaaaactgatccacaagagatataccctctcttgttctcagtcacaacaacccaagtagatgtaccctcttcttgtaccacaaaggatgtaccctccaatgtgttaagacaaagttctcaggcgggaatgggaagaatcaaaagaattctcagactgtgtcattttgaattctttgacaagggagaagggagacacaaaagaattcaggcggttagtccttcgttcttttggaaaagggagaagagagacacaaaaagaattcaggcg

SEQ ID NO: 14993 - DNA, 126 bp, Glycine max
  Peptide Sequence Number=SeqID_106678
atggagttcttggagctcaagcagggaaacatgactgtggctaaatatgtagccaagtttgaagagttggtgaggatgaagactcttgagacagggcaacctattataggagtacaggcccagtaa

SEQ ID NO: 14994 - DNA, 785 bp, Glycine max
  Peptide Sequence Number=SeqID_106679
atggtgaaagttggaacctcttacgtgccgatcaacgtctcattttcgccaaaagttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggggatcagtcaggagaactaggtaggaagctgggctttaggaacttgtctttactttaccagtggccagagaagttgggagggctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14995 - DNA, 636 bp, Glycine max
  Peptide Sequence Number=SeqID_106680
atgaccatgattacgccaagctcgaaattaaccctcactaaagggaacaaaagctgtgccctgctttttgcaatccagtcacgtcgtctgatgattctctctccggatgtaaaggtgggctggggtaaaccttccttgctatctcctctgattgccgatgctgtggctcgtcatggtgcttctcgtaacgtgtatatcggcaacctcgactctcgatatatgtcagaatctgctctgtctgttgtattctcccactttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 14996 - DNA, 588 bp, Glycine max
  Peptide Sequence Number=SeqID_106681
atgaccactttagctcagacatggagcattctttccttccctaacttggttcctacctccgacacatatgatgtcagattagacagggccaagttaatttatggaataattatgaagatggacgtgaatgcgggttacctcatctctcaccagatctctattatagcacagcatgactcctctaagcttggatttctagccttaatcatagctttatgtaaagctagaggagtcacatctgattctaggactcttgagagccttagccccgccatcaatgtggcatacattaagaagaactgttggaatctggatgatccaacagtaacattcagagggcctaggaagactaggggaaagagatcagaggctcctactacttcagcagcaccagagacaaccgcaccttcttcatccactcctccaacacctcccagttcgattatacctccaacaccttccacttcgactccagcacagtttccagcacagattctagctgctcttgcctcagccttcacatttacaccaaagatgcttcattctatgctccagagcttacacagggagcaggccattatcatgtag

SEQ ID NO: 14997 - DNA, 803 bp, Glycine max
  Peptide Sequence Number=SeqID_106682
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgaattacaaaaagcagatgtaacaggaatagaacagatagaagaacatacaccactgtgtctagccaagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 14998 - DNA, 201 bp, Glycine max
  Peptide Sequence Number=SeqID_106683
atgaacatatgtaattttgggcacaataccttgagcatgcgtgaaatggccccgaggaaacttgcctcaaagagatccaggaaggataaggcggccgaaggaactagttccgctcctgagtatgacagtcaccgctttaggagtgctgtacaccagcagcgcttcgaggccatcaagggatggtcatttcttcgggagtga

SEQ ID NO: 14999 - DNA, 1554 bp, Glycine max
  Peptide Sequence Number=SeqID_106684
gtgatggcgttcgacgaagtggccaggcggacacccgcgcgcgcaaaattgagatctgccgccgcgcctaccacattcttaccgaagaggttggtttcccgccggaagacatcattttcgaccccaatatctttgccatcgctaccggcatcgaagagcacaacaactacgcgatggatttcatcggtgcctgtgaagacatcaaacgcgaactgccgcatgcgatgatctccggcggcgtctccaacgtgtcgttctcgttccgaggtaacgaaccggtgcgtgaggcgattcacgcggtgttcctctactacgccatccgcaacggcatggacatgggcatcgtcaacgccggtcagctggcgatttatgacgatctgccggcggagctgcgcgatgcggttgaggacgtgatcctcaaccggcgcgacgatggcaccgagcgactgctggcgctggctgagaagtatcgcggcaacaaaggcgagggtgagcaggacaagcagcaggccgaatggcgcagctgggacgtggtgaagcggctggaatattcgctggtgaaaggcattaccgagtttatcgagcaggacaccgaagaggcgcgccaggccgcggcacggccgattgaagtcattgaagggccgctgatgtctggcatgaatgtggtcggcgatctgtttggcgagggcaaaatgtttctgccgcaggtggtgaaatcggcgcgcgtgatgaagcaggcggtggcctacctcgaaccctttatccaggcgagcaaagaggccggccgcagcaacggtaaaatcgtgctggcgacggtaaaaggtgacgtgcacgacatcggcaaaaacattgttggcgtggtgctgcagtgtaacaactacgaaatcatcgacctgggcgtgatggtgccgggcgacaaaatcctgaaaaccgcgcgtgaggaaaacgccgacatcatcggactttccggcctgattaccccgtcgctcgacgagatggtgaatgtggcgaaagagatggagcgccagggctttacgctgccgctgctgattggcggggccaccacctcgaaagcgcacacggcggtgaagattgagcagaattacagcggcccgacggtctatgtgcagaacgcctcgcgcaccgtcggcgtggtctcttcgctgctgtcgcctacgctgaaagaggcgttcgtggcgcgcacgcgtaaagagtacgaaaccgtgcggattcagcacgcgcgtaaaaagccgcgcacgccgccggtcacgctacaggccgcgcgcgataatcattacgtcattgactggcaacgttacacgccaccggtggcgcatcgtaccggcgtcagcgcagtggaggccagtatcgatacgctgcgcaactacatcgactggacgccgttttttatgacctggtcgctggccggcaaatatccgcgtatcctggaagatgaggtggtgggcgaagaagccacgcggctgtttgccgatgccaatgcgatgctggataacctcagcgcgcagggcacgctcaggccgcgcggcgtggtcg

SEQ ID NO: 15000 - DNA, 1947 bp, Glycine max
  Peptide Sequence Number=SeqID_106685
atggcaaaagagggcgaatttagcctgaacttccgcgataacgatcaatatcgctactattctgcgtcattgcagctgttcccgtggctggaaaccacggtgcgctataccgacgtacgcacccgccgctacagtgcggtggaaggcttcagcggcaaccagagctataaagacaaagccttcgacctgaagctgcgcctgtggcaggagagcttctggctgccggaagtggcggtcggctcgcgcgatttgggcggtaccggcctgttcgacagtgaatatctggtggcgagtaaagcctggggaccgtttgatttcagcctcggcctgggctggggctatctcggcaacagcggcaccatcaaaaacccgttctgctcctacagcgatagcttctgcagccgcaccggcggcggttcggcgggttccattaacggctcgcagatgttccacggtccggcggcactgtttggtggcatcgaataccagacgccgtggcagccgctgcgtctcaagctggagtatgaaggcaacgattatcaggacgattttgccggccggctggagcagcgcagtaaggtcaacgttggcgcaatctatcgccttagcgactgggcggatatcaacgccagctacgagcgcggcaatacttttatgtttggcgtgaccgtgcgcaccaactttaattcgttacaccagtcgcaccttgatagcgcaaaaccggcttatcagccacagccgcagggcgatctgctgcagccgacggtggtcgctaatcagcttaccgatctgaaatacaatgccggactggatggtccgcgcatccagaccaaaggccgcacgctgtacgtctccggtgagcagaccaaatatcgcgacacgcgcgaaggcgttgaccgcgctaaccgcattatcatgaacaatctgccggcgggtattgatacgattgaagtcaccgagtcgcgctttaacatgccgcaggtcaccacgcgcaccgatgtggccagcctgaataacgaactgcgcggctatccgctcggccacgagcagccgctgcagcagacgcgtgaagaaccgatcgatccgggcaccaccgaacagggctatttcatccgtaaggatcgccttaactacagcctgtcgccggtgctgaaccagtcggtcggcggcccggaaagcttctacatgtaccagctcggcgtaatgggcaatgtcgattactggctgaccgatcactggctgattggcggcagcctgtttggcaacatcgccaataactatgacaagttcaactacaacggcgcgccagccgactcgacgctgccgcgcgtgcgcacccacattcgcgactacgtggagaacaacgtttacgtgaatgatctgcaggccaactacatgcgctatctcggcaatggcttttacggccaggtgtacggtggctatctggaaaccatgtacggcggcgtgggcggcgagctgttgtatcgcccggtggacagcaactgggctttcggtctcgatgcgaactacgtgaagcagcgtgactgggacaacatgatgcagttcaccgactataaggcgccgaccgggcaccttaccgcttactggcgtccgtggttaatgcaggatgtgctggtgaaagccagcgtcggagaatatctggcgaaggacaaaggggtcacgctggatgtgtcgaagcgctttgacagcggcgtaatggtcggcttctacgccaccaaaaccaacgtgtcagccgaagcgtatggcgaaggggatttcaccaaaggtttctatatttcgattccgatggatctgtttaccgtcacgccaacccgtggccgtgcgcaggtgaactgggtgccgctgacgcgtgacggtggtcagatgctgggccgtaagtaccagctgtacgatctgaccgccgatcgcgatgcgcgttttaattaa

SEQ ID NO: 15001 - DNA, 1715 bp, Glycine max
  Peptide Sequence Number=SeqID_106686
atgcgcggcgaaccggccgacaatcgccgccggatttacctgaaacgctgcggctggcgtcacaaattttttcctttcagttgcaactgtggtcatactgaaacgcgtgcaagccgtaacaaatgctcagcatgccgggccagacaggatgcgcccggatggaatgacggttcttatatcaacaagagtgttgccatgaaaaatatcaatccgacacaaaccgcagcctggaaagcgctgcagcagcattttgatcagatgaaatcggtagagattgccgacctgtttgcgcaggatgccgatcgttttgcgaaattctctgccacctttgatgatcagatgctggtggatttctcaaaaaaccgcatcacccaggaaaccctcgacaaactccaggcgctggcgaaagagaccgatctggcgggcgccatcaaatccatgttctccggtgagaagattaaccgcaccgaagatcgcgccgtgctgcacgtggccctgcgcaaccgcagcaatacgccgatcctcgtggatggcaaagatgtaatgccggaagtgaacgcggtgctggcgaagatgaaagccttctcagagcgcatcatcagcggcgagtggaaaggctacaccggcaagccgattactgacgtggtgaacatcggtatcggcggttcagacctcggcccgttcatggtgaccgaagcgctacgtccgtataaaaaccacctcaacatgcactttgtttccaacgttgatggcacgcacattgccgaaacgctgaaaccgcttagcccggaaaccacgctgttcctcgtggcgtcgaaaacctttaccacgcaggaaaccatgaccaacgcccacagcgcgcgcgactggttcctgaacaccgccggcgatcagcagcacgtggcgaagcactttgccgcgctctcaactaacgcgaaagcggtcggcgaatttggtattgataccgccaacatgttcgagttctgggactgggtcggcggccgctactcactgtggtccgcgattggtctgtcgatcatcctgtccatcggcttcgaaaacttcgaacagctgctgagcggcgcgcatgccatggaccagcactttgcgaacacgccagcggagcaaaacctgccggtgctgctggcgctgatcggtatctggtacaacaacttcttcggtgccgaaaccgaagcgattctgccgtacgaccagtacatgcaccgttttgccgcttacttccagcagggcaacatggagtccaacggtaagtacgtcgaccgcgacggcaacccggtggattaccagaccggtccgattatctggggtgaacccggcaccaacgggcagcacgcgttttatcagctgatccatcagggtaccaagctgattccatgcgacttcattgcgccggcgcagactcacaacgcgctggccgatcaccaccagaagctgctttccaacttctttgctcagaccgaagcgctggcgtttggtaaagcccgcgaggtggtagagaaagagtttaccgatgccggtaaatcggcggagtccgtcgcgcatatcgtgccgttcaaggtgtttgaaggtaaccgcccgaccaactcgattctgctgcgtgaaatcactccgttcagcctcggcgcgctgattgcgctgtacgagcataagatcttcactcagggcgcgattctcaacatcttcaccttcgatca

SEQ ID NO: 15002 - DNA, 306 bp, Glycine max
  Peptide Sequence Number=SeqID_106687
atggcgcgcgccgccgccggaggccgcctgatacgtcgcgacggaggcccattcgaccaggtcgttagcgaacagtccgcccagcgacatcagcatcaggctgacggtgcagttaccgccgacaaaggttttgatgccactgtcgaggccctgacgaatcacctgatggttgaccggatcaagaataatgatggcgtcatctttcatgcgcagcgtggaggccgcatcaatccagtagccctgccagccgctctcgcgcagcttcgggtagacttcactgggtataatcgccgccctggcaggtga

SEQ ID NO: 15003 - DNA, 879 bp, Glycine max
  Peptide Sequence Number=SeqID_106688
atggtgaaattagatagaaacgaccccctgatgctggcgcgccagctccctacacagacggttgccctgatccttgctggcgggcgcggtacgcgcctgaaagatcttaccgccaaacgcgccaagcctgccgtgcacttcggcggcaagttccgcatcatcgactttgcgctctccaactgtatcaactccgggattcggcgcatcggcgtcatcacccaatatcagtcacatacgctgacgcagcacattcagcgcggctggtcattgttcaacgaagagatgaatgagtttgtcgatctgctgccggcgcagcagcgcgcctcgaccgaacactggtatcgcggtaccgccgatgcggtcacgcagaatctcgacatcattcgccgctataacgcgcagtacatcgtgattctcgccggggatcacatctacaaaatggattactcgcgcatgctgctcgaccacgccgatcgtggcgccaagtgcaccatcgcctgtctgcccgtaccgctgcatgaggccaccgcgtttggcgtgatggcagtcgatgcggacaacaatgtaatcgatttcgttgagaaaccggcgcagccgccgtccatgccgggcgacgacagcaaagcgctggccagcatgggcatttacgtgttcaacgccgattacctctatgagctgctggaggaggatttgcagatcgccgactcaagccacgatttcggtaaagatctgctgccgaagctcgtcgccagcggcgaagcctacgcgcactccttcacgctgtcgtgcgtacagaacgacgaaaacgcggaaccttactggcgcgacgtcggtacgctggaagcttactggcacgccaacatcgatctggcatcgtga

SEQ ID NO: 15004 - DNA, 213 bp, Glycine max
  Peptide Sequence Number=SeqID_106689
atgaacgcacctttcacctatgcctcacccacgctgacggttgacgccctcaagcactcaatcgcctataagctgatgtttaccattggtaaagatccgtcgatcgccaacaagcatgagtggctgaacgccgcgctgctggcggtacgcgatcgcatggtggagcgctggctgcgctccagccgtgcgcagctgtcgcaggatgtgcgtcag

SEQ ID NO: 15005 - DNA, 1794 bp, Glycine max
  Peptide Sequence Number=SeqID_106690
atgattgccagttggctgctgagccagctcacgccgctgtggggcgatcgcctgtttgtgcttaccacgctggtcggtctggtgccggtagcccgcagcgcgtggcaggccatacgcagcggctcgccgttcagcattgaaaccctgatgaccctcgccgccgcgggcgcgctggtgattggcgcccatgccgaagctgccatggtgctgctgctgttccagctgggagaacggctggaagcctatgccgccgcgcgggcgcgccgtggcgtcaccgcgctgatggcgctgcgtccggacatcgccacgcgcgtcaatggcacacagcgtgagcaggtggcactggcggcgctgcagcccggtgatgtgattgaagtagcggcaggcggtcgtctgcccgccgatgccgagctgctgcacgccagcgccagctttgatgagagcgcgctgaccggcgaatcattaccggtggcgcatcagccgggcgatgccgtaatggcaggcgccaccagcgtggatcggctggtgacgctgcgcgtgacctcacagccgggccacagcgctatcgaccgcattctgcagctgatagaagaagctgaaagtcaccgcgcgccggtggagcgttttatcgatcgcttcagccgcctctacacgccggccatcatgctgctggcactgctggtgatggtgctgccgccgctgctcggattaggcgcctggctgccgtggatctacaaagggctgacgctgctgctgattggctgcccgtgcgcgctggtgatctccacgcctgccgctatcacttccggcctggcggcggcggctcgccagggcgcgctgattaaaggcggtgcggcgctcgaacgcctcagccgggtgcaggcgctggcgtttgataaaaccggcaccctgaccgccggtaaaccgcaggtcaccgacgtgaagccgtttggcgcggatacacagcaacagctgctcagcctcgcggccgctattgagcagggctccggccacccgctggcgcgggcgatagtcgcggaagcgcagcaccagcagcaggtgatcccaccggcgcagcatcagcaaacgctggccggcagcggcattcgcgcgcagatcgacggcgtgatgcaccagctgctggcaccgcgcgatgtggcggcgctgagtgacgcgcagcagcagcagattgcgcagctggaggcacagggcaaaaccgtggtggtgctgttgcgcgaagcacagccgctcgggctgctggcgctgcaggatttgctgcgcgaggaggcccgcagtgcgctggcggcgctgcaggcgctggggattcgcagcgtgatgctgaccggcgataatccgcgcgccgccgccgcgattgccgccgaactcggcatcagctatcgcgccagtctgttgcctgcggataaggtagccgccgtgcgtgaactgggcgaacagcagccgctggcgatggtcggcgatggcatcaacgatgcgccagccatgaaggccgcgacgctggggattgccatgggcagcggcactgatgtggcgctggaagcggccgatgcggctctgacgcagaataacctggcgattctgccgcgcaccgtgcagctggcacgccgcacacgcgccattatccgtcagaatattgcgctggcgctggggctgaaggcgattttcctcgtcaccacgctgctcggctttaccggcctgtggctggcggtgctggccgattccggtgccaccgcgctggtcaccgccaacgcgctgcgcctgctgcgtcagcgctga

SEQ ID NO: 15006 - DNA, 717 bp, Glycine max
  Peptide Sequence Number=SeqID_106691
cacgccagccacggccgccatcgccgcgccgatcacaaaggtcagcgagatcacgcggtcggtgttgatgcccagcaggctggccattttcaggtcttcagcgcaggcacggcaggcgcggcccatgcgcgaataacgaatgaacagggtcagcgccagcatcgcgaggaaggtgacgacccagataaccagttgcatggtggtgagcgtggcggcaaagccgttgctctcacccagcgtccactggccggtgatcaggctgggcagcgccagatcgcgcgagccctgcgtcaggctgacgtagttctgcagaaagatcgacataccaatcgccgagatcagcgcgatcaggcgtttggaggagcgcaccggcttatacgccacgcgctcgatgctccagccataggcgctggagataatcaccgccatcacgaacccggcggcaatcatcagccacgaggtgtcgatacccatcatcatcagggcggcgatcacgataaaggagacatagctgccgatcatgtatacctcgccgtgagcgaagttgatcatgccgatgatgccgtaaaccatggtgtaaccgatggcgatcagcgcgtaggtgctcccgagggtgaccccgttgaacatctgctgaatgaaatagagaaactgctcggacatagtgaggacctgcatgtaaacgggaaatccccggtgcgttcggcaccgggttag

SEQ ID NO: 15007 - DNA, 1122 bp, Glycine max
  Peptide Sequence Number=SeqID_106692
atgagtaaaggacgcgcattactggcgggttgcgtagcgctggcgatgagccatgcggtactggcgaaagacatcaaaattgcgattgtcggtgcggcaaccggcccggtggcgcagtacggtgacatgcagttcaccggtgcggcccaggcgatcaaggacatcaacgccaaaggcggcgtaaacggcgacaagctggtcggcgtagaatatgacgacgcctgtgacccgaaacaggcggttgcggtggccaacaaagtggtcaatgacggcatcaaatacgttatcggccacctgtgctcctcctccactcagccggcatcagacatttataacgatgaaggcattctgatgatcaccccggcggctaccgcgcctgaactgaccgcgcgcggctatgccgacgtgatgcgtaccaccggtctggattccgatcagggcccgaccgcggccaactacatcctcgatcagatcaaaccaaaacgtattgccgtggtacatgacaagcagcagtacggtcagggcctggcggaatccgtgcagaaaaccctgaaggcgaaaggcggcaacgtagtgctgttcgaagggatcaccgctggcgataaagacttctccacgctgattgcgcgcctgaagaaagagaacgttgacttcgtttactacggcggttactacccggagctgggccagattctgcgtcaggctaaaaccgccggtctgaaagccggctttatgggaccagaaggggtcggcaacgcttccctgtctaacatcgcgggtgacgcctctgaaggcctgtacgtgacgctgccgaagcgctacgaccagctgccagacaacaaagcgattgtggacgcgatcaaagccaacagcgcatcaaaccgcaaagatccaaccggcccgttcgtctggaccacctatgcggctattcagtcactggtggcgggcattgagcgcagtaaaagcgatgagcctgatgcgattgctaaaaacctgaaagagggtgcgccggtacccaccgtgatgggtaacctgagctgggaccagaagggcgatctgaagggcttcgaatttggcgtcttcaaatggcacaaagacggttcttctaccgcagttaagtaa

SEQ ID NO: 15008 - DNA, 2709 bp, Glycine max
  Peptide Sequence Number=SeqID_106693
atggtggccgggctggagcgcgtcacgtcgggcgatatctacatcgatgatcggcgcgtcaccgacatggagccgaaagatcgcggcatcgccatggtattcccagaattacgcgctctacccgcacatgacggtgggagaaaacatggcttacggcctgaaaatccgcggcatgggccaaggaaccagattacccagcgggtgatggatgcggcgcgcagtctggagcttgatcacctgttgcagcgccgtccgcgcgagctctccggcggccagcggcagcgcgtggccatgggccgcgccatcgtgcgggaaccggcggtgtttctgtttgatgagccgctgtcgaacctggatgcgcgcctgcgcgtgcagatgcgtctggagctgcagcaactgcaccgccggctgaaaaccaccagcctgtacgtcacgcacgatcaggttgaagccatgacgctggcgcagcgcgtgatggtgatgaataaaggcgtggtggagcaggtgggcacgccggtggaggtgtatgagcgtccggccagtcagtttgttgcgtcgttcatcggcgcgccggcgatgaacctgctacccggtcagatcaatagcgatggctcgcgctttacgctcgacgcgctcaacagcctgccgctcggcgccggcaaagcgcgatgggccaaccgtccgctgacgctcggcattcgtcccgagcatattcagctcagcagccgtgaggccggcggtgtgccgctggtggtggatacgctggagatcctcggcgcggacaatcttgcgcatggccacattggcaacacgcggctggtgcctgtggctacaactgccgccagatgcgttacacttcttcgattctacccatggaaagcgtctggaatgagtgtaaaaaactggccctatccgcacattgttgcgcatcgcggcggcggcaagctggccccggaaaacaccctggcggcgattgatgttggcgcgcactacggtcataccatgatcgaattcgacgctaaactgtcacaggataagcagattttcctgctgcacgatgacacgctggaccgcaccagcaacggctggggcgtggcgggcgatctgccgtggcagcagctggcgcagctggatgccggcagctggtttagccgtgaatttgacggtgaaccgctggcattgctgagcgaggtggccgcgcgctgccgccagcatcagatgatggccaacattgagatcaaacccagcagcggtaccgaggtggaaaccggacgtgatgtggcgctggccgcccgaacgctgtggcagggacaaacggcaccgctaatgtcctcgttctcgtacgcggcgctggaagcggcgatgcaggccgcgccggagctgccgcgcggcctgctgctggatgagtggcacgacgactggcaggcgctgaccgccgcgctcgactgcgtctccatccatttaaatcatcgcttgctggacgccagacgcaccgccgcgcttaaagccgccggtctgcgtattctggtgtataccgtgaatcagcccgcgcgggcgcgcgagctgctgagctggggcgtggatgccatctgtaccgatcgcattgatgctatcggcccggacttcccttgcgctgcatctcctgattttgctgctgctgatcctgacgcaactgctgctgctgttgctgctgctggacctgcatgcgcgtctgcatgcgctgctggctcgggttatagccggcatgttcgccatgccgctcagcggcatcagtgccgcgataacaatcagccattttttcatggtgttcctccatcagtgcggcctgcttctttgcaaacacttgcagcaatcaataacaaatgtaaacaactgaaaggatggtggcaggatgaggataaagagcggtgtgcgccagttcggctgggcgctgttaatgagttttaccgtggtgcagggggcgcaggcggcgccggccagcgccccgccggtatcgtatggcgtcgacagcgacacctttcacccggtgaaagcacagcacgggatggttgcggcggcaacgcggttgatgcggcgattgcggtgggctttgcgctggcggtcactcacccgcaggcgggcaacctgggcggtggcggctttatgctgctgcgcaccgctgccggccgcaccaccgccattgatttccgcgagatggcgccggcgcgtgcctcgcgcgatatgttcctggataagcagggcaacgcggatagtaagttatcactcacttctcatctggcttccggcacgccgggcaccgtagccggttttgccctggcagcgcaaaagtacggcacgctgccgctcagcacgctgctggcgccggcgatcaaactggcgcgcgacggcatcatcgttaacgatgcgctggctgacgatctcgctacctacggtaaagagaacctgatcaaccacgacaacagtcgcgccattttctacaaagccgacggtcagccgtaccagaagggcgatcgcctggtgcagaaaaacctcgcgcatagcctgcagctgattgctcagcaggggccggatgctttctacaaaggcaaaattgccgatgagatcgctgccgaaatggcgcagcacggcggactgattggcaaggcggatctggcggcctaccgcgcagtggaacgcaagccggtaagcggcagctaccgtggctacgag

SEQ ID NO: 15009 - DNA, 2067 bp, Glycine max
  Peptide Sequence Number=SeqID_106694
ggcgcgcagataacgatcgttcttcagttcactcataatgggctctctcatgctaaggccggcagtgtagcattttcacgccgcgctggcgcgacacagcgcaaccgtatcttcaatcagccggcgcgccacggtgcccggcggcggcaacaggggcaggtcgtcgtaacgataccagccagcatccagcagctctttaccatcatgctgcagctcgccgccatcgtactccgccatgaacgccatcatcagcgagtgcggaaacggccacggctgcgaggtcacgtaacgcacattttttacccgcacgttgctctcttccatcacctcgcgggccacagcctgctccagcgtttcgccgacttcgacaaaaccggccagcacggtgtagatgctgttgcgatggcgcgcatggtttgccagcaggatctcctcaccgcgacgaatcgccacaatgatacagggggcgatttgcggatagtagcgctcgcggcagtggctgcacaggcaggcaaattcgcgcttgctgtgctgcatttcatggccgcaatagccgcaccagcgatgcgaacggtagaactcagccagctgcacgccgcgcccggcgagctgaaacagaccgacatcttcgtcaatcagctggcgcaccgaggccatattgtccggacgcgcttcgcataccagccagacgttttcgccctgccactcgccaatcactctgccgctgctgccgagctgacaatccaccagccagcgtctacgcttgagatctcacgttgcatcttaatcgttgtccttagcgtcaaatggcacgctgaaatcctgatgttaagtggcggtaatgaattagtcgactcatggttgcgcgcccgtcgacagctgctcgtcacctattacgagttaattggcatgaagccgaacaaagaagcgctgactgcgctggatgaacaggcgctggatgcgttttgccatcgtctggtggactatctctctaccggccacttcagcgtttacgagcgcatcatcagcgagatgtccggcgacagcccgatgattgcggcagcgcagatctatccggcgctggaaggcaatactgaacggctgatgcaactgtatgacagccatctgcagcaggccattaatgacgacaactgcgtggatttccagcaggcgctgtcagaagtgggcgaagcgctggagtcacgctttacgctggaagacaaactgattcagctcgcctgggataaccagctggcgcgcccgccggtggccaatgacagcaccattgctctcagtaaagtcgcttatcgcgtaaaacgtaaacttgtcggagtgcccttaggggctgagaccgttaattcgggatccgcggaacctgatcagtcaggcgcccgcaccgtttctgttactccttccggactccggacaagcagcttccccttgttttcaggaaacttgctatgtctgatgctaaaacctcacgtcgtgaacaacgcgcgcaggcgcaaaaatttatcgattcgctccagggaaccgccttccctaactcacaaacgtatctggatcagcggcagccgcgcggatatccgcgtcccgatgcgcgaaattcagctcagcccgacgcacaccggcggcagcaaagatcatccgcaatacgcagaaaatgaaccggtgccggtgtatgacactgccggtgcctatggcgatccccacgcgaccatcaacgtgcatcagggtctggcaaaattgcgcgccggctggatcgccgaacgcaacgacagcgaaaccatcagcgcactcagctcaagctacagtcagcagcggctggcagatgacgggctggatcatctgcgttttgaacacctgccgcagccgcgccgggccaaagcgggtcgccgcgtcacgcagctgcactatgcgcgtcagggcattatcacgccggagatggagttcatcgcgctgcgcgaaaacatgggacgtgagcgtatccgcagtgcaacgctgttgcagcagcacgccggccacggctttggcgcgcagctgccggagaatatcagcgccgaattt

SEQ ID NO: 15010 - DNA, 1546 bp, Glycine max
  Peptide Sequence Number=SeqID_106695
atgccccgcgacgtcaaggatgccccttctggggcgttacctgagccaagggataaaaccaccatgcaacaacgtcgtcctgtacgccgcgctctgctcagtgtctctgacaaagccggtatcctcgaatttgctcaggccctctcccatcgtggtgttgagctgctctccacaggtggcaccgcacgcctgctggcagatgccggcctgcccgtcacggaagtttctgactacaccggtttcccggaaatgatggatggacgcgtcaaaacgctgcaccccaaagtgcacggtggcattctgggccgtcgcggcaccgatgatgccatcatggccgagcacgccatcaatcctatcgacatggtggtcgttaacctttatccctttgcccagaccgtggcgaaagccgactgcagcctggaagatgccgttgagaacattgatatcggcggccccaccatggtgcgctcggcagccaagaaccacaaagacgtggcgatcgtggtgaagagcagtgactacgacgcgatcatcgcggagctcgatgccaacgaaaactccctgacgctggaaacccgtttcgatctggccatcaaagcctttgaacacaccgccgcttacgacagcatgattgccaactactttggcagcctggtaccggcctatcacggcgaaagcaccgcgccggctggccgcttcccgcgcaccctgaacctcaactttattaaaaagcaggatatgcgttacggcgagaacagccatcaggacgctgctttctatattgaagagcatgtcagcgaagcgtcggtcgccaccgcacagcagctgcagggcaaggcgctgtcctataacaatattgccgataccgatgcggcactggagtgcgtcaaagagttcagcgagccagcctgcgttatcgtcaagcacgctaacccatgcggcgtcgccgcaggcgattcaattcttgccgcctacgagcgcgcttataaaaccgatccgacctcggcgttcggcggcatcatcgcctttaaccgcgagctggatgaagcgaccgcgcaggcgatcatcagccgtcagttcgtggaagtcattattgcgccatcggccagtgaagcggcactgcgcgtgaccgcagccaaacagaacgtccgcgttctggtgtgcggtcagtggcagagccgcgtggccggtctcgacttcaaacgcgtcaacggtggactgctggttcaggatcgcgatctcggtatggtcgatgccagccagctgcgcgttgtcagccaacgtcagccgaccgaacaggagctgcgtgacgcgctgttctgctggaaagtggcgaagttcgttaaatccaacgccattgtgtatgcacgcgacaacatgacgatcggtattggcgcgggccagatgagccgcgtttactctgccaaaattgccggcatcaaagccgctgacgaaggactggaggtgaagggttccgccatggcttccgacgccttcttcccgttccgcgatggcattgatgctgcggcggcagtgggcatcacct

SEQ ID NO: 15011 - DNA, 510 bp, Glycine max
  Peptide Sequence Number=SeqID_106696
atgcccggtatcgaacaggcgattgcccgcggcctggcgtatgcgccgtatgccgatgtgctgtggtgcgaaacttccacgccggatctggcgctggcgcagcgcttcgccgaggcgattcacgcgcagtatcccggcaagctgctggcttacaactgctcgccttcgtttaactggaagaagaatctcgacgatcgcaccattgcccgcttccagcaggcgctgagcgagatgggctaccgctttcagttcatcactctggccggcattcacagcatgtggttcaacatgttcgacctcgcgcacgcttatgcgcagggcgaaggcatgcgccactacgtggaaaaggtgcagcagccggaatttgccgcacgcgaacgcggctacaccttctctgcgcatcagcaggaagtgggcaccggttatttcgatcgcatcaccacggtgattcagggcggcagctcgtcagttaccgcgctgaccggctccaccgaagccgcacagttctga

SEQ ID NO: 15012 - DNA, 833 bp, Glycine max
  Peptide Sequence Number=SeqID_106697
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctcgcatccgattgcagggacgccaatttctttggccttccccgccccattctgtccttgagatggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15013 - DNA, 638 bp, Glycine max
  Peptide Sequence Number=SeqID_106698
atgaggggagcgccaaccaaagaaagtctctcgcctttccttgtgagggatctaggcgcgcaaagtctcaaggtgatacaaagagtccacaaggcgtggagaagtccgttgaagaaagataaggagattagaggcatccgaaacggtgtcatcggtggttatcatggatggctaagagttcacacgcgagggttagattggctctccaaattgaaagttatcaatgaggagaacttcgaagctccggaggaagatgaagaagtccaagctctcaaattagagctagggaaggcgagactcgccaaggagaagttcaaatcagccgctacacacatccggaaagagtgcatcgagttacaagaggaaaacgcggccactgcaagagcccttgaacaagaaactaaaagggcccgcaaggaggaatatggccgagagaaattccgaggagcattgtggggtagcaacagtgagctcaagctccgaagagaggaaagagaccggtcacgagtgcatggcatgatcttaaaagaagagttagctgcgtgcgcaagatccaagaggagtttggctcaacacttggaagccacggagcaaagcatgctagctattatagggcaatacaaggaagagttgaacca

SEQ ID NO: 15014 - DNA, 640 bp, Glycine max
  Peptide Sequence Number=SeqID_106699
aggactacatgtcatcaccttcacagaactacatgtccttgccttcaaaggacaacacgtcctcgcgttcagaggactgcacatcctcgtctttagaggactacacgccctcgccttcagaggactacacgttctcgtttttagagggctacacgccctcgccttcagaggactacacgccctcgccttcagagggctacacgtcctcgccttcaatgggctgtacaccctcgtttttagagggttacgcgtcctcactttcagtgggctccacatctgcaccttaagagaatttaagttcatgggccacccccctgatcctggaggagggtcaactgtgcgagcacaaccagaggaggaggctatcgcgcaactactatgcataccggggcaagatttcacccacgccactgcaaagagacgagtgcggatcatgcgccctaacatgaccactcttacacagatatggatgacgttgctacttaggaaccttctgcccagtgaccacaatgtcgatctccccctggatcatgcccacaagacacccagtggacccggagaagtcgaacagggtcctggggttttcagctctgattacgggcctttgtcagtcctaccgggtgcctgtcccccaagcaag

SEQ ID NO: 15015 - DNA, 889 bp, Glycine max
  Peptide Sequence Number=SeqID_106700
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgacaaagaaaatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 15016 - DNA, 255 bp, Glycine max
  Peptide Sequence Number=SeqID_106701
atggttatccgcacctttcgtcaaccagggacaaatgagcccgttgacgcgcagagactaacgtcgtcttctgcaccttttgtcatccagggacagcgagtcgggtggcaggcggagatatcttatggtcgtccgcaccttttgtcaaccaaggcgaatgagttcgacggtttttactcttgtcgtccggcgacattcaagcccgtcaacacacgagattcttctctgttgggcggggatgatcaagttcgatag

SEQ ID NO: 15017 - DNA, 699 bp, Glycine max
  Peptide Sequence Number=SeqID_106702
atgaggtcttgggtgaggggtcagtggatcccgtttgatgcagatgctatcggccagctcctgggatatcctttagtgctggaagagggccaggagtgcgagtatggccagaggaggaaccggtccgatgggttcgatgaggaggccatcgcccagttgctatgtataccggggcaagattttgcccggactgctgccgggagacggatgcggatcatgcgcaccaacatgaccaccctgactcagatatggatgactttgctgctcagcaacatcctgcccaccgatcataattccgacctccccctgccgaagtgccagctggtgtacgccatcctgacacggatgagcatccatgtggctcagttaatcgctgatgccatctatatttttgcaggtatggcgcctaccaggcaccctctggacccagataagtccaacagggccctgggatttcccgccttgatcacaggactctgccagtcgttcggcgtccccgtcacacctatcaaggtgattcggccgcccatcacccgagcttttattgagaagtactgcacgcagagacaggtccagggtggagcaccacaggccgcggacgcgccgccacctcatcaggctggtccagccggattgtttgatacagagcagtatttgcggcatttggttcgccagcaggcggccaaccaccgagcacat

SEQ ID NO: 15018 - DNA, 381 bp, Glycine max
  Peptide Sequence Number=SeqID_106703
atgccaatctccccctgcaaaaggatcgcacccacaaagacacccagtggacccgaaaaagtcaaacagggccctggggttttcagctctggttacgggcctctatcagtcctacagggtgcccgtacccccccggcaaggtcacgtcatcatagggatcgcgccttcaagacaccctgtggacccgaagaagtccaacagggtcttggagttgccagctctaaatatgggtctctgtcagttctagggagtgtctgtcgcccccagcaaagtcatcagacccccctaccaatcgagctttcatcaagaagtactgcgcccccaggcaggcgcagggcgaaacaccacagcagcattgggatggccggtagcgggcaatag

SEQ ID NO: 15019 - DNA, 920 bp, Glycine max
  Peptide Sequence Number=SeqID_106704
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttccccaacggaaaccaccaccacatgccaccaccgtcaaccgcgctgcgccaccaccgtcgccgaccgccaccactgcaccgtccaaccccttctccccttcttccccttatcttcttctttctactttttacctccaatccaactgaaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15020 - DNA, 225 bp, Glycine max
  Peptide Sequence Number=SeqID_106705
atgattgcggttatgaacagatgttttgatgataacaaagatgatgacaaaggtgatgacaaaaagctcaaaggtcaatcaaagaatgagttcaagatgttcaagatagaatcaagaacacttcaagattcaagaggaaagttgaattcaagaatcatagtcaagattcaaggatcaagcttcaagaatcaagactcaagattcaagaatcaagagaagacttaa

SEQ ID NO: 15021 - DNA, 485 bp, Glycine max
  Peptide Sequence Number=SeqID_106706
ttggaacctcttacgtcgatgcaaaccccttctcagtattgtcaagaaacgttgaccatgttcaacagaaattgatttattcgatatccgtcacctcaggtatttttcgggcaaagtgcctcggtgagccaacttttgattttgtagtgagggttaatttcgagctccatggcgttctgtttctatcagctgtccttcctgttcagtatgaaattgggtggtgcgtccaattcgcacaaagctaccgagccggaacatcagcgctggcaagtgtaagcggggtgcgacgtgagctaaccctcacacccgccgcgttaatgcgttgccgctcagggcgcgccctttcgccattcagggaaacctgtcggcaactgcttaatgacggcaacgcgcgggcgatcgaggcggcctttgctattacgccagctggcgaaagggggatgtgtgcaaggcgattaagttgggtgcagggtgtttcccagtga

SEQ ID NO: 15022 - DNA, 288 bp, Glycine max
  Peptide Sequence Number=SeqID_106707
atgccttactttggagtcattgaagaaatctgggagcttaattatgtaaaattcattgtctatgttttcaagtgtaagtggtttgatagcaatatcggtgtgcgaaccgatgaaacaagtctctgcagctcaaaaggatttgatctaggaggatattcaggggagcggtggaggccgtttaagtcagatttgacctccatgggaggttatgattttctagaagaaaagttgatggaggacaagaaaaaagaaatgattggaggaagcagcccaatccaggagcactga

SEQ ID NO: 15023 - DNA, 162 bp, Glycine max
  Peptide Sequence Number=SeqID_106708
atgccaatctccgcctgcagatgtatcgggatcacgcccacaagacgcccagtggacccaaataagtccaatagggccctggggtttccagctctggttacgggcctctatagtcctacagggtgtccgttcccctggcaaggtcacgtcatcatggcatag

SEQ ID NO: 15024 - DNA, 315 bp, Glycine max
  Peptide Sequence Number=SeqID_106709
atggccgatgtggcgggcgccgatttcctcgggagcgatgcgccaggcggttttcggcgcttcgcggtagaagcccagcagcgactcgatgctgcgtcgggacatcatttcatcgtcggtgaacgacagcgacacgatgggcgtgcgtacggcggagaaggcgcggcggatggcctcgccatccgcgagggcgtactgcggatgcaggcaccagcgtcgccattgttcgatcaccccgcgcggcaggtcgccgaccatgcccaggcggcgcccgggaaaatagccgagcagcggcgtcagcaggggcgcgacgag

SEQ ID NO: 15025 - DNA, 405 bp, Glycine max
  Peptide Sequence Number=SeqID_106710
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttccccgcgaatctactgcctagcgctgttcgccaattctccattctccactttttccggagccccatgaatttattacctagcgctgttcatgtgtcctccaccaacgagtttggagccccgcgaatttacttcctagcgct

SEQ ID NO: 15026 - DNA, 420 bp, Glycine max
  Peptide Sequence Number=SeqID_106711
atggcgctcaattcattgtcaccactttcaattaattctcttcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15027 - DNA, 764 bp, Glycine max
  Peptide Sequence Number=SeqID_106712
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaaaccaccaaaatgaaattctcaattgccgtactgtcatcaatccttgctgtctgctcggtcacagttgctaatccagttgatcccagttcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15028 - DNA, 657 bp, Glycine max
  Peptide Sequence Number=SeqID_106713
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatgctcatagggattttaaagcttcaaagacagttgataccagagctgggagcctcagttacagttggcctctgtgtccatgtgggttccacagctgtggattcaaccgaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 15029 - DNA, 827 bp, Glycine max
  Peptide Sequence Number=SeqID_106714
ttggcccagaggcttcccggtatcaacagagacaccaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatataagaaaggataaactgaaagtaacaagagataatcagaaaattgggaaaaatccacacaccttgagtgtatctgattgttgggaatgcaagcaaagacctcatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15030 - DNA, 854 bp, Glycine max
  Peptide Sequence Number=SeqID_106715
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtgacgcgtcatctgatcaagttgctgctgctgcgtggctacgcgttcaaccgtaccgccgactttgagacggtgcggcggatcaaggagcagttgtgctacgtgagttacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15031 - DNA, 983 bp, Glycine max
  Peptide Sequence Number=SeqID_106716
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccacatcttcttcctagcatgtaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 15032 - DNA, 207 bp, Glycine max
  Peptide Sequence Number=SeqID_106717
gtgtcatcctctgaagaagaccctgaagaggacccagaggagttacctcctgaacctactgtggatgaccttgacttacctgaggatgatgaagacccactccccgatgtggattctccaaaggatatcatgtcagcatctgaggcagactctatagaggagagcggccctggagggacagcgaatagtgaagactcttcatcatag

SEQ ID NO: 15033 - DNA, 305 bp, Glycine max
  Peptide Sequence Number=SeqID_106718
ttcaagtggagggtacatccactttgttgttcaaagagaacaagggagggtacatcccttgtggatctttgcttgtaaaggattttacaaggttgaaagaaatctcaagaattgctggttgcttggggactggatcctccctagcatgcctatttataggaaaatgggcacttggggcaatggaagctcgcccaggcgagctaagcttaagtcatgaagccatgagctcgcccaggcgagctagttacttaacattgaagtcttttgttgctcgggcaagccagaggctagcctgggcgagctag

SEQ ID NO: 15034 - DNA, 300 bp, Glycine max
  Peptide Sequence Number=SeqID_106719
atgggcgtggagcattatctacagcatttggttcgccagcaggcggccaaccatcgtgggcaggtgcagatacatgagtgtctctaccagttcagcctcagtcagcaggggcagggttccacccattttgtatgccttactccggagcaatttggggctgaggtcgcatggcctggagactggcccgatgcccaggcaggggaggagcctgcaggatcccccggtgaggtggatgagtcccatatagatgaagatatgactgacctgctcggtttcttgggagggagtggagccgcgtga

SEQ ID NO: 15035 - DNA, 752 bp, Glycine max
  Peptide Sequence Number=SeqID_106720
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttattggatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15036 - DNA, 532 bp, Glycine max
  Peptide Sequence Number=SeqID_106721
atttaattccggaggaacgacttctaatgatggtattataattggcactgaaatgcttaaaaatctggatggtgttacgggtcttattgctcatgaattgattcattttcaacaaaatattatgggaaatgacatgctgctaaaatataccttgcttgagggaggagcggattttgtcagcgaattgatatctggtgaaaatattaatgtaaaagcatttcaatatggtgaagcacatgccgatcctttaaaaaaggagtttgtcgctttattaaagggaaacaatgctacggactggctttatgaaaccagtaaaaaagatgaccgtcctaatgatttaggatattggatgggatataaaatttcagaagcctattttaataaacaaacagataagcacaaagcaattcatgatatattgaatatcaaagatcccttgttatttttgaaagaaagcggttttttagatcaatacattaaagaatacacaaagaaaggccacaaaaagtttgaagacttttttaaagcgtaa

SEQ ID NO: 15037 - DNA, 49 bp, Glycine max
  Peptide Sequence Number=SeqID_106722
atgctgccgctgcgagacaaaaaagtggctcctcggaatagcaagccag

SEQ ID NO: 15038 - DNA, 243 bp, Glycine max
  Peptide Sequence Number=SeqID_106723
atggctaacgatggaaacaaaaaagattccaatagctcttactctcttcaccattccgatcatcctggaatggtcccatcagcacatgttcagccccttgtgaatggattgactgaattacaattacaacaaattttgtttattatgcacgacaatggagcatctcaatcagctactcccaaggcaaataatgtcaatttttcttcaggatttgatgacggggatgacgattggtttgggtga

SEQ ID NO: 15039 - DNA, 792 bp, Glycine max
  Peptide Sequence Number=SeqID_106724
atgcccgcctccgaggtgtatgacgaggccggcatcatcgccatcacccccggctccaccaacccgcagatcaccgagcgcggcatgaagaccatgttccgcatgtgtgggcgcgacgatcagcagggcgtgatcgccaccaactacatgctggacaccctgaaggccaagcgcatcgcggtgatccacgataaagacacctatggccaggggctggcggacgcggcgaaggcggcgatgaacaagcgcggggtcaaggaagtgctgtatgaggggctgtcgcgcggcgagaaagacttcaacgcgctggtgaccaagatcgcctcggtcaagccggacgtggtctacttcggcggctgccatccggaagccgggccgctggtgcgccagatgcgcgagcagggcgtgaccgccaagttcttctccggcgactgcgtggtgaccgaagaactggtgaccgccgccggcgggccgcagtacaccaacggcgtgctgatgaccttcggcaacgatccgcgtcagatcccggaaggcaaagcggtgatcgccaagttccgcgccagcggctttgagccggaagggtacaccctctactcctacgcctcgatccaggcgatcgccgccgccttcaacgccaccggcggcaaagacagcgccaaggccgccgaatggctgaagtcgcacgatgtggatactcgtgatgggcaaaaaagcctgggatcagaagggcgacctgaaggtctcggactacgtgtctaccaatggatgacaggcaaatatcaccagctgtaa

SEQ ID NO: 15040 - DNA, 393 bp, Glycine max
  Peptide Sequence Number=SeqID_106725
atgggtttagagatttgcttctgcgaaaacagaaagagagaggtgaatctgaaggtgctcaaggttccagaaatcgaaccgaaggtgctggatgctactgataatgaaccttggggtcctcatggtactgtgctggcagagatttcacaggctaccgaaaaatttactaaatgtcaaatggtcatgaatgtcctttggacaagactgggtgaaactggaaaagattggcgttatgtatacaaggaactttctagttttgaatatgtcgaacctagtgggaaggatgtgagactcaatgtaaggacgaatgctgaaaacattgtgtcacttttgaatgataaagataagatacatgaagtcagaaataaagctgctgcaaaccgtgataagtag

SEQ ID NO: 15041 - DNA, 609 bp, Glycine max
  Peptide Sequence Number=SeqID_106726
atgaccggtagattgctggccggatcattaacctttgattgtcgcatcatgcactatattattgttagaattttgcttccccgttcttttaatttggctcaagcctctgaggaggacttgattttgatgtgggctttccataccggtcatcagatcgactgggctcacttggttcggtatcgaatgcataaggcattaagggccaatgcacctcttccatatcctcaattggtcaccttttttctccgtcattttcaaattcctcttgatgatgaaccttttgttcaagtcaagcgttcctttgctatagatgctggtgcaatcacttcattaggttaccgtaaggatcgtaatggtcaatggcagaagaaggacacactccctccagaagacgagcgtactccttctcctcctcctcagcgcgatgattcctcagcccttatgactgaagttcttacagaattatggggtctccacacttatgttggtgaacgattcgattccttagatggtcgctttgaaggcatggatacccgcatcacccagcttaaagaagatgtgacttatcttcatcggtgcttcgatcttccaccgccttctaagtcttag

SEQ ID NO: 15042 - DNA, 395 bp, Glycine max
  Peptide Sequence Number=SeqID_106727
gactgctggaacccagcagatacttctgtagtatttcgagggcccaagaaggctctggggagagccacataggaggtccctccaacaccacaaccttatatttctgcattgactcctccttcgccactgccactatctcaggtgctttcataacccatgttgtagagcattcaccacggctagttcttgatcatccaggcattgtagtagatcgggacaacactccacctgcccattttgatgccagaggaattccttcagagcttgctgctactgctaaagagcccactactatcattgttgaggagtctcctgaagttgctattgctgaggaggagcctactgtcgccactactgttgatggattgacaagtgtaccaattcgtcccaaatag

SEQ ID NO: 15043 - DNA, 219 bp, Glycine max
  Peptide Sequence Number=SeqID_106728
gaagcaacctggctcgcctgggcgagctgggctcgcctgggcgagctcggcggcaaccacctcccctattttgctataaataggggaggaagtgaagaagaaaaggccgaggcgcttccgaaacgtttccgtaacgttttccatgaagaatttcgcaaaggtttcgaccgttcttcgacgttcttcattcgttcttcatcgttcttcgatcttcaacgg

SEQ ID NO: 15044 - DNA, 576 bp, Glycine max
  Peptide Sequence Number=SeqID_106729
atgggtgatcaagaggagacacaggaacagatgaaagccgacatgtcggctctgagagaacaaatggcttccatgatggaggccatgttaggaatgaggcaactcatggagaaaaacatggccaccgctgccgccgttagttcggctgccaaagcagacccaactctcctagctaccgcgcaccatcctcccccaaatacggtaggacgaggaagcagcacattggggcacaacagcaacccccatttgggatacaaccgggtggcttacccttatggattgccacctaattacacgccgccagtcatgcaagatgatgtgggtcatgtctcttcccccatccttgaaggggagcctcctcgacagctcgacgaggtccacgaagatcatcaagagtatgcccaaggggatgtcaagttctaccccccaaatccccgtcgaggggccggcacccaacactttgcctcagcccaacctcatagcacaaccaatattcttgtccacaaaaagaccaaccccgacggccgaagaaagaaggaaactcgatctcctcgaggtgagattgagagttgttga

SEQ ID NO: 15045 - DNA, 398 bp, Glycine max
  Peptide Sequence Number=SeqID_106730
gcgtgaccaccatggatggctgggatgtgattgagccagcagaaccaggtggtaaaccaggcaaggtgaggttacgagactcgattgagttaacgccaggcaatgtacgtgtttacaatgagaatgaaattcactcgccacgacgcgatggcccggccaagttgatccgtattgaagggaatcccaaccagagtttaccaggccgtgtctggcaaccactggttggttcttccacagtcagcagtgatgatgcgattaagaatgccatcgagcgagcagcaaaaacgctcaatcacctaaactggtttgaggtcgtagaaacacgcggccatatcgcggatgggaaagtcgcccactttcaggtcacgcttaaagtcggtttcagaattgaagagtaa

SEQ ID NO: 15046 - DNA, 189 bp, Glycine max
  Peptide Sequence Number=SeqID_106731
atgactacatcgagccggaacatttcacggccaagctgcatcatttgcccgatgccactatcggctgccagcagttctgctgccaccagaatggtccatgagcgtgaaaaagcgattctgagcccggtgaacaccggcggcgtaatagctggaataatcagcttgcgatacagcgttgttttgggcgag

SEQ ID NO: 15047 - DNA, 857 bp, Glycine max
  Peptide Sequence Number=SeqID_106732
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggtctttgcagattgcttgttcatgccctcttctaatgtcaaacaatttttggccgggtgtggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15048 - DNA, 243 bp, Glycine max
  Peptide Sequence Number=SeqID_106733
atgggtaaagtagaggaggtgcaagagcagatgaaggccgacatggaggccatgaaagagcaaatggccacaatgatggaggccatgaaagagcaaatggccacaatgatggaggccatgatgagcatgaagaagataatggaagccaatgcagttgcaattgccgctaccagcgctattgctaaggtgaacccgatgcccccatttggccttaaccaaatgaatcatccaaccttagatatg

SEQ ID NO: 15049 - DNA, 887 bp, Glycine max
  Peptide Sequence Number=SeqID_106734
atggtgaaagtgggaacttcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccatccgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttcaaccaaatgggtttcatgtggcatcatggctgtggactctgtagattcagcgctactgacatcacaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggaatgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15050 - DNA, 839 bp, Glycine max
  Peptide Sequence Number=SeqID_106735
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcaaagtataattgatgcaattaattcaagcattttcgacgaaaactggcaaaatatatttgatccgattgatccaagtacttctgataaagactggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15051 - DNA, 333 bp, Glycine max
  Peptide Sequence Number=SeqID_106736
atgcctggcaggaaaataccacattcacctgccccttcggcacttttgcctataggaggatgcctttcggccgatgcaatgcccccggtaccttccagcgatagtctagaaaaagttttgaatagatgcactgaaactaaccttgttctaaattttgaaaaatgtcattttatggttgagcaaggattatacaggcactttataagagattttagcaaggcacctgattggatagccccatttgagctaatgtgcgctacatccaattacacattgggggttgtccttgctcaaaagatctccttacttcagcttacttcttttccaccatga

SEQ ID NO: 15052 - DNA, 327 bp, Glycine max
  Peptide Sequence Number=SeqID_106737
atgttgataatcattgatcaatataaagagaaggtgaacctagctgctagtcacgggcagatgctaagagacaagcaggcgaaggtgtcggccttgcgggttaaaagggaagcaagggaagaggtgatggagttattgcataaagaaggcatgaaatggatggataggtttgctctcactctgaatgaaagtcaagagcttccaaagttgttagccaaagccaagacagtggttgacacatactccgctcctgatgaagttcatagtcttttcaattactgccaacacatggtcgaactaatgacccacataattaggaaccgctaa

SEQ ID NO: 15053 - DNA, 1010 bp, Glycine max
  Peptide Sequence Number=SeqID_106738
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtacactcttttgtctctctattcctctcttgctgtcttctttggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatgggccgc

SEQ ID NO: 15054 - DNA, 830 bp, Glycine max
  Peptide Sequence Number=SeqID_106739
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaccaagaaggctttggccctcgctgctgccgtaggcatgagcctcggcttgtccccgctcacagtagccactgcctcagccgctaccgtaaacaagaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15055 - DNA, 219 bp, Glycine max
  Peptide Sequence Number=SeqID_106740
atgtcgagccgacggggtcaggtaccagtagtgacaatggcaaaggggggggagctggacactgctgaaccggaagagattgctcaggatgagtgtctgggtaacaaagccgagaagggtgtagtcaagcgctctcagaaagcggatcaaaggctttcctattcaacggattcggattattctactttagatgcttcggatgctttcttcggccgcgca

SEQ ID NO: 15056 - DNA, 465 bp, Glycine max
  Peptide Sequence Number=SeqID_106741
atgaccatgattacgccaagctcgaaattaaccctcactaaagggaacaaaagctggtaccgggccccccctcgagtagaagttaaaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15057 - DNA, 123 bp, Glycine max
  Peptide Sequence Number=SeqID_106742
atggcgagcatcatgactagaataatcaaatttccagtcatcaacaatggtgccctcaaaaagtgcaccttgactggatggtccgtggcggcgttggccagcagcagcagtggtggaggatga

SEQ ID NO: 15058 - DNA, 423 bp, Glycine max
  Peptide Sequence Number=SeqID_106743
atggtagatgtatttagttttcagttacaactgaatctcagcagtatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15059 - DNA, 204 bp, Glycine max
  Peptide Sequence Number=SeqID_106744
atgtatgaatatcctaggagaacccgcacattaacgtgtaagcattcctttcaaaattcatatagatattcatgctttgttggaaaaaaggaaatggctccgaagaaactctccatgaagaggtctagaagagacgccacaggagaagggcccagtgccgccccagagtttgatagtcatcgtttccggagcgtcgagcactag

SEQ ID NO: 15060 - DNA, 254 bp, Glycine max
  Peptide Sequence Number=SeqID_106745
atgaatattgaggaatccattcatgttacttttgatgaatctaatgctatcttgtcaagaaagaatatgctagatgatattgcagaatctttagaacaaattcatattcatggacaagattctaaagaaaaagggaaaggaagcaatgaagatcctctagaagaagccaaatcaaataatgaactcccaaaagaatggaaagtctcaaaagatcatcccctcgacagcattatcggtgatatctcaaaaggggg

SEQ ID NO: 15061 - DNA, 435 bp, Glycine max
  Peptide Sequence Number=SeqID_106746
atgggatcaagagcctgcaagttcacctgtaggatcatcatctactgggtatctagcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15062 - DNA, 639 bp, Glycine max
  Peptide Sequence Number=SeqID_106747
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttctggttcgtcttaaagatgctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15063 - DNA, 470 bp, Glycine max
  Peptide Sequence Number=SeqID_106748
atgaccatgattacgccaagctcgaaattaaccctcactaaagggaacaaaagctggttttttcctataaagcattttccgctatctaatcctggaaacaaaatagatcagctcagaagaatgctgctagcagctgattcgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 15064 - DNA, 231 bp, Glycine max
  Peptide Sequence Number=SeqID_106749
atggcagcggaatggagaaggaagagagagaggagacgccacttcaaggagaagatgagtctagaagaagctcaccaccataggaggccatggataagagcttggaggaagaaggagatgaatgaagggagagggagaaaagagcacgaaattttatgctcaaaaagagctctgaaatctgaacccactaatccaagatcaattccaagattctccactaagtgtgcttag

SEQ ID NO: 15065 - DNA, 219 bp, Glycine max
  Peptide Sequence Number=SeqID_106750
atgcttctacagtctgaccgttgggattttgaaaataataagtttggtctccctctaagtgagaatggcatgctaagcgcaattccaatcgaggggaattgcgctgaggggcccaaagctgcgctaagcccaattccaatcgaggggaattgcgctgagttgcccaaagagacttgcgttggatcgacaagcatgaatgagagagagccctttgagtaa

SEQ ID NO: 15066 - DNA, 537 bp, Glycine max
  Peptide Sequence Number=SeqID_106751
atgtcttccctagtgatcataactccgaccttcctctgccgaagtgtcagctggtgtatgccacccaccaggcaccctctagacccgaataagtctaacagggccctggggtttccggcattgatcacgggcctctgccagttattcggggttcccgtcactcctagtaaggtgatccgaccgtcgatcacccgggccttcattgagaagtattgcacgcctaggcaggcacagggtgatgcacctcaggccgtagacgcatcgccaccacctcatcaggctgatcccgctgggtcattaggcatggagcgttatctacagcacttgctcagcctcagtcagcaggggcagggttttgctccttttgcgtgccctactccagatcagtttagggctgaggtcgcatggcccagagattggcccgaggcccaggcaggggaggtgcctgcagggtccctcggcgatgcagaggaggcccgtatggatgaggagatgacagatttgctcgatttcttgggaggaagcggagccacgtga

SEQ ID NO: 15067 - DNA, 884 bp, Glycine max
  Peptide Sequence Number=SeqID_106752
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccgtaatatcctgtccctcagatgcttcaagcttgcatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15068 - DNA, 453 bp, Glycine max
  Peptide Sequence Number=SeqID_106753
atgggctttctacaagatgacagagaatatgttgaggcaatcaaagaggctaagggctggggcacaactaattatctaaggaaattggttgtattaattctattaacgggtgccatgaccaaacctaaagaagtttggaatcaatgttggcattggctagctgatgacattgcatatcaatatagtaaatcaacaatcaactcagaagtacagatcaatgatgatactcttagaaatttgacattgattgaaattgaacaactattgcacataaaccaaatatcactaatagactatcctacaatgccatatcctcaagatatcaatctcacatcctacctacaaaacaacttggtattatcagaacttgactacaaccatgatgcaacgagatcagaatttgagcatctttttgcatccatgacaggcaatctacctattcatatattataa

SEQ ID NO: 15069 - DNA, 468 bp, Glycine max
  Peptide Sequence Number=SeqID_106754
atgaccatgattacgccaagctcgaaattaaccctcactaaagggaacaaaagctgcttcgatgaccaatacatctggtataagaaagatccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15070 - DNA, 789 bp, Glycine max
  Peptide Sequence Number=SeqID_106755
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgagttctgttatgtttgcatctgagtacttattccactgctacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15071 - DNA, 227 bp, Glycine max
  Peptide Sequence Number=SeqID_106756
gaaagctagaagatgcctcggaagatcgaggttcttcttctggagttgttactgcttctaagtcctgcaaaaaatttctaattctctctgcattgcgccttttgcaagtagcgttaatctccaaatcgatggggatcaaatcacttgcagtagatcttctttgcatacaagagaaacaaaacaacaattatccatttcaaaagaataataaaatgtgcaataactaa

SEQ ID NO: 15072 - DNA, 459 bp, Glycine max
  Peptide Sequence Number=SeqID_106757
atggtttggctggatggtcagggacttcgaagaaggatgactggaaagttggtgacaaagaaatctggggaagagggatgtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15073 - DNA, 774 bp, Glycine max
  Peptide Sequence Number=SeqID_106758
atggggacaaggggttgcatcagctacaatctcgttcttgctataagacaacttggctaccctatgagagaggcaccactagaggatgagctcgcgcctgtcatttcacgaggcttcaataagaccaacatggagacacttcagaaggtccacaaggcatgggaggtgttgcgaaaaaaggacaaagaactcaggggcagtaacaatgggcccattagtggctgccgtaagtggttgaaagtccacatgcatggtttggattggctcccaagtttgagaaccactaaaaggaaggaagttgaggcaccggaggaagataaagaggtgcaggccctttgggcggaacttgagcaagcccaaacagttaaagaaaagttcgaatcagcagctctgaaaatccgaaaagagaataccgaactgagagatgtaaatgtggctaccaccaaagccttggaacgagaaaccaagagggcttgtagggaagaactcggtcggaacaagttccgaggggctctgtggggtagcaatagtgagcttaaactccgaagagtggaaagggaccaatcacgagtagatagtttgatcttgagagatgaattgaaggcttgctcgaggtccaaaagaagtttgtctcagcggttatgcgagacagagaccaacatgttagctaatatcaccaagtaccaagaagaactaaatctagccgcggtccacgagcatagagtggcggacgagtatgcccaactgtacgcgaaaaaggaggctagaggaaag

SEQ ID NO: 15074 - DNA, 441 bp, Glycine max
  Peptide Sequence Number=SeqID_106759
atggagtctcactgtcacccaggctggagtacagtggtgcaatctcgtctcactgtaacctttgcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15075 - DNA, 174 bp, Glycine max
  Peptide Sequence Number=SeqID_106760
atgaccaagagcaagggcaaggatccacttgaaggacttggaggacctatgacaagggctagagcaaggaaagccaaggaagctcttcaacaagtgttgtccatactatttgaatacaagcccaagtttcaaggagaacagtccaaggttgttaatggaaataagttattttaa

SEQ ID NO: 15076 - DNA, 205 bp, Glycine max
  Peptide Sequence Number=SeqID_106761
aggcgattgtgttcggtggcacgcagagacaaattatggtcattctgcgccgtgtgtcaaccaagaggaacgaattcgacagtatctggatgatgttggtcgtcgggggtgcatatagcaaccaggcccacttgggccttccaggaagttctccagaaggcggtgccttcaggaggaagcaacctagctcgcctgggcaagctgg

SEQ ID NO: 15077 - DNA, 504 bp, Glycine max
  Peptide Sequence Number=SeqID_106762
atggcacgctatctggcgaaacagatgaagctcaagctgcagctcgtgccggtgaccagcgccaaccgtgtgccgtatctgcaaaccgataaggtggatctggtcatctccagcctcgggaaaaacccggagcgcgagaaggtgattgattttagccgcgcctacgcgccgttcttccttggcgtgtttggcccgaaaggggccgagctgaaagatgccgccgggctgagcggaaaaactatcggcgtgacgcgcggggcggtggaggacatggtactcaccagcctggcgccgaaagatgccaacgtgaaacgttacgaagacaataacaccacgctctctgcatacctttccggacaggtgcagtacgtggcgactggcaacctcgtggtggcggcgatttcccgccagaatgccgataaggccccggtgccgagctttatgctgaaagattcaccgtgctttatcggcctgaagaaaaacgaaccggctctgaaggcaaaa

SEQ ID NO: 15078 - DNA, 654 bp, Glycine max
  Peptide Sequence Number=SeqID_106763
atgacgatgctgtgtgtgacgcatgagatgggctttgcgcgtacggttgccgatcgggtgatctttatggatcgcggtgaaatcgtggagatggcgccgccggaagagttctttgcgaatccgaaatccgagcggacccgggcgtttctgtcgcaggttttttattgcgataaaggtcatggcagaaaacaaaaaagccctgaacagatgttcagggctttcgtgtttgatgcctggcagttccctactctcgcatggggagaccccacactaccatcggcgctacggcgtttcacttctgagttcggcatggggtcagagtcgaactggggacctcacccttaccaagggtgcgctctaccaactgagccatatcagcacactaaatttgatgcctggcagttccctactctcgcatggggaggccccacactaccatcggcgctacggcgtttcacttctgagttcggcatggggtcaggtgggaccaccgcgctgttgccgccaggcaaattctgttttcgtccgcgtctttcgcgctctgactgcgttgccccgctcgcgccgctcagtcacatacttctgtatgctccttcacgtcgtctcgcgtgccgccttgtcacagcacaaaatccactggacgtaatccggtga

SEQ ID NO: 15079 - DNA, 192 bp, Glycine max
  Peptide Sequence Number=SeqID_106764
atgttgaagaaattggcctacactccttgcaagaatacatttgatcaaaatttagaaaaatttcgtcaattgagtccagccatagcaacatggattgatcacatttcaaggaaaaatggaccatgggcttatgataaagaagggtgtagatatggtcacatgacaaccaatctctcagaatgtgtaaataag

SEQ ID NO: 15080 - DNA, 327 bp, Glycine max
  Peptide Sequence Number=SeqID_106765
ggcgcgtcccattcgccattcaggctgcgcaactgttgggaagggcgatcggtgcgggcctcttcgctattacgccagctggcgaaagggggatgtgctgcaaggcgattaagttgggaattcgatctgtccgatgccgacctgcaggccctgctggcgcgtttcgaccaggactacaacctgaccccccaggagctggggcaactggtacgggcgatcaagcttatcgataccgtcgacctcgagggggggcccggtaccagcttttgttccctttagtgagggttaatttcgagcttggcgtaatcatggtcatagctgtttcct

SEQ ID NO: 15081 - DNA, 879 bp, Glycine max
  Peptide Sequence Number=SeqID_106766
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataatgccttgtatgccagccgtattctttgtcttgatatgcacgcattgcggcagcgcgaacaacggcataatccacttcgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 15082 - DNA, 636 bp, Glycine max
  Peptide Sequence Number=SeqID_106767
atgaccctggcattgaccagccgcctgatcgacagtgatactggcattgagcgtctgagtgcgacattaggtcaacgtttttattttgaagacgagaaggtcaccctaccgaccaccactagcagcacacgcaaatcgtctgatattctggcaggatttacagcacgtctttccagccggttgaacctggacacgttctggcaatatgaccccgaccgcggcaatatgcagcgtaacaattacttgttgcgttacaatcccgagcctggcaagtctttcagctttggttaccgttacaccgctaatacgctggaacagtttgatacttcagcacagtggccattagggactggctggtacggtataggacgcctgaattactccatccgcgacggtaatgccgtgcaattcctcggcggcctggaatatgatgccggctgctggcaagcgcgtgcggtcatgcagcgtgtgcaaacggcaacagctaacgcgaactatgccatgtttttccaactcgaactgggggggctaacctcaattggtgctaaccccttaaatgtcatcaagcgcaatattccaagctatatgcgcacctacgacatcccgtcaacttacagagaccagaacacgcaataa

SEQ ID NO: 15083 - DNA, 354 bp, Glycine max
  Peptide Sequence Number=SeqID_106768
atggaagccgcggaggagtcattggaaacgactttccaatcttttgaggtagtaagcatcgcctccatagattctctctctaggccgccccacttgtccgatgcggcaatgatggtggcccgggtgatgctggggcacgggtacgagcctggaatgggtttgggcaagaacaacggtggcaggaccagcctggtaagtaccagaggaaaccgcgggaattttgggttaggctataaacctacgcaggctaacataaggaaaatatctcagaaaggaagaacaaaggccagggcccgtggtcgggacaacaagccaaagaggctttgccgtgccacatcagcaggaacttcataa

SEQ ID NO: 15084 - DNA, 726 bp, Glycine max
  Peptide Sequence Number=SeqID_106769
atgacttacaaaatcactcttaaaggcaaccgaaattttagagcgacagaaagaaagagggagaagtttgccgacaatgcatcggctgaaatatgggagggagaaagaaaagttgaggaaatgcttctcaactgggggaaggctaatgataaaattgagggaaaggtcctcccaaatagtggagggaattgcaagaggttgaaagagaccagctggtttcctgggtttttgcaattcccacatggttgtcctaaggggtggaatggaattcctccaacaataaggaagtatggtatgtgggataatgcgtcggtcgtgacattgccagaacctggccagtattggatcgatgatgatgacaaagggatgacccaagagaacgcgatggggtgtgaccgctggaggagaactgcttccatggttgagccggatgtgtcggatttaagagtaaaaggaaaatcaaaatcaggggaagccagtattggagcttccctcatagcctccacatatgaaacgacgatagaatcccgtcaaaccgagaaaaccacaaagctcgatggtggatgtccaagatggccactccctcatggcactaatcttggcaaggataaggtagcaaaatcaactccatcctcaaatgttggctgctctatccacggtgccattggctccgaaatcccctctgccctcgtccctaccttcaccttcatccagctagcctcatga

SEQ ID NO: 15085 - DNA, 1665 bp, Glycine max
  Peptide Sequence Number=SeqID_106770
atggagatcgagcggggtaacaataatgagcacaaaggttcaagatatgccgttgcatgtgcggtagtcacttccatgatatccattatatttggttatgatactggtgttatgagtggggccctgatattcataaaggaggagctaggaatcagcgacacccaacaagaagttctagctggcatcttaaacatttgtgcattgtttggttctttagttgcaggaagaaccgctgattacattggtcgacgctacacaatcaccctagcctctattcttttcatggttggttcagttctcatgggatatggtccaaactacgcaattttaatgactggaaggtgtgttgcgggtattggtgtcggttttgctcttttgatagcaccagtttatgccgcagaaatctcctctactaaatcccgaggctttgtaacctccctacccgagctttgtattggcattggaattttacttggttacatagtaaactacttgtttgggaaactaattttgaggcttggatggagattgatgcttggtattgcagcagttccttcacttgctttggctttgggcattctggcaatgccagagtctccaaggtggttggtgatgcaaggccatttgggaaaagccaagaaagttctattacaagtttcagacacagaagaagaagctgagcttcggttgaaggatataaagagtgctgccggcattgacgagaattgcactgaggaaatagttaaacttcctcaaaaggacaatggtgaagcggtttggaaagagttgattttcaggccctcttattctgttcggtggatgctgattgctgctgtggggattcacttttttgagcatgcaactggaattgaagctgttatgttatacagtcatagaatctttaagaaagcaggtgttaccagcaaggacaagctcttgctcacaaccattggagtaggccttacaaaagtcatttgcttgataatagccactttttttattgacaaagttgggagaagacccctcttgcttgtaagcgttggaggaatggtttgtagccttggggtgttaggattcagcttgaccatggtggatacatcccacgaggaactcttgtgggcattaattcttagcattgtggccacttatatctatgttgcgtttttcaatcttgggcttggacctatcacgtgggtctatagctctgagattttccctttgaagttgagggcacaaggagcaagtataggagttgcagtcaacagactcaccaatgctgctatttccatgagttttatatcaatctataatgcaattaccataggcggggcttttttcatgtttgctggtatatctgttattgcttgggcgttcttctactttttcatgccagaaaccaaaggcgtggccttggaagagatggagatgcttttcagcaaaaacaagggaaataataagaggaggggtgaaagaaagggagtgaatgaaacacctaggagagggggttctgtcgtggcgcgctcagcgcgacacccgctcgctcagcgcatgcttaacgcgttctatttcagttatgcacgcttaacgcctgttgcgcactcagtgcacatgacaactctcgagcttaacgcctcgcttaatgcatgtgcttcctggcccgcttag

SEQ ID NO: 15086 - DNA, 1551 bp, Glycine max
  Peptide Sequence Number=SeqID_106771
atgagagttcccgttccctcatccccacaggccaacccaaaacccaccaataacgtagtccgtaccattgcccttcccaacctcaacaccaccaccaccaccaccaccacgagcttgtgctacgagcccacttctgtcctcgacctgtgccggagcccgagcccgagcccgggcaccgaaaagcccaccaacgatcacgccgttctcgacctggacgaccatgcgttgcacaacttggactgggactccatcatgaaggacttgggcttacacgacgactccgccacccccgtattgaaaacttttctccaccccgacgacgacaacaacaacccatcatgcgacgacttcacacccttcgaccacgcgcttgaattcacctctctctccgacatctactccaaccaaaacctcgccttcgatttcaaccacttgcctcacgacttcaaccaccacctcaatggcttcgatttcatcgaagagctcatccgcgccgccgactgcttcgacaccaaacagttacacgtggcgcaggtgatattggagcggctcaatcaaaggctacgatctcctgtgggaaaacccctccagcgcgcagcgttttacttcaaagaagctctccagagtcttctctccggttcgaaccggaccccgaggatttcgtccctggtggaaatcgtgcacagtatcagaaccttcaaggccttttcgggaatttcgccgatcccaatgttctctatcttcaccaccaatcaaatagttctggatcacgctgcgtgctccttcatgcacgtcatcgacttcgatataggtcttgggatccaatacgcttctctcatgaaggagattgcggagaaggcggcggagtcgccggtgctccgaatcactgccgtcgttccggaagaatacgccgtcgagagcacgctcgtccacgacaacctcgcgcagttcgctctcgaactcaggatccgagtgcaggtcgagttcgtggcgcttcgaaccttcgagaatctctccttcaagtccgtgaagttcgtcgacggcgagaataccaccgtgctcttgtcgccggcgatttttggccacctcggcaacgccgccgcgttcctggcggacgtgcggaggatctcgcctagcatggtggttttcgtggacggtgagggatgggcggagactgccacggcatcggcggcgtcgttccggcgtggcgttgtgagcagtttggagtactactcgatgatgctggagtcgcttgacgcgtcgacggtgggaggaggaggggagtgggtgaggagaatcgagatgatgcaactggggccgaagattttggcggcggtggaaagcgcctggcggaagttgccgccgtggagggaggcgttttatggcgccggaatgaggccggtgcagttaagccagtttgcggattttcaagcggagtgcttgttagcgaagtcacaaatcagaggcttccacgtggcaagacgtcagaacgaactggtgcttttctggcatgatagggccatggttgccacgtcagcatggcgctgttag

SEQ ID NO: 15087 - DNA, 1644 bp, Glycine max
  Peptide Sequence Number=SeqID_106772
atggtgatgtttgtaccactgcaacacattgtgaatcgctattgccaaaattttcagcttctcaatctctttctgaaaccaaaaagctgcacgccctcatcctcatccttgccaagcttgttctcctggaacgctatgatgaggttgtatgtccaaatggggcacccccttgatgcttgtggtgacttgtctttgattgatgtgggcgttggaattcatgggcagacctttaagtttggctatgattccgacacatttgttcaaaacactttgttggcaatgtatatgaatgccggggagaaggaagcagcacaactggtttttgacttgatgctggaacggactgtgatttcttggaataccatgattaacgggtacttttggaataactgtgtagaagatgcagtaaaggtttatggtagaatgatggatgtgggtgtcgagcctaattgtgcaactgtggtttcggtgttgcctgcttgtgggcttttgaaaaatgtggagcttggcagagacgttcatgcattagttcaggagaaaggattttggggagatattgtagtttggagtgcattgccggacatgtatgttaagtgtggtcagatgaaggaagcatggttgctagcgaaggggatggatgagaaagatgtgtgtgaaggagtgaaaccaaattcggtaagcatagcttctttactatcagcatgtggcagtttggtttatttgaactatggcaagtgcctgcatgcatgggcaataaggcaaaagctcgagtctgaggtcattgtggaaactgccttgattgatatgtatgccaaatgtaatcatggcaacctcagttataaagtgtttatgggaacctctaagaagagaacggccccatggaatgctcttctatctgggttcatacaaaataagcttgcaagagaggcaatagaactctttaagcaaattgcaacaattgctgcttatggaaagcatggacatggcaaaatggctgtgaaacttttcaatcagttggtacaatctggagtaaaaccaaatcatgccaccttcacctctgttctgcatgcttgcagccatgcaggtttggttgacgagggtttttctttgttcaactttatgctcaagcaacatcaagttattccccatgttgatcattatacttgcattgttgatcttcttggacgtactggtagactgaatgatgcttataaccctattagaacaatgcctataacacctaaccatgccgtatggggtgcactacttggtgcttgtgtgattcatgagaatgttgaactgggagaggtggctgctaggtggacttttgagcttgagcctgaaaatactggaaattatgttttgttggcaaaactttatgctactgtaggaaggtggggagatgcagagaagattagagatatggtaaatgaggtaggattaagaaaactacctgctcacagtttagttgaggtcagagatatgatattgccttttcctatggttgtctggttgttgttgatcccttatactggccacgcagctacttattctcccattttcttgcaagatggcaatgattgcatattgactatgagggaaagaaacagagcagaactaggtcggtactacctattcttatag

SEQ ID NO: 15088 - DNA, 1539 bp, Glycine max
  Peptide Sequence Number=SeqID_106773
atgtctgcgaaagatacaaatggacaatgccaactgcccaaggaagatggtaatggtgaaaatggggacagtcaaaagctcaacaagtatgcttgtgcttgtgtgacggctgccactattatctctgctatatttggttatgtaacgggagtgatggctggagcactcttattcataaaggaagaacttcagatcagtgacctacaagtggggctcttggcagggatcttaaatgtgtgcgcgctacctgcatgcatggttgcaggaagaacctctgattatctcggtcgccgttacaccatcattctagcttctgtcatcttcttattgggctcccttctaatgggctatggcccatcctattcaatcttaatcattggaagatgcattgttggaataggtgtaggttttgcattgatcatagcaccggtttacagtgcagaaatttcatccccttcctacagaggctttctcatttctctcccagacgtttccctcaactttggactcttgcttggctatgtctcaaactacttccttggaaaactgtctctgaaacttggatggagaaccatgttggttgttcctgcagttccttcacttgttcttgtcattctcatgttcaagttggtagagtctccaaggtggttaatcatgcaaggacgtgtaggtgaggcaaggaaagtgcttttattagtctctaatacaaaggaagaagctgaaaaacgcttgaaggaaataaaaggtgctgctgggattgatgaaaagtgcacagaagacattgtccatgttccaaagcaaattcgaagtggtgcaggagctcttaaggaactgttgtgtaaaccttcactaccagtgcgtaatatactagttgcagctattggagttcatgtgttccaacaggtttgtggaatagaaagtattttgctatatagtccaagggtgtttgagaaaacaggaatcatggacaagagcatgctccttctagccacggttggtatgggaattagccaagctgtgtttacattcatatctgctttcttgttggacagggttgggaggaggattctgttgctgattagtgcaggtggtgtggttgtgaccctcttaggattgggtttttgcatgaccatggtggaaaactccaaagaaaaacaattgtgggcaatgggttttaccattgtttttacctacatatttgtagcttttgtggctattggtattggacctgtgacgtgggtttatagctctgagatttttcccctcaggttgagagcacaaggtcttgccattggtgtgactgtgaatagaattgccaatgtcgtagtggttaccagtttcatttcaatttataaaaagataacattaggcggtactttctttatgtatgttggtatcactgcgttggcttggtggttctactactccttgcctgaaaccaaaggaaggtcattagaagatatggagacaatctttgggaaaaattccaagtcggagatacaagtgaagcctgagttatggatttcatgcatgaaataa

SEQ ID NO: 15089 - DNA, 1017 bp, Glycine max
  Peptide Sequence Number=SeqID_106774
atggacatccaaaccaacaatcatagcattccaacaactaacagtttttatcctctctccatgaaggagttgtgcttggaagtgagagtgaaggctagctttggtgataatggattgaacttatttcagttccaacatggaacaaagggatgtgaggaggtttggaagagtcttcagttttcgttagggacaaatgatcaaacacttgatgagcatttctgtatggaaatgtcacgagatggtgctgtgttggcatgtacagatggagcagttcttcccgtcagtcaagtgtttgatgcaattagagagcttgggaatggagggcttgagcaatgggatcctcttgttcttacttctgcctcactcttaagcaagttgcctgtggattcttcctctgttgattttgtgattttaatctggctgtcaatcgattgtcctgtggatcaactgattcaagaaattcttagagtgttaaaagtagatggtacaattcttattcgcaagtcatctcagtctgctgtgggttcatttgataagataatatcttctcttgagaacaagttattgttggcagggtttacagaaccacaagttttacaatcagctgggatcaaagctaaaaagccttcatggaaaattggttcgtcttttgcgctaaagaaggtgattaggagttcacctaaaatgcaaattgattttgattcagatctgattgatgaagatagtcttttgactgaagaagatttaaagaaaccccagcttccacctggtgattgtgaaattgggagcacaagaaaagcctgcaaaaattgcacctgtgggagggctgaagaggaggaaaaagtattgaagttaggattgacaacagaacagattgataatcctcaatcagcttgtggcaattgtgggctaggggatgctttcaggtgcagtacctgcccttacaagggactgcctgccttcaaattgggcgagaaggttgcactgtccggtaactttcttgctgcagacatataa

SEQ ID NO: 15090 - DNA, 519 bp, Glycine max
  Peptide Sequence Number=SeqID_106775
atgtgcgcttcctcatcaaggtggagagccttcatgtccaactccaaggttgaagcctctcaagtcaaggcacaggccaagaagtccttggctctagagcccgtggagaagtggcgccaaggctcacatttgggatggaggagggataggaatagggatacggaacattgcagcagcaaagaggaagagcagaggaaaacttggataatgaaggagcctcaaggctgggtgcccaatgctacaatggagctaatgctacttgtggtctcgctcaaggctcaggctcattgctcacatgccaaatcttcgcatggagccaaggacttttcagaggcttcaaccttggaatcagacatggaggctctccaccttgatggggaagcacacatggaaaggattcagaagcgttgcgaggagaaaattgtgtcatatcagcgcaagcatgactggactgtcgccgtgcttaagtttcttctctggacgttgaaaagaagccaaggttcaatacgattgccctaa

SEQ ID NO: 15091 - DNA, 1527 bp, Glycine max
  Peptide Sequence Number=SeqID_106776
atgtctgactcactcctaactttccattctctttcaaccattcttgctcttctcccaatcttcatcttcattctcatcaaaagaaagcaaagcaaacccaggctcaaccttcccccaggtaacatgggttggccatttcttggtgaaaccattggctatttgaagccttattctgccaccacaataggggaattcatggagcaacacatagcgaggtatggaacaatttacaagtcgaaactgtttggggagccagcaatagtgtcagcagatgcaggactcaacaggttcattctacagaacgaagggaaattgttcgagtgcagctatcccagaagcattggtggaatactaggaaaatggtccatgttggtcttagttggtgacatgcatagagacatgcgggttatatcgctaaactttctaagccacgccaggctcagaacacacctcttgaaagaggtggagaagcaatccctcttggttctaaacacttggaaccaaaattccacattctcagcccaagatgaagcaaagaagttcaccttcaatttgatggccaagcatatcatgagcatggatccaggggatatagagacagagcatctaaagaaggagtacgtcactttcatgaaaggggtggtatccgcgccattaaatttacctggaactgcataccgaaaggcattgaagtctaggtccattatactaaagttcatagaggggaaaatggaagagagagttagaagaatccaagaggggaatgagagtttggaggaagatgatcttctaaattgggttttgaagaattcaaatctttcaaccgagcaaattcttgacttgattctcagcttgctcttcgctggccatgaaacttcgtcggtagccatagctctagccatttacttcttacccggttgtcctcaagctatacaacagttaaaggaagaacacagagaaattgccagagccaaaaagcaagcaggggaagttgaactcacttgggatgactacaaacgaatggaatttactcattgtgttgtgaacgagacacttaggttgggaaatgttgtgaggtttctccacaggaaggctgtgaaagatgttaactataaaggttatgacattccatgtgggtggaaagtcctcccggtgattgcagccgtgcatctggatccttcactttttgaccaacctcaacacttcaatccatggagatggcagaaaaacgtaggacatgctagatatagatatgctagttttttggtgatggtaagaaatcattgtccggaatggcgaataatcaaaggatgtggcctacatgcacaatggaggatcaagtgggtccattcccatgcatctcaaacagtggcgagtgaaaatcttcatcgtttaagggtagtgacaagtttcacgaataggaaggtgataaggggtgaaagcgtggtggtaagagttggggtagtgccagccaccaagtatgtgtttgagaagcagttgaatttaaccttaatggactttcagtaa

SEQ ID NO: 15092 - DNA, 327 bp, Glycine max
  Peptide Sequence Number=SeqID_106777
atggaatttaacagaagcttcaggttgtcaaggtcacaccacatactgctttcatctgaatctgtgatttcggaatgtgccaaaatcgctggctatgagagactctcacaatcgttaaggctaagtggggaatatgatttcagtgataagcagaagaatcataaaaggagtactgtggggcttcttggtaaggttttctccttcagaagagtttccactcctcacggagagcctaataaggtggccgagacagtggtaaagaaggagaagaaacgctcctcttggcttcccgatccagatagacggtggccaattcagggatggtga

SEQ ID NO: 15093 - DNA, 918 bp, Glycine max
  Peptide Sequence Number=SeqID_106778
atgacgctgggtctgatcaatgcgaaccctgtggttcacgccaagaaagagcgaatcgctcgttccgatgatcctcacgccgacgacgccatccttgacttggctttgacaaatttcgtgagggatattcgggatcccgaacatccttattccttggaacagctcagtgttctctccgaggaatcaatcaccgttgatgacaaattaggccgaattctgataacttttacgccgaccgtacagcactgtagcatggccacggttattggtctttgtctcagagttaaactgaagcactacttccctcctcatttcaaatctcagcgaatttcctcccatcacaaggttccaatgtctttccctggaatcaaggattcacgtgtctctctgttagttcttatttgtggtgttcaatggattatggatctagattccttgcaggcagttgtggttgtcacggctataatagcgaacaaaatcacggctggaggtagtccattgggcattttgctccctcctttgaatcagaactggaacttcactttatctgttacttgtgtgcactctgttatgacttataaagaagcacctacttttccttatgaggaacacccagcagtttctggccagctcgtccctagctgcaacagtggccgcagtagcatactagctgtagctgaccaaatagcagtcatagcagacgagataatggcaatatatggtttcctggccgatgattatctgatccattattcaaatatctctttgcaggtggacatcaaggtttctcctggatctcatgccgacgaagaatcagtcaataagcagttaaatgataaagaaagagtcgctgctgccttggagaatcccaacctccgccagcttgtggatgagtgcctctactccaatgaactgtga

SEQ ID NO: 15094 - DNA, 699 bp, Glycine max
  Peptide Sequence Number=SeqID_106779
atgtcgaaataccagtcagcacctgcagtccacgttgtcgttaatgcaaatggagggatatatatagttagttcgagagagagagagagaatcaaaagagcccacgtgaccagcgggaacagtcttccatggatctgccttttccgatcacgaggttttagtgtctcaaacccaatatccgtatctctgcctctctgcctctgccactgccaccctcccaaggaaaatggaatagtttcccactccctcttactctcacgctccttttccttccctcctcaaccacgctctaatcccaatattactaaccatacactactctatactgggaagatatattttcaacagaacaatgaccactcctccaatgactcccactccgttagtcgttatagggcgtccaatccatcaaatctgcagccaacaacaacaacagccacaacaagcagttttttggctgccgtaccgtgcgaatcacgtgaatccaaaacaaaagccaagctcgtcatcatagtaacctcatgccccgaatccacacccattgcttttgcttatgccacaacagtagaagttgtagtggtcgaagagaagatccctcatattttgattgatttttggatcaccaccaaagggggagagagaaagctattcaaatggatactcagcaatcatcaaagcaaagcaatcttgctaagctaa

SEQ ID NO: 15095 - DNA, 1194 bp, Glycine max
  Peptide Sequence Number=SeqID_106780
atgccgacttttactgccatggcactggataggttgatagagccgggagcttctaagccagctgataaatctgctccaacttcaatgcctgtgccaaactcgcagaagctggagaggggtactagtgcgcccaccaagaaaagtaaggttcatcagcctccattgaaggcggcactttgtatcactcctgaagtgacaccacttccagatgcgccttcttcgttccctccttcaccatacatcatcaaccacaaatgccgtggtccacacctcctcaagagttcctctgaggcaaatgcactgtctgaggtgaatatttgttgtgatgaaaatgataatgacaagagcttagatgctgttgatacaagtacagctggtgacctccaagttacttctacaaagcctgaacttgttaaagaggagaaggtaaatggtgtttatgaaggccaatttgattggagcaatgatgttgacctgcaaatggacacagagaaactggaagtggttgaagagaatgcagcgacagaattgtctatgaaattcagcagtcctggtacagagttttatgatgcctgggaagaattatcttctgaaggcatgtctcaaaattctacatacaatattgaagctgaattatgtgaaataaggttaagtctgttggtggaggtagagaagcggaagcaagctgaagaatccatcaacaacatgagaagccaatgggaaagtattaggccagggttatatcaagcaggaattgtttttcctgcatatcttactgccgctgttgaggatgagcagctgatttctgatcccgtggaagatctatgtcaacaagtttatattgctaggttcatatcaaataccattggaaaaggaattgccagggcagagttggatacagagatggaagctcaactagaggcaaagaactttgagattgctcgacttttggaacgtctccactgttatgacaccatgaataaggagatgtctcagaggaaccaggaagcagtagagatggcaccgcgtgagaggcaaaggagcagcaggaggcagagatggatttggggctccatcacaactgtaattgctcttagtactgcagcactagcatggtcttatctcccaacgggtaaaggatcatcctctgctgacaatgatctagttcctgaacatgatgacccagccaagtag

SEQ ID NO: 15096 - DNA, 1305 bp, Glycine max
  Peptide Sequence Number=SeqID_106781
atgaagcattttgccttggtgtttcttttggccattttggtccctcaggagtgtttccatgtcagtgtggaagcaagggatgatttcgtcagaaccagaggcatccacttcatgcagaatggatacccttactatgcaaatggcttcaatgcctactggttaatgtacacagcttctgacccatctcagagattcaaggtttcaaatgccttcagagaagcagcaagccacggccttactgttgctagaacttgggccttcagtgatggtggctatagaccactacaatatttccctggcttctataatgaacaaatgttcacggggttagattttgttgtatctgaggccaggaagtacgggattaagctcatactgagcttggtgaacaactatgaaaattttggaggcaagaagcagtatgtgaactgggctaggagtcacggccagtaccttacttcagatgatgatttctttaggagccctgttgttaagggttattacatgaaccatgtgagggttctgatttatgtgcatcttccacagactgttctcaacagatataacagatttactggcatgcattacaaagatgacccaacaatcatggcctgggagcttatgaatgaacctaggtgcacatcggatccttcagggagaactattcaggcgtggatcacggaaatggcttcgtttgttaagtccatagacaggaaccacttattggaggctggactagaagggttttacggacaatcaacaccacaaagaaagagattgaatcccggtttcgacataggaacagacttcatcggaaacaatcgaataccggccattgattttgcaacagtccactgctaccccgaccaatgggtatcgagctcaaatattcagtatcaactttcattcttgaacaactggctgagtgcgcacttcatagacgcgcaataccgtataaagaaaccaatactagtggcggaatttgggaaatcatttaagagttcgagttcgtacgagagggatgaggtgttcaattcagtgtattacaaaatatatgcttctgctaagagaggaggggcagcgagtggagcattgttctggcagcttctgacggagggtatggagtctttccaagatggttacggaataattcttgggcagagttcctctacggccaatctcattgctcgccagtcccgcaagctgtacctgattcggaagatcttcgcgagggtcgcgaacatgcggcgatggcaaagggccagagctagaggtggaaacggaggcagatacattggcaactga

SEQ ID NO: 15097 - DNA, 552 bp, Glycine max
  Peptide Sequence Number=SeqID_106782
atgataatgcaagttgcaacaaatatcagccggcaaaaccaacataaaaagaaacctcgtgtaaggattacatgcaccaacaaaacaaaagacaaatattcttcaagttttgctggggaaggtaaacagaaccaggtgagtgattatttctccatggttaagaagacagtcttgaaggttgatatcagttgtctcaaatgcaaaaggaagctcctcaaaatcgtctcttcaattcaaggggtggataaaattgaagctgatgaagggaagggcacgttgaccgtgacaggggatgcagacccatatgaaataatagttcgcataaggaaagctggcaaacatgctgaagttgtgagtgttgggcctccccaggcccctcaaaaaaaggatgagaagaagcccgaagaaaagaagaagcccgaggcagagaagaaagatgaaaaacctaaggagtccagtatccacatgccatattactatcctccttaccaaccagtagtgctgtacatgaacagatacgaggagcccaatccatcttgcactatattgtga

SEQ ID NO: 15098 - DNA, 2118 bp, Glycine max
  Peptide Sequence Number=SeqID_106783
atgccttccccatcctcaattttctcagcctacgcctccatgacagcttccatcatgcttctgcgttccatggccaacgaactcgttccccaacccattcgcggctacctttacaacacgttcggttacctcataaggcctcgttcccaaaccctcaccctcatcatcgaagagtccaccggcatagcccgtaaccaagtctacgactccgcggaggcctacctctccacacgtgtcagccccgaaaacgagagactcaagatcagcaagagcgcaaaagagaagaaactaaccgttcggttggagaagggcgagaaggtagtcgactgcttcaacggcgcgtgcttcaaatggagattcatctgcgctgagtccgagaagaacaaccccaacgatcatagcaacaacagcatctccgtacggtccgaaaaacggtcttttgagctgagcttcccgaagaagtacaaggaaatggttttggactcttacctgcccttcattctcgacaaggccagggagatgaaggacgaggaaagggtcttaaagatgcacactctcaacacctcctactgttacagtggagtcaaatgggactccattaatctggagcatccctcaacttttgagacgctggcgatggagccggagctgaagaatgcggtgatagaggacttggataggttcgtgaagaggaaggagttttataagagggttgggagggcgtggaaacgtggctacttgctgtatgggcctcctggtactggaaaatctagcttgatcgctgctatggcgaattacttgaagtttgacgtctttgacctcgaacttgggagcatagtgagagattctgacctcaggaagctgcttctggcgactgcgaataggtccattttggtcattgaagacattgattgcagtgtggatctgccagagcgtcggcatggggatcatggacgtaaacaagctgacgtgcaggctcaccgtgcatctgatggacggatgcagttgaccttgtctggattactgaacttcatagatgggctatggtctagttgtggagacgagagaatcatcatattcaccaccaaccacaaggagaggctagacccagcactgttgaggccaggaagaatggacatgcacattcacatgtcctattgctcctaccaaggcttcaagattttggcctcaaactacttagaaacttcctctgaccaccccctctttggagaggtagaggggctaatagaggacatacagataacccctgcgcaagtggcagaggaactgatgaagaacgaagaccctgaggccacacttgaaggattcgtgaagctacttaagaggaagaagatggaaggtgatgtgtgtgaaaactctactcctgataaagcagaacctactcgtcagcaatctaaaaggcgcaaggttggttgcaagcaaaaacgaggcaagagtaatagtgacacactgggcttgaatgttgagttgaagcaagtcatcgttgatgatttggaacgcttcttgaggaggaaggaactttacaagaaagtgggcaatccttggaaacgtgcctctccgaacaggaaaatcaagcctcctagcagcaatgaactcttcgtagccgcccaggagtacctttccgccaagattacaagattactcaacacgtgtttggataagagaattaatttcaaattcttagacactcgcgtcgtggactgtcttcgcagtcaagaaccaacgcggcaagatctacgacctcacgcatctggcggccagcactgcgaggtgccgcaccacggcagggtccggcggagggccaattcggcagtggcaggttccggcaaagtcactggtcttaatcaacagcatcgccctgtccaccacagacaaaggactaaaccgatgaggttgacgaggcaggggctggggatttgggagagaatcttgatctcgtttttggcggggactggtgcagttgccgcagtgggtgcatttggtggcgtggtttttagaggtgctggtgacgacaagtttggtcgttctgacagcggcgaggagcttgtcgacgtccagggtgactctttagactctgtcgtggctgcctctgcctag

SEQ ID NO: 15099 - DNA, 3138 bp, Glycine max
  Peptide Sequence Number=SeqID_106784
atgggattctacacacagaaccttttttcttctttcacctcagcttcatcatggttcgaggtgtacgctgccttctccacattcacgatgctcctcagaacagcattcattcaactcattccccagcaattccgatccttcattgtctcaaagctagagtccttcttctccaaataccaagcaaatagcgaaatccgtctaaaaattaacaaattttgggacaaaaattcgggagaccgcaatgaacttttcgatgctgcccaggagtacctccccaccaggattattcacacctacaagtcgctcaaagttggcaaactacaaggcgagaagcacattgagctcgcagtgtatggaagtgaagatgtggtggacgaatttgaaggcaccaaattcacttggaagctggatgaagaagggtccaaacaggactctaataatcacaacaagaagtatagctttgaattaaccttcaatgagaagcatagagagaaagcattggatctgtatattccacatgtgattaaaacatatgaggtcatgaaagctgagaggaggattgtaaggatctattcttggttagatgatgattggaacgatagcgagttatcacatcctgccacattcgactcactggccttgagtcccgagttgaagaaagatatcattgatgatttggaacggttcctgaggaggaaggagcattacaagaaagtggggaagccttggaaacgtggctacttgttgtatggacctcctggaactggaaaatcaagccttattgcggcgatggcgaactacttgaaattcgatgtgtatgatttggagcttacttctgtttattctaactcggacctcatgcaatccatgaaggaagcatctaaccgttccatcgttgtgattgaagatattgactgcaatgaagagctgcacgctagatcaattggtctttcagatgatcaagattcagacgctgacaatgaggctgccaaggttaagacaagtaggtttagtctgtcgggtctgcttaactacatggatggtttgtggtcaagcggaggagaggagcggattataatattcacaaccaaccacaaagaaaaaatagaccctgctttgttgcgcccgggtcgtatggacatgtacattcacttgtcctacctaaaaggcaaggcatttcgagtcttggcttccaattatttggatattgaaggagatcatccactctttgaagaaattgatgagctattggagaaattacaagtcacccctgcagtagtagcagagcaactgatgagaaatgaggatcctgatgatgctttggaagcccttgttacatttctcaaagaaatggacaaggatagtaattgtgacttagagctaagagggactatgcttgattcgttgtcttcaaatcctgcaaggccagaggaagcaatcaactcaaacgacaccatgtctggaactatgtctccaaaaggttctttcaagaagaaagcaatcaatgcctcaaacatgctgaggaattctttgaccaggaagggtaggcgaagcagtaaggtcatgtccgttgaaatcgaggatgtccacgatgctgaggagttgaaaattgttgacgagttccgtcaagctcttattttggacgaacttcttcctgcaaaacacgatgattatcatatgatgcttagattcctgaaggctaggaaatttgatatcgagaaaacaaagcaaatgtggtctgaaatgctcaaatggaggaaggaatttggtgctgacaccatcacggaggacttcgaattcaaagaacttgatgaagtcttgcaatattatccccaaggccatcatggagtggacaaagatggaagacctgtgtacatagagagattaggccaagtcgatgccacgaagatgatgcaagtcacaaccatggatcgctacatcaaataccacgtaaaggagtttgagaggacatttgatgttaagtttgcagcttgttcaattgctgcaaagaagcacatagatcaaagtacaactatcctggacgtgcagggagtggggcttaaaagcttcagcaaacatgctagggaacttgttactcgccttcagaagattgacggtgacaactatccagagaccttgaatcgcatgttcatcatcaatgcaggttctggatttaggatactgtggaacaccgtaaaatcattccttgatcctaagaccacggcaaaaatcaatgttcttggcaacaagtatgacaccaaattgctagaaataattgatgcaagtgagttgcctgaatttttaggaggcacttgtacatgtgctgatcaaggaggctgtatgcgctctgataagggcccatggaaggatgcagaagtaatgaggatggttcagaatggtgatcacaaatgttcaaaaaaaagtgcctcacaaggcgaggaagagaaagaaaattctgaggaacacaagacttccaaattggaggcaaatcacaccccccagctttctccagttgttgaagaagaggtccctgctactaaaacttcccagcccttatcaccgatggctgataaatctgctgtgaaaaaagttgatgagaaagcttccaagcctaaggacttagcccctacagctgataaaactgcagcatcaactgtctgtgctcaatggcttctgatcaatttgcctgcaactgccttctctcgtgcagagttttcgactgtgatgaaacgcatggctgagttggaggagaaaatcgtcaccatcaataataagcccactgctatgccacctgagaaggagcaaatgctgaatgcaactataactcgagccgatgacttggagaaacaacttttggctaccaagaaggctctggaggattcacttgttaagcaagaagagctttcggcttatcttgacaaaaagaagaagaagaagaagaagagatttgtatgtatcccaagcaaatccgtggatgcccaaacaagaggtccagatattaacgggaaattagcttttagtttctgcctttcaggagacttcccaaatgccccccttacatcaatgttcaacatgcgaactagtaaatattcaaaacgatcagaagagaagcatttgctcaaaatatatgaattatga

SEQ ID NO: 15100 - DNA, 1428 bp, Glycine max
  Peptide Sequence Number=SeqID_106785
atgagaacttctttggggagtttttcttcacccttcacaagcttccgttccgcctcatcatggttcgaggtgtacgccgctttctccacattcatgatgcttctgagaaccgcgatcaacgatctcataccccaccaagttcgcaccttcatagtcacaaagataaaggctttgttctcagatcgccaaaatattaaccaggtctcactccagatcaacgagatttgggatggccaaatcaaccagctcttccaagccgcccaagagtatctccctgctcaaatatcccactcttacaagtccctcaaagttggaaagctcccaaagcacaagaacattgcggtggcagtggatggaacacaagaggtcgtggatcttttccaaggcatcaagctcagctggaagctcgttgagaaaagccccaaaagcgattctgatcaccgcgatcatcatcctaagtctagcggtgttggttacgagaggaagtcatttactctaagctttgatgagaagcatagagatgtagtaatgaacaagtacattaaccacgttctaagcacttaccaggacatgcagacagagcagaaaaccatcaagatccattccattggtggaaggtgttggcagaagagtgacttaactcatccagcttcctttgactcgcttgcattggaacctgagcagaaacaagccattattgatgatttgaatcggtttttgcgacggaaggagctttacaagaaggtggggaagccttggaaacgtggctacctcctttatgggcctcccgggacaggaaaatctagccttattgctgctatagccaactacttgaagtttgatgtgtatgatttggagctaagctctatgttttctaactcggaactcatgcgagtcatgagggaaacaaccaaccgctccatcatcgtcatcgaagacatagactgcaacaaagaggtgcatgctcgaccaacaacgaaacctttttcagattcagattcagacttcgaccgcaagcgtgttaaggttaagccttacaggtttactctgtcgggtctgcttaacaacatggatggtttgtggtcaagtggtggagaggagcgaattataatattcactactaaccacagagagagaattgaccctgcattgctgcgccctggtcgtatggacatgcacattcacttgtccttcctcaaaggcaaggcctttcgagtcttggcttccaattatttaggaattgaagatcattcactttttgaagaaattgatggactattggagaaattagaagtcacccctgcagtagtagcagagcaactgatgagaaatgaggatcctgaagttgctttggaaggacttgttgaatttctcaaagaaaaggacaaagaaagcctacttagatttatgaatgagactgcagactaa

SEQ ID NO: 15101 - DNA, 126 bp, Glycine max
  Peptide Sequence Number=SeqID_106786
atggaacaaaggattcaagttcacaattacttctcaattcacaagcggccgcaccctctgagaaagggacactggcgttgtgggaaggataaaggtattcagtttgttgttatgtctccgatataa

SEQ ID NO: 15102 - DNA, 3564 bp, Glycine max
  Peptide Sequence Number=SeqID_106787
atggaaccgcagcttcagcccaagctggaccccgcgccggaggttgttagcggtggcggtggggattcggagaagtcgcatgtcagtgatgtcaccgaggttcgcgacgttgacatggcgcaggcaaacggcgcttgttgcccttccgttttgaaacggaagcgcggtcgcccggccaagggaaaccgcgttccgaaagggattataccgccgtcgaggcagaaacaggaagaagaggatgtttgcttcatatgcttcgacggtggaagcctcgttctctgtgatcgccgtgagggggatgccctaaagcgtatcatccctcgtgtattaagcgagacgaggccttttttcgctcaaaggccaaatggaattgcgggatgtacaaaaaaggctgattttgtctctatcagagaaaataaaggtttatgtggaatgtgcaagaagactataatgcttatagagaattgtgcccagggtgacaaggcagcggtggattttgatgacaagagcagctgggagtatcttttcaaggtgtactggacgtatttgaaggagaagctatctttgacatttgatgagatccttcaagctaaaaatccgtacaaaggagttgcaagattagaagcatctggtgttgcggtggatgtttcatcattacttctgtctccaaagatggagctgccaatcaacaattttgtgaatgataaaccgtggcattatcaggatccaacagggaaggttcaaggacctttctctttattgcagctgtataagtgggatgcatttggatattttcctccagatctcagaatatggagtgtagatgagacacaggataactctatattcttaactgatgtgctgagtgggaagtgtacaaataatgtgtcgctgccaaacaacagccaacagctgtctttgggaaccaatagtacattggaaaataaagataatggtcaggatggtggtgagaatgagaacaatctgtctaggaatgaaaattctgcaaaccatcaaattgttgagcgctgtgaggagcaaaaagtgtctgatacttgtacacaatctaatggtaaagatgaatctgttaggagcaatggttggaactctcagtctccaggtttgactatacaagcagatgggaataacaatgaggggcaaagtggaaattctgaaaggagggaggagtcccccaaatgtgaaatttcttgtcatgatgtcccccatgtatacgcttcactgccttcaactgtattttcagagaaactgaatgagaatccttctgataaattaacagaagttcataagattgaagtaaagtctgaagataatggaaattttgacttgaacaaaatttctgagggtcgaagtaacagtgggcaaagttgtcagaaacaatcagacagtgaggagaattcagggctatcttctggtcagaattggagatgccctgatgtaaccaatccagtgtgtaacatatctacatggctatcaatctttggtgaaccaaatgatttggatgagtcagtttcagatctgctggctgaagtggaggcaatggagtcacttgggggcttggaatctcccacttctatcatgaaatgtggtgaggagttgactgacggttctataactgattgtcttagttttgcagatgcgcttagcccaatgcttgacgcaggtaagggtgatgcactaagctcctcaggtgatttacacttaccatctcaaaccacaacaccagatgacccattaaagcaagcagatgtacatcatcatcctcaaaaaatatctggggagcattcaacaaagagttcagaagttgagactcacatcagggatcttttggaagtaatatggatgagattccaactgaggaaagtgacagtgctctacgagcttctctctgcttgtctatcagatttaggtgaaaataacaagaaatttagccggaggagaaagggctatgatgctcaacaacgtgtcactctgcggctgctagcaacttggctcgatatcaagtgggcaaaaatggttgagcaagaggcaagtaaagaagaaattcaatcaaatgaagacaagtgggctaaatggaagaggggtggtatcattggtgctcctgccttaacagggggaactttgatggctattactggtggattagctgccccagcaattgctgcagggcttggtgctttggctccaaccttgggtactctgattcctgtaattggagcaaatgaatttgctgcagctgctagtgctgctggaactgttgctggttctgttgccgttgctgcatcatttggagctgctggagctggactcagtggaagcaaaatggctaggagagttggggatgttgacgagtttgaactcaaagctgtaggcaaaaaccataaccaaggtaggcttgggattatgatcatggtctctggatttgtctttgaggatgacgattttataaggccgtgggaagtactggatgacaacttggagaggtatgcactgcagtgggagtccaagaatctattttccctgagcactgcaattcaggattggctttcttcaagaattgcaacggagctgatgaagcaaggggcgacgatgacggtcttgcatgctcttttaactgcattggcttggccagctgcattacttgctgcaactgaattcatagacagcacatggacaattgctatcgacagggcgagccctggtgcagcggtaaagttgtgccttggtgacttgttggtcatgggttcgaatccggaaacagcctctttgcatatgcaaggatcagacaaggcaggaaagttgcttgctgaagtattattgggaggattgcagggaaatcggcctgtcacacttgtaggtagtatagagtttttagctgaaacagaaaacagtgctgaactggtcgagagagttgttcttcttggattacccattgcaatcaaggatgagaattgggaagctgctagaaagatggtagcaggaagatttgtaaatgcttattcaagaaatgactggatgcttggagttgcttgctttccgtgccagtgcagacctttcgcaccgcttccattctttctccctcccaatttcacttgtaggccaaacgcagcgtttcggcagcatgatacgcggaggcgaaaactacgtttcttccgctccggcgttctcgaacgacgcaagcgccttctcgtttgcagcggctccaccgtgtccatcttcagcaccgccaccggctccctcgtttcctcgctcgaaggccacaccgccgtcgtggtggtcccctcctccactggcctaagctactgctggaccgcttccgtcgacggaaccatctgccactgggacttctccgttcccgaatgcgtcaagattatcgatctttgcttacccatcttctctatgacggcgaatgttattgcttacgtgtctgttcaagatataaacgcaccggacaatcaccccaagcctctttatggacagatcaggaagtgtaattttgttctttcttttggcacagtggtggggtatgaggaagatgaagcgtga

SEQ ID NO: 15103 - DNA, 1074 bp, Glycine max
  Peptide Sequence Number=SeqID_106788
atggagtcatgtgtcccaccagggtttcggttccacccaacagatgaagagcttgttggttattatctcaggaagaaagtcgcttctcagaaaattgaccttgatgttatcagagagatcgatctatatcgtattgaaccatgggatctccaagagagatgcaggatagggtatgaagagcagaatgagtggtatttcttcagccacaaagataaaaagtatccaacagggacaagaactaatagagctaccatggctgggttttggaaggcgacaggaagagacaaagcagtgtatgaaagagcaaaacttattgggatgaggaagacccttgttttctacaaaggaagagcccctaatggacagaaaagtgattggatcatgcacgagtataggcttgaatctgatgagaatggacctccacaggcaagcatattggttcagtttgaagtgttacgttcaaactttgctttagatggccgcccagccttcaagaagaaaaccactgggcaaacgaagactataaatattgaaggatgggagtcaagctacttctatgacgaagcaagtggggcaacaagcactttggtcgatccaattgaactcatttcaaggcaatctcagagctttctggctcaaaatttcatgtgcaagcaagagctagaagcagataacttgacttgcatgcatcaagatccgtttgtgcaacttcctcagctagaaagcccgtctttgccactagtaaagaagccaagcacagtgtccctagtatcagacaataataacgaaggtgaagacaatcaaaacaggttgttattcaacaacaacaacacaaagaaagtcactactgattggagagcccttgacaagtttgtagcctctcaactaagtcaagaagtaaacacgcatgaaactaatgttggagtactctcatcaagctttgaaccccatgatgataaccacgacatggcactgctgctactgcagagtagtagggatgaagggaacaggttaagcccgtttctaaatacaagctccgactgtgacaatgggatatgcgtattcgaaaaatga

SEQ ID NO: 15104 - DNA, 9804 bp, Glycine max
  Peptide Sequence Number=SeqID_106789
atgaagaccatcatatggagcatcacccatgcacattccccaagacctcaggctcttgtctcaccgtcttctaatttatcaccacctcaaggagtgaggggcatgagagaagatgaggtttgcaaagcttctggtgttttaaaaagtggtgttcattgcttagcacttttcaaggagaaagatgaggagagggagatgctgcatctcttctcacagattttggccatcatggaacctcgagatcttatggacatgttctctctgtgtatgcctgagctttttgagtgcatgatctccaacactcaacttgttcatatattctctacccttctagcagcacagaaagtgtaccggccattcgcagatgtgcttgttaattttcttgtgagcagcaaacttgatgtcttgaagcaaccagattcacctgcagcaaaactggttttgcatctctttcggtttatatttggtgccgtggctaaagcaccatctgattttgaacgaattttgcagcctcatgcgcctgtaataatggaattttgcatgaaaaatgctactgaagttgaaagacctcttggctacatgcagttgcttcgtacaatgttcaaggcactttcagggtgtaaatatgaacttttgctccgggatttggtccccatgttgcagccctgccttaatatgctgctggctatgttggaagggccaactgctgaagatatgcgagaccttttattggagctatgcttaaccttacctgcccgtttgagctctctgttaccatacctttctcgtcttatgaaacctttggtattatgtcttacgggaagtgacgaattagtgagtcttggtttacgaacacttgagttttgggttgatagtttaaatcccgatttcctcgaacccattatggctagtgtaatgtctgaggtgattcttgctttgtggtctcacttaagaccagctccctatccctggggtgcaaaagcgttgcagcttcttggcaagttaggaggccgaaacagacgattcctcaaagagcctctagcacttgagtgtaaggagaatcctgagcatgggcttcgcctgattttgacatttgagcctgcaaccccattcttggtgccacttgatcgatgcataaatcttgctgtggaagctgtaatgaacaaaaattgtggcatggatgctttctatcggaagcaagctctaaaattccttcgagtttgcctatcatctcagctcaatttgcctggaaatgttgctgatgaggggagtacgtctaagcagctatctgcattgttagtttctacagttgatcaatcatcacgcaggtctgagttaatggaagtcaaggctgacttaggtgtaaagacaaagacccagcttatggctgagaagtctgttttcaagattcttttgatgactgtcattgctgccaatggtggggcagatctcacagatcccacagatgattttgttgtcaatatatgtcgccattttgcagtgatatttcacattgattcttcatccagcaatgtatcagcagctgcacttgggggttcatcactctcaaatagtgttcatgttggttctaggcttaaaagcaatgcttgttcaaatttgaaggagctggaccctctaatattcttggatgctttagttgatgtactagcagatgaaaacaggctccatgccaaagctgctcttggtgctttaaatgtgtttgcagaaacacttgtattcctagctcgttcaaaacatactgacttcataatgtccagagggccaggtacacctatgattgtctctagtccatcaatgaatcctgtatattctccaccccctagtgtccgcgttcctgtatttgaacaactgttgccccgtcttctgcattgttgctatgggcttacatggcaagcacagatgggtggtatcatgggacttggtgctttggttggaaaggtcactgttgagactctttgcctttttcaagtaagaattgtgcgtggtctaatatatgtccttaaaaagcttcccatatatgctagcaaggagcaggaggagacaagtcaagtgctcactcaagttcttcgggtggtaaataatgctgatgaagctaatagtgaggcacgtaaacagagcttccaaggagtggttgattttcttgctcaagagttgttcaaccagaatgcatctatcattgtgagaaagaatgtacaatcatgcttggcacttttagctagcaggactggcagtgaggtgtcagaattactagagccgttgtatcagccttttctccagcctcttattgtgcgatcactcaagttaaagactgttgatcagcaggttggaacagttacagcattgaatttttgtctagcattgaggccacctcttctcaagttgactccagagttagttaacttcctgcaagaagcgttgcaaatagcagaatctgatgacaatgcgtgggttgctaagtttatcaaccccaaagtgatgacatcgttaactaaacttcgaacagcttgcattgagcttctttgtacaacaatggcatgggctgattttaagactccaaatcactctgagttgcgtgccaagattatttcaatgtttttcaagtctttaacctgtcggactcctgaaattgttgctgttgcaaaggagggcctgcgacagcatctaaagaggtggctggagcctgaaaagttggctcagagtcagaagtcatggaaggctggtgaagaaccaaagattgctgcagctataattgagctttttcacttgcttcctcctgctgcctcaaagttccttgatgaacttgtaaccttgactattgacttggaaggagctcttcccccaggacaaccattaagagatgaacttgcaaaatcaccgcaaaagatacttgcaagtgcattctctgaatttccgatcaaatctgatgtgacagtggctcctgcatccacaagtacacctagtttattaggcgaagaaagtgttgttgctccatcaactgatgcttctaatccacctgctcctcctcccaatgcaacatccgatgcttactttcaggggctagcacttataaaaaccctggtcaaattaatccctgtcacctgcaagaatatcccgattgcaaaaagaacaggagctgaacctagtgcaagtatgggctctggattctcaactgttggagtccagctgttcactgacatcttcgcattgctgatgctggttaaagaaagcaaatggcttgtcaaatgcttccttaattacttgagacatgacaaaaacgaagtgaatgttctctttgatatacttaccatattcttatttcatagtcggattgactatacattcctgaaggagttttacattattgaggtggcagaaggttatccaccaagcatgaaaaaggctcttctattgcattttctcagccttttccaatcaaaacaacttgatcatgaccatttggtgattgtgatgcaaatgctcattcttccaatgcttgcacatgcctttcaaaatggtcaaagttgggaagttgttgatccttctataataaaaacaattgttgataaacttctcgatcctccggaggaggtttctgccgagtatgatgagcctttaagaatagaactattgcagcttgccactttgcttcttaaatatcttcaaaatgatcttgtccatcataggaaggaactgataaagtttgggtggaatcatcttaagcgtgaagacactgcaagcaaacaatgggcatttgtgaatgtttgccatttcttggaggcatatcaagccccagaaaaaataatactccaggctcttgacattctaatgccagcactgcctcgacgtttgccccttggtgattctcggatgccaatatggataagatataccaagaaaatccttgttgaagaaggtcattcaattccgaatcttattcacatattccaactaattgtccgccattccgatctcttctacagctgcagagcacagtttgttcctcagatggtgaattctcttagtcgcctaggattgccttataataccacagcagagaacagacgtcttgccattgaacttgctggattagttgttaactgggagaggcaaaggcaaaatgagatgaaagttgttactgattctgatgcacctagccaaatcaatgatgtctttaatcctagctcagctgattctaagcgatctgtcgatgggtctacatttccagaagatgcaagtaagcgagtaaagccagagcctggtctgcaatccctatgtggtgtcatgtcacctggtggtccttcatcaatcactaacattgaaacccctggatctgccagtcaacctgatgaagaatttaaaccaaatgctgcaatggaggaaatgattattaattttcttatcagagtgaggcttacttctaacctgtctagagatgacaagtatgatgctgaggcaaaagttgcgctagtcatagagccaaaggacaaagaagcaagtgccatgtacaaacaagctttggagctactttcacaagctttggaagtgtggccgaatgcaaatgtaaaatttaattatttggaaaaacttctgagcagtatacagccatctcaagcaaaggatccatccactgcactggcacagggtttagatgtcatgaacaaagttttagagaaacaacctcacttgtttataagaaataacattaaccagatttctcaaattcttgaaccatgtttcaagcataaacttttagatgctggcaaatctttttgctcactattgaagatgatttttgttgcttttcctcaagaagcaactaccacacctgctgatgttaagttgttgcaccagaagcttgatgatttgatacagaagcatgttaccactgtcacagctcctcaaacgtctagtgatgataataatgctagttcaattagtttcctattgcttgtcataaaaaccttgacagagcggctgcaacgtgatatgggttcatcggcaggctctcattcaagacaaggtcagagaacagatccagattcagcggtcacgtcttctcgtcaaggtgctgatgttggagcagttatttcaaatctaaaatcaattttgaaacttatcactgatagagtgatggttgtttccgagtgcaagcgatctgtatctcaaatattgaatgctttactctcagagagaggaattgatgctagtgtacttctttgcatacttgatgtggttaaagggtggattgaagatgacttctgtaaacaaggaacttcagtcacaccaagttcttttctcactcctaaggagatagtttcttttcttcataagctgtcacaagtagataaacaaaacttcacacctgtggctctcaatgagtgggacaggaaatatcttgaacttctttatgggatttgtgcagattcaaataaatatcctttacccttgcgtcaagaggtttttcagaaggtggaaaggctatttatgcttggtttacgagccagagatcctgaagttaggatgaaattcttctctctctatcatgagtctctcaggaaaacactttttaccagacttcaatttattatccaaattcaagactggggggctttgagtgatgttttctggctcaaacaaggccttgatcttctcctggcaatattagttgaggataagcctattacactagctccaaattctgccagggttcaaccacttttagtttcaagttctattctggaattatctgggatgccacacaaggtaaatgatgtatctgaaggatctgaggatgctccactaacgtttgagacccttgtgcttaagcatgcccagtttcttaacagcatgagcaaactccaggtggctgatctattaattccattgagagagttagcccatacagatgctaatgttgcataccatttgtgggtattggtatttccaattgtctgggttacattgcttaaagaagaacaagtaacacttgctaaaccaatgattaatcttttgtctaaagattaccataagaggcagcaagccagcagaccaaatgttgtgcaagctctattagaaggtcttcagttgagccatcctcaacccagaatgccaagtgagcttattaaatatattgggaaaacttataatgcatggcacattgcactggctttgctggaaagtcatgttatgttgtttccaaatgattccaaatgctccgagtctctggctgagctctatcgtttgctcaatgaagaggatatgagatgtgggttgtggaagaagagatcagtcactgcagaaacccgggctgggctttctcttgttcagcatggttactggcaccgtgcccaaagcctcttctatcaagccatggtgaaggcaactcaaggaacatataataatactgtacccaaggctgagatgtgtctatgggaagagcaatggttatattgtgctagtcaacttagtcaatgggatgcactagctgactttggcaagagtgttgagaactatgaaattctgcttgacagtctttggaaactgcctgactggacgtatatgaaggagcatgtcattcccaaggctcaagtggaagaaactccaaagcttcgtctaattcaagcatactttgctcttcatgataaaaatacaaatggtgtgggggatgctgagaatatggtaggtaaaggtgttgatcttgctctagaacaatggtggcagctgcctgaaatgtctgttcattccagaattcctcttctgcagcaattccaacaaatagttgaagttcaagagtcagctaggattctaatggatatttccaatggaaataaactctctggaaattcggtggttggtgtgcaaggaaacctttatgctgatctcaaggacatccttgagacgtggagactaagaactccaaatgaatgggataatatgtctgtttggtatgatttgctgcagtggaggaatgaaatgtacaactctgtcatagacgctttcaaagattttggcaccacaaattcagcacttcatcatcttggttaccgtgacaaagcatggactgtcaacaggcttgctcacattgctcgtaagcaaagcctttttgatgtttgtgtcaccatacttgaaaaattatatggccattcaaccatggaagtgcaggaagcatttgttaagataactgaacaggcaaaggcatacctagaaaataagggagaacttacaaatggtattaatctgatcaacagcacaaatctagagtattttcctgcaaagcacaaggctgaaattttccgtctgaaaggggatttcttgttaaaattgaatgattctgagtctgctaatcttaactattcaaatgccattagtcttttcaaaaacttgcctaaaggatggataagctggggaaactactgcgatatggcttacagagaaactcaggatgagatttggttggaatatgctgtcagctgcttattgcaaggtataaaatttggtgtgtccaattcaagaagccatcttgctcgtgtgctttatcttcttagctttgatactcctaatgagcctgttggaaggtcatttgataagtactatgaacaagtaccacattgggtttggctttcttggattccacagctcttactctccctgcagagaacagaagctcctcactgtaaacttgttcttctgaagattgcaacattgtatcctcaggctctgtattattggttgcgcacatacttactggaacgacgtgatgttgccaataaatctgaacttggtagaatagcaatggctcaacaaagaactcaacaaagtatttctggtactagtgttggttctcttggtgggttgactgatggaaatgcaagagtacaaggtcaagctggcagtaacttgccatctgatattcaagctcaccaaggctcccagccggcaggtggaattggatctcatgatggtggaaactcacatgggcaagaacccgaaaggtctacaagtgcagaaagcagcatgcacaacggaaatgaccaacctttgcagcaaggttctggaaatgaaggtggtcaaaatactttaagacgtcctggtgctttaggatttgtggcttcagctgccaatgcttttgatgctgcaaaagatataatggaggctcttcggggaaaacatgctaatttggctagtgaacttgagatcctgctaacagaaattggttcaaggtttgtcactcttccagaagagagacttttggcagtggttaatgctttgctccaccgctgctacaaatatccgactgctacaactgcagaagtccctcagtctctcaagaaagagctctcgggtgtttgtagggcttgcttttctgctgatgctgtaaataagcatgttgattttgtgagggagtacaaacaggattttgaacgtgatcttgatccagaaagcattactactttcccatctaccctgtctcaactgactgagcggttgaaacactggaaaaatgttcttcaaagcaatgttgaggataggtttccagcagtattaaagttggaagaagaaagcaaggtgttgcgggactttcacgttattgatgttgaagttccagggcaatatttcactgaccaggaaattgcaccagatcataccgtgaagttggatagggttgcagctgatattccaattgtgcggaggcatgggagcagtttccggcgcttgactctaattggctctgatggttcccaacgtcattttattgtccagacatctttgactcccaatgctagaagtgatgaacgcatactgcagcttttccgtgtgatgaaccaaatgtttgagaagcacaaggaatcaagacgccgtcacatatgcattcacacaccgataattattcctgtttggtcccaggttcgcatggtagaagatgatttgatgtatagcactttcctcgaggtctatgagaatcattgtgcaaggaatgaccgtgaggctgatcttccaataacctatttcaaggagcaattgaaccaagctatatctggccaaatatcaccagaagctgttgtggatcttcgtctgcaagcctataatgaaataactaaaaatctagttaatgacaacatcttttcacagtatatgtacaaaactctacctagtggcaaccatagttgggctttcaagaagcaattcgccatccagttagccctttcgagtttcatgtccttcatgctgcaaattggtgggagatccccgaacaagatcttgtttgcaaagaacactggaaaaatatttcaaactgattttcatcctgcatatgatgcaaatggattgattgagtttaatgagccagtcccatttaggctgacaaggaacatgcaagccttcttctcccatggagtggaaggccttattgtatcttcaatgtgtgctgctgcacaggctgtggcttcacctaaacaaagtcagcacctatggcatcacctagcaatgtttttccgtgacgagctactgtcttggtcttggagaagaccgcttggtatgcccatggcccctatggctgcaggtggtactatgagtcctgttgacttcaaacagaaagttatcacaaatgtggaacatgttattacaagggttaagggaattgctcctcagaatttttctgaagaggaggaaaatgttatggatccaccacaacctgtgcagaggggtgttactgagttggttgaagctgccttgaacccaaggaacttgtgcatgatggatccaacgtggcatccctggttctaa

SEQ ID NO: 15105 - DNA, 852 bp, Glycine max
  Peptide Sequence Number=SeqID_106790
atggggtgtgttggcttggctcctgaagtgtttgacttggactgtgaagagaagatagacagacaaacgaggaaaggagcgggggttaagcgtaagggtgcggggtcggtgttcaagtcccacacccaccaccgcaagggtccggcgaggttccgcagcctcgacttcggcgagcgcaacggctacctcaaaggggtcgtcaccgatatcatccacgaccctggtcgcggtgctcctctagccaaggtggcgttccgccaccccttccgctacaagaagcagatggagctcttcgtcgccgccgagggcctctacaccggccagttcatctactgcggcaagaaggccaccctcgtcgtcggcaacgtcttgcccctccgatccatccccgaaggtgccgttatctgcaacgtcgagcaccacgttggcgaccgcggcgtcttcgccagagcctccggtgactatgccattgttatcagccacaaccctgataacgacacctctaggatcaagcttccttctgggtcaaagaagattgtgcctagtgggtgcagggcgatgattgggcaggttgcaggtggagggaggactgagaagcctcttctgaaagctggtaatgcttatcacaaattcagagtgaagaggaattgctggcctaaggtgcgtggtgtggcgatgaacccagttgagcatcctcatggaggaggtaatcaccagcatattggtcatgccagtaccgtcaggcgtgatgctcctcctggccagaaggttggtctcattgctgctaggaggactggtcgtcttagggggcaagctgctgctactgctgctaaagcggataagaccacctga

SEQ ID NO: 15106 - DNA, 285 bp, Glycine max
  Peptide Sequence Number=SeqID_106791
atgccttacatgacatcttcaggcttaaactccttgacggaaccagctgcaaacgatggccacaaagactgcccgtctaggaatagcttgattttgactttgttctatacaattgagaatgtgaaaactataattaaagcacctaggagtgtagtggttaggaagcctgttttgctagtgatgcagaaaattgggagaaatgatgtccgccaagctgtggtgtccggacataactgggaagatgcaagggacaaagaaggggaacttggagcatacttagaatag

SEQ ID NO: 15107 - DNA, 87 bp, Glycine max
  Peptide Sequence Number=SeqID_106792
atggcctcttcagctcaattttccaccactttggtcgtactatgtctcttccaattcctagcagttcctggatatgcaactgggtga

SEQ ID NO: 15108 - DNA, 3735 bp, Glycine max
  Peptide Sequence Number=SeqID_106793
atggcagaaaacaaagacgaaatctattctgaatgttcaccaggctcaaactctccaatgggtagcaagtgcagatacttgtttcatagattatgcggttgtgacacttcatggaacaaaaacagcaccccaaagagtcgaagaattttccacagagatgtggaaaaagaagaattccagtatgctagtagtcactgtctctcatcctactacagtgtctttgtggttcgactagcaatcatggtgatgctagccatcttgatagggttgctcactatactgacatggcatttcaccaagatttatacagcaaaatcacttcgcagcttggcatatggtttgcgttatgaacttctgcaacgccccgttttgaggatgtggaatattttaaactctacttctgaaatcactacagctcaggtcaaactgtctcagtatgtgatcagacgtcacagcaaccctgcgactcaagcagagcaagttgagctgtatgaagcgatgagggctgtaacatgggcgttatttgctagtcgaaaagctctaaactctataactatcaattataagaatggatttgttcaagcgttccacagagatcttaaggacaacaacacattttacatctattctgatctttcaaattactccatgggtgctagcaactctaatgaggtcaattccatttcaaagcaccgagcttgggatgataaaggccttcatggtaactattcttcaatctggtaccgagaaccacttgaccctgtgagtggtgaaaagattggaaaagctatgaaaattgcacctgaagacttgatcaacatcgctggactttcccaagtgcctgacggtgtagcttcgtggcatgtcgcagtgagcaagttcacagattcaccattgctttcagcagcattgccagtttgggactcttctaataagactattatggcggttgtgggggtcacaactgcactttatagtgtaggacagctaatgagagagctagttgagatgcacagtggccatatgtatttgacatctcaagagggttacttacttgcaacttccacaagtgcacctctactggaaacttcaacaaagcctcctaagcttaagatggctgttgactgtgaagacaacgtaattcgactgggagctgagtggttacagagaacttatgggaacaattttcctccaagtcatgagattcatgtagagaatgtcaagctaggtcaccagagatattacattgactcattcttcctaaatttaaagagacttcctttggtaggtgtgatcatcataccaagaaagtatatcatggggcaggtagatgaaagagcctacaaaacgttggttattctgatatctgcatcattatgtattttagtcattggatgtgtttgcattttgatattgacaaatggagtatcaaaggaaatgaatctaagagcagaactgataaatcaactggaagcaagaagaaaagcagaggcatcaagcaactataaaagtcaattccttgcaaacatgagtcatgaactgaggacacctatggcagcagtaattgggttgcttgacattctcatatcagatgactgtctcacaaatgaacaatattcaacagttactcaaataagaaaatgttcaactgctctgctccgtcttcttaataacatcttggatctgagtaaggtggaatctggaaaactggtcctagaagatgcagaatttgacttaggaagggaacttgaagggcttgtagatatgttttctgttcagtgcatgaaccacaatgtggagactgttttagacctgtctgatgatatgccaaaggtagtccgtggagattctgcgagagtggttcaaatatttgcaaatctgatcaacaattcaatcaagtttactccatcgggtcatattattctgcgaggatggtgtgaaaaccaaaattcttacgttggtagtcctcttgaccagaagaaatctcggagtttacaaaagtgcatagagaggccaaatgcaaaccatgcaaagagaacttctgtgaaagataacaaagtgatactttggtttgaagttgacgacacaggctgtggtattgacccaagcaaatgggattctgtgtttgaaagctttgagcaggctgatccatcaactacacgactgcatggaggcactggtcttggtctttgcattgtgagaaacttggttaacaagatgggtggagacatcagggttgtcaaaaaggagggctcaggaacactaatgcgattatgcttgcttctcagtgcgccaatggatgtcacagaacaacagtgtgcagtagatttgacagacaatggcttagtggtactgcttgctctgcatggcaacatgggtcgattaattacatccaagtggctacagaaaaacggggtgtgcacaatggaagcatctgactggaacggactaactcaaattttgagggaactctttcatgcaggaagttcagttcataatactgactttgaggcacactatccagcaaaagaggaattgaagtctaaactactcaacataagagatatgaggaacccgggttttgtcattgttgttgacattggactacttgacttgagtacagatatatggaaggaacagtttaacttcctccacaggtactttggtagagcaaagtttgtatggatgttaaaccatgacacttccaataccataaaaatggagctccgtaggaaagggcatatacttatggttaacaaacccctttacaaagcaaaaatgattcatatcttggaagctgtcataaatgagagaaatcttgagctacaaaagaaaaacatgatagctccaaggaccacaatgaaagagggtgatttgcatgagtttcttgagattgattccactcattttgatggtgctagctctgatgattctgacatatcagaaataagtggttctaatcccgttagtgctaatggagataaaccagttgagaagctagaaaactctcatccatcatcaccacaccatatgaataactgcctagttagattaacaaatgaaaatgaatgtttggaagaacataatttgaggaaagaagaatcttctagtcccagctccagttctgccactgaagacaaccaacctaaatcactatccaccaaagaatcatcatccatttcaacagaagatcaggatgaagattctgaatgtggggacacaaatagggtcaccagctcaagtaaagcagtagtagatggaaagaaatctcttgagggcctaaagattttgcttgcagaagatacaccagtacttcaaagggttgctaccataatgcttgaaaaaatgggagcagatgttgttgctgtaggtgatggacaacaggcagtagatgctctcaattgcatgttcactgctgaagactgtagaagagaatcactccagaaggaaagaaacacaagatctcaaacagagatttcgacttgccgtccatatgacttgatcctaatggattgtcagatgccaaagatggatggctatgaggcaacaaaagcaatcaggaaatcagaagtgggaacaagcaggcacattcccattgttgctcttacagcacatgcaatgtcatgtgatgaagccaaatgcctggaggtgggcatggatgcttacttaacaaagccaattgacttcaaaatgatggtgtccaccattctttcactcactaaaagaacatcttga

SEQ ID NO: 15109 - DNA, 1191 bp, Glycine max
  Peptide Sequence Number=SeqID_106794
atgaatgtgatcgatcgatgttggagactgaatcctgaatggaggaggcatcgacctcaattagcaacatgttcggtgggctacaccggcaagatgacaaacaacattggtaaagacctcatccattatattgttatagaccctagtgatgatcctataaaccctaaacgtggcaccttgaggtatggagcttctgtaattcaaggtaaagtgtggatcacattccaaagagacatgcacattaaacttgagagaccccttcttattagtagtttcaccgcaattgatggtcgaggggttaatgtccacattgctaataatgcatgcttaatgatctttaaggctaccaacataatcatccatggcattcgagttcatcattgcaaacctcaagccccaggggtcgtgatggggcctgaaggaaaagtgattcctttgggccacgtagatggggatgcaattagattggttactgcttcaaagatttggattgaccataatacactatataattgtcaagatggtctacttgatgtaacacgaggatccactgatgtgactatatccaataattggtttagagaccaagataaggttatgcttcttggacatgatgatggatatgtgagagaccagaatatgaaggttactgttgtgtacaatcactttgggcctaattgtaatcagcgcatgccaaggattcgccatgggtatgcacatgtagcaaacaatctttacttaggatgggtgcaatatgccattggtggaagcatgggacctagcctcaaaagtgaagctaacctctttatagcacctacaatagggagtaaggaggtgacatggagaaagagtaatcataacaatggggatacatgggaatttcattcagtgaaagatgcttttgaaaatggagcctcatttacagtaacaaaaggaggacgtgtgccaaaaccaaattatagcaatgaacaatactttaaagttgttgatgtcaactttgttaggtcgttgacacgctcatcgggcatattaggatgcagtaaaacctctaattttaggaagaggtgcaacggttataatttaaggaaggaaaagtattcaagttcaatgaatatatacacatttagtcacacattacaagtgaagattagtcttcaacctaataggttggaagacactcacgatctttga

SEQ ID NO: 15110 - DNA, 603 bp, Glycine max
  Peptide Sequence Number=SeqID_106795
atggccacaataatatcaaaaagcatatacgtcttgtgcacaggaagtaatgacattgccaatacttactctctatcaccggttaggagagcacattatgacgttccagaatacacggacttaatggcttcacaagccacaaacttcttgcaggaactttatggactaggagctagaagaattggagtaattggtttgcctgttcttgggtgcgtgccctcacaaagaacaattcaaggaggcatattgagatcatgttcagattttgaaaaccaagcagcaatgctcttcaacagcaaactctcatcccaaactgatgccctaaataaaaatttccccgaggctagatttgtgtaccttgatatttacaacccattattgaatatgattcaaaacccttccacatatggttttaaggtaacaaacgaaggatgctgtggcactggaattattgaagcaggcatactttgcaaccctttcaccctacaaatatgttcaaataccgcaaactacatattctgggacagtttccatcctacggaagaggcctacaatgtgctttgttctttggtgcttgataacaaaatcaaggatttcttctga

SEQ ID NO: 15111 - DNA, 294 bp, Glycine max
  Peptide Sequence Number=SeqID_106796
atggaggagaaagattggaatgatgacagcctcaccatgaccaccgtttctcagcactgtttccgcgatgattctgaagcgccaagcttctacatctccatcatcgagaacatgaaggacgaatatggcctattcctgtggccctgcagcgtagttctcgccgagtatgtttggcagcacaaacatcgattttcaggagccaacgttgttgaggtgctggaacttccttgcctgacttggttgcagcaaaactcggtgcctgtgtcactcttaccgatgactccaccagattag

SEQ ID NO: 15112 - DNA, 1527 bp, Glycine max
  Peptide Sequence Number=SeqID_106797
atggcttgtcacagttggctctgtaatatctcactgctgttgctgctgctgagtttagcttcgcagagttgccacgctctcaattccttcggcttcgacatccaccaccgtttctccgatccggtgaaggagattctcggcgttcatgacttacccgacaagggaactcgcctgtactatgttgttatggcccacagagaccgaatattccggggccggcgactcgccgccgccgttcaccactcgcctctcacttttgtccccgccaacgagacttatcagattggagcctttggattcttgcattttgccaatgtttctgttgggactccaccgttatcgtttctggtggcactggatactggtagtgacttgttctggttaccttgtaattgtaccaaatgtgttcgaggtgtagaatcaaacggagagaaaattgcttttaatatctatgatcttaaaggatcatccacaagccaaaccgttctgtgcaatagcaacttatgtgagctacagagacaatgcccttcatctgatagcatctgtccatatgaagtaaactatctatcgaatggtacttcaactactggattcctggtggaggatgtgttgcacttaattacagatgacgatgaaacaaaagatgctgacacacgaattacttttggttgtggccaagttcagactggtgcatttttggatggagcagctccaaatggtctatttggactaggaatgggtaatgaatctgtcccaagtatcctagccaaagaagggctcacttcgaattctttttcaatgtgttttggatctgatggtcttggaagaatcacatttggggataatagtagcttggtccaaggaaagacaccattcaacctcagggcattgcaccctacttataacatcactgttacccaaattattgtgggaggaaatgctgccgatcttgagtttcatgcaatatttgactctggtacctcgttcacacacctaaacgacccggcttataagcagattactaacagtttcaattctgcaattaaactacaacggtattcatcttctagttctgatgagctcccctttgagtactgttatgacttaagttcaaacaagactgttgaacttcccattaatctgaccatgaaaggtggagacaattatcttgtcacagaccctatagtaacgatcagtggtgagggtgttaacttactttgtttgggagtcctgaaaagcaacaatgtgaacatcataggacaaaacttcatgactggttaccgtatagtctttgatcgtgagaacatgattcttggttggagggaatctaactgttatgttgatgaactctctactttagctattaaccgatcaaattcccctgctatttctcctgccatagctgtgaatcctgaagaaacatcaaaccagtctaatgatcctgagctgtcacctaatctctcatttaagataaaacctacctctgcgtttatgatggcccttttggtgcttttgaccatactttga

SEQ ID NO: 15113 - DNA, 429 bp, Glycine max
  Peptide Sequence Number=SeqID_106798
atgggtgttatcggaccgagattaaacgtccacggccctcccagtctcgagccattggcgaaaggaccgtggagaaatccttgttgttacattaagttgactacaagtttcgcctttgtccggaaggggctcggtcaaggtctagatctaggcctaggtcccgatcaagatcttttgaaaaacaaaggccaagatcccagtcgagaagtcgtggaagcaaatcttgtgggagcaagagctagcaacttcaatgtgttgaatgaattgaacattgtggttgtggtggtggcaattagttatgactatgacaacgatggtgatgctggtggtggtgtcaatgacagaggtggtattagtgttggtgtcggagacaatggtggtgatagtgatggtgttagtgatagtgacaacgaaaagtgtcatagttaa

SEQ ID NO: 15114 - DNA, 1647 bp, Glycine max
  Peptide Sequence Number=SeqID_106799
atggaagccactactatgttccgttttttctctgccgttatggtcaatcctaaacctcacaaactcttctcttccctctctatcttcccttccgccaccgctccccgccactttcaatccctcaaattccccactaaacagaacgctcactctgaaaaccgcgatattggcgaccgcgtcgtcttcgatgacggcatcttcgaaagcggcgccgttttccaaaacgacagcaatctcaccactaacacacccaaacgcagacccagcccaaggacaaaagtgacgcggataacgcgtgagaatttggttccggacaagtggagagaagttcagtcagagaccaaaatcaccattaacgagaggcgcaagaagaagaagaacataagagggttggttcctctaagggatgcaaacaaaatcgaggttgagaagaagttgagtcgctacaaggatgtaaattgggacgagtacaagtcttctaagaaggctaaattgagacagatcagtcctctggttctcaagaacccttctacatttcccgtcaaagagaaccttccagaacctcacttcaatggcgagcgtgttgagcctaagaatcccagaggtgtccttcacgggaagggtttggaggatgtcattcagtttttcaatagtggaagctataaccctagttataacacctctcttgaaggtcgtcggaagttgtttgctattactaaggaggaggtgttgttgttgaacaagcgaatgcccgacttggcaattgctacttcaggtaaatggcttcctctgcacactcttgctgcgggcggagaactttaccttttagattctttgttgaagcataatgttgatatcaatgctgtggataaggatggtttgactgcccttcacaaagcaattggcaaaaagcgggtcataaccaattatctcctaaaaaactcagctaatccctttgtccgggacaaagagggggccaccttgatgcactatgccgtacaaacagcttctattgagacaattgaattactattattgtataatgtggatataaatcttcaagacaatgatggttggacaccattacatcttgctgttcaaactcagagaccaaatttagtgaggcttctgctgcttaaaggtgctgataagacattaagaaacaagtttccaaacatatgtgctaatcaagttgttaaagcagcctcaagggagtctttgacatgtatgacaaatggtgttgtctctagtacccagacatttgggagtatagctgtatccttccttgttgtaccaagagcagaacatggtggtttcttaatccatgtcagatgtgatttggcatccttctcatttcaaatatatttatttttaacccctcatggtggaataatggttaaacctatatgccttctcatgctcatcaaaagacagttacattatgcgagaggtgaagagatttgttgtccattcacaatcttcaaaatttcaactgacaccaacagctctcaaattgtcgacaaattccatggccagggaattcgacatgcacttttggaaaccctaatgagtaatggcagtgtaaatcgaccaagtatgaatttgataggaactaaatgtaacagaaacttgtacctctgtcattga

SEQ ID NO: 15115 - DNA, 165 bp, Glycine max
  Peptide Sequence Number=SeqID_106800
atgaattattgcctaagagaggaacaacaaaggaaggagacttggagattgggtggaatggcgcaccaccatgatggtgtgatgagaagtggtgcaccaccgttgtgtcagccatgggtggtagccactgctgatgacagaggacaaacggaaagcttgctttga

SEQ ID NO: 15116 - DNA, 804 bp, Glycine max
  Peptide Sequence Number=SeqID_106801
atggttgttggatttgggtgtatgtggggcacagtgattgttgggtttaaaggtagggtgtggtggtgttgggttgatggccaaggttgtgcaagtgagggaaggggtgctgactatcacaaaaagaagggggttaggcaaatgacgagtggttttggtgaatcaacgagagcatctgcaccgagcccatcatgctcggggaacagttcaaacgatgctggcgatttcgaatgcaacatatgcttcgatttggcgcaagatcctgtgatcacactctgtggtcacctattctgttggccatgcctttataggtggctccatcatcactcccattctcaggagtgccctgtttgcaaggcccttgtgcaggaagagaaattggttcctctttatggaaggggcaaaacacagaccgatcccaggaccaagttatatcctggaatggagatcccccaccgtccttccgggcagaggccgcaaaccatgccgcccccgccgcctcccgaggtcaacccatttgggagttatgggtttggactcatgggagggttcattcctatggcaactgcccgatttggaaacttcacgctttccactgcctttggtgggtttatcccgtccctgctcaacattcatttccatggttttcaggatgccactgtctatgggacaacgtctggcaaccggtcaagtgcagcggcaggaggacaatgttttgaagaatctgcttatgttgattgggtttctcgtccttcttacgggaattgtatgcttgagaaggttgccactttggctctttattaa

SEQ ID NO: 15117 - DNA, 1233 bp, Glycine max
  Peptide Sequence Number=SeqID_106802
atgaggcctacaaccacaagtgtagggacagggcgtaaggctaccttagctttttcattgatcggtgggaattgtaaagctgcgcaatccaaagcacgaggaccactctctactcaaactccaccatctgtcatctacgccttcgcccctctcgtgtttcccacaacggttactccttctccctctcctatttcaacccatgccatggcttgtctgagccgctaccaccaccaccaccacccccgcggcgccacctggctctcttcccctgacgaaatgctccaacactgccccctctccgcccaccaccgccgtctccgcgatgacgacgccgaacctatctaccttccctctctctcctccgcctaccgcatcttccccgtctacgccatgggcgcccccgacccgacaccagaacccgaattagacggacccgacccgatttggaacgctgcggagaaggagccgattctgagtagcttcttgtacgctagcattttggcgcatgattgcttggagcaagcattggcgtttgtcgccgctaatcgtctccaaaaccctactctcttggccactcagcttatggatatcttctgcaatgtcattttgcatgacaaagctatccagcgatccattcgccttgatgttcaggcatttaaagatcgtgaccctgcttgtttgtcgtattgctccgcgcttttgtatatgaagggttatcatgctctgcaagtacatcgggtagcccatacattatggcaccaggggcgcaaagtcttggccctagctttgcaaagtcgtgttagtgaggtttttggtgtggacattcatccagctgcgaaaattggggaggggattttattagatcatgggacaggtgtggttattggtgaaactgctattgttggaaacagagtttcactgatgcatggtgtaacattaggaggcacggggaaggaaataggtgatcgccatcccaaagtaggtgaaggggcactaattggagctagtgcaactatacttggaaatataaagattggtgaaggtgccatgattgctgcgggttccctggtgttaaaagatgtccctcctcactgcattgcggcaggaataccagctaaagtcattagtggtctacaggagcatgacccatctttaaccatgaagcatgatgctactaaagattttttcacacatgtagctactaacttcagagatgaaaaacccaatggttag

SEQ ID NO: 15118 - DNA, 429 bp, Glycine max
  Peptide Sequence Number=SeqID_106803
atgagtgaagacttggtaccattgtcaccgatcagtttcctagaaggggcagccactaactacggtgataagatctccatcatctaccatcataatgtgagattttcatggagacaaacccatgaaagatgcgtaaagcttgcttcggctttggttaacttagggatttctcacaacgatatgagctgtctcgtcgttcaacttgttttgggtctcacaagtgcatatcgaggtgtagggacgttaattcagcagagtgatcatcaacctccgttttatcaagctcagtcgatgctcacacttgaggaagccggatcgacaatggtggctgtctcacaaccatttatgactcaaatttctctcattcagaccaacaacaacgtgggaagccgtttggatatcacaagaattatgaagaaaaaaaattag

SEQ ID NO: 15119 - DNA, 1185 bp, Glycine max
  Peptide Sequence Number=SeqID_106804
atggaagatttaaggcgttcattgcaacctaaagagaatgctattgaggcattgcaacagtcaattgcagaaaaggaacagatgttggaagatatgagagggttgcttcaggctgctgaagaaaaaaggcaagctgctctagctgagctctcagctaaacatcaaaagaatatcgagagtttggaggctcaaattaatgatgcattgtccgacagaagtaaggcaactgaatccatttcttcactgcaggttctagttgcagaaaaagaatccagaattgcagagatggaagcagcatcaacaggagaagctgcacgactcagagcagctgtggaaagtgtgaaaggggagctttctcacataaaagaggagcatgaaaacgaaagggaaagctgggagactgcttctcaggcacttaaagcaaaacttgaaattgcagagagcaactgcatacgtgcagaagttgaagtagcaaaaataagaagtcagctggaatcagaggtatccacacaaacaagaatcctcaatatgagagatgctgaattgttggctgccaaagaagagatcagctctcttgagaaggaattttcttcatacaaagttcgtgcacatgcacttcttcaaaagaaggatgctgaactggctgctgctaaagattctgaacaactcaaagatctagaggaaactctgaaagaggtggaaaatgaagtattatcaataacagaagaaagggatagagttcttcaagatcttcaatctgctatggctaatcatgagaaagagcttgcagaaagagacacagcccttgaaaatgtcaagcaacagataaggagcttagaaataaagcttgactcagctaatgctaaacacctaaaagagaaagaggaatggggactaagtcttcaaaatgtacaagaaacatggagaatcagatgtgaggcaatgaaggctgaaaatgaagcaactgctacaaaagatatgcaaaaggaattggaagagctcaaacagcgatgtaaaaaactgaaggaagagcatgcttcatttcatgatcttgcggatagaatgattgaggagaaagactatgaaatatccagacttttagatgaaaataagaatcttcgtcagtctcttcaatcaagaccatcagtatgtttttatctgctttttcaatatcacgagagttaa

SEQ ID NO: 15120 - DNA, 276 bp, Glycine max
  Peptide Sequence Number=SeqID_106805
atgatggagaaggaagactctgtgcagaagctgtacacgcgtatgcgactctgggaatttccggatcagtatgtgattgagccaacggatggatcttctggttcttctttgtctgttagtcgtgtcgatggatccatgaagctcattgataaggttccagaatgcagcacgcttcgagttcctaagatttatacgattttcggtgttgttgggatgttgaagctcttggctggtcagcaatcactttgccatcgtgatttgatgattgatttgtag

SEQ ID NO: 15121 - DNA, 468 bp, Glycine max
  Peptide Sequence Number=SeqID_106806
atggatctaagaacgaaggggtttgaaggaagtgagattcctgaaatggagccaaggcttctccagcacggtggcttggtaactggccgtggtggatccattcttgaccttgaggaccaggcgcgtcagctttgccccataacgcttgtcgtactcgctcaccgcgtagttcgcgatctccgccacgtggctgtcgttcacgtccttgatggggctccagccgcccagcgcagattccgaccgccgggcagcgtaggagaccaagacgagggagaggagaaggagacagtgcattggaaaaacgcggttaacgggcttgtcctgaatattctcgtttgggctagcgcattggcaaagccaactacatttgatggtgttgaagttggaagccagaaagcaaactcggttgctattcctccagggattataagaataagagggtgcacatgcatagttcctgctatgtga

SEQ ID NO: 15122 - DNA, 1491 bp, Glycine max
  Peptide Sequence Number=SeqID_106807
atggtaacatcaaaggctcatgcagcacttgtagccagccccggcatggggcacctcattcccatgctggagctaggcaaacgcctcctcactcaccattccttccacgtcaccatcttcatcgtcaccaccgattccgcaaccacaacctctcacatactccaacaaacatccaatctcaacatcgtccttgtccctcccatcgatgtctcccacaagctaccacccaacccgcccttagcagcacgaattatgttaaccatgatcgactccataccctttttgcggtcttccattctatccaccaacctccctcctccttcggcactcattgtcgacatgttcggtcttgcagcttttcccattgcacgtgacctcggcatgcttacctacgtttacttcgccaccagcgcctggttctctgcggtttccgtatacgttcccgctatggacaagaaaatgattgaacgccatgcggaacaccacgaaccgcttgtgattcccggttgcgaagcggttcggttcgaggacacgctggaaccgtttttatcgcctataggggagatgtacgaaggttacctcgcagcggcaaaggaaatagtaaccgcagacggaattttgatgaacacgtggcaagatctggagcccgctgcgacgaaggcggtgagagaggacgggatattgggccggtttacgaagggagcggtgtatccggttggaccgctagttagaaccgtggagaaaaaagcggaggatgcggttttaagttggatggacgtgcaaccggctgagacggtcgtctacgtgtctttcgggagcggtggaaccatgtcagaggttcaaatgagggaagtggcgttggggttggagctgagtcagcagaggtttgtttgggtggtgcggccaccgtgcgagggtgacacgagtggctcgtttttcgaagtatcgaaaaatggcagtggtgatgtggtgcttgattacttgccgaaggggtttgtgaaaagaacggaaggggtgggggttgtggtccccatgtgggccccgcaggcggagatcctgggacatcctgcgacgggttgtttcgtgacgcactgtggttggaattccgtcttggagagcgtgctcaacggggttcccatggtggcgtggccgctatacgcggagcagaaaatgaacgcgtttatgctgtcggaggagcttggggtggcggtgcgcgtggcgggggagggaggaggaggagttgtgggaagagaagagatagcggagctggtgagaagagtgatggtggataaagaaggagttggtatgaggaagaaggttaaggagctgaaagtgagtggagagaaagccttgtctaagtttggatcctctcatcattggctttgtcaaatgaacaaggactgtcaagttcatgcgcaggcttctgaggctgactacttagggactgctactaccactactgatgtgctcagcgacgtcgtttgctcttga

SEQ ID NO: 15123 - DNA, 2811 bp, Glycine max
  Peptide Sequence Number=SeqID_106808
atgattttagcttggctcttggttttaatggctctctccaatgggttcttttcaaatggggacggcatgcataattccacaataccagattttgtaaatattggggctctcttctctttcaatactagtgttggcaggagtataaaaattgctataaaagctgcgattgaagatataaactctgatcctactattcttggtaaaaccaagctgaacctctcactgcaagaagattctaagtatagaggtttcctgagcatttctgaggttttgcaggtcatggcaagacgcacggtggcaataataggcccccatagttctgtaacagctcatgtcataactcacattgcaaatgagctccaagttcctctgctgtcattttcagctttggaccctaccctttcttcacttcaattcccattcttcattagaacctgtcacagtgatctttatcaaatgactgcaatagcagacattgtaaactaccatgattggaaagatgttattgctgtctaccttgatgatgataatgggagaaatggaattggtgcattaggcgataagcttgctgagaggcgttgcaggatatcatataaagcacctttgagcccggacgcatctatggaagagatttctaatgtgcttgttcaggtggctctggcagaatcacgggtaatagttgttcatgcaaatactcaatttggccccaagttgtttagtgttgcaaagaatcttgggatgatgggaactgggtatgtctggatagccactgctttcctctctgctctgcttgatatcaacagtcccctctcttcagattcattggatgacattcaaggagttcttacaccgcgtatgtacacgccggattcacagctccaaaggaggtttgcttctaggtggaaaaacttgactagtgggaatactgctaatgcccaccttggattgagctttttacctatatacgcatatgacactgtttatgtgcttgctcatgcacttgatgcatttttcaaacaaggtaaccaaattacattctcaactgattcaaagctatctagcatacatggagataacttgaatcttgaagccttgaaaatcttcaatgaaggaaatttgttacgcagtaacatctatgaggttaacatgactggtgtatcaggtccattcaagtacacatctgatagaaaccttgttaatcctgcatatgaaatcattaatgtcattggaactggaactcggaggatcggttattggtctaattactctggactatcagttgttcctccggaaactctttattccaaaccagccaatctttccagggaaaatcaaaagttgttcgctccaatttggcctggaaacactggtgagagacctcgtggttgggtttttccaaacaatggaaggctcttaaagattggcgtaccaaaaggtgttagttacaaagaatttgtctcacaaatagaaggtactgatacgtttgaaggattctgcattgatgtatttcttgctgcagtgagcctgttgtcttatgctgtcccctataagtttgtcccatacggggaaggtaagaacaatcctagtatgactgagcttgtccgtctgatcacaactggtgtgagtatcatggataacttttttgtggagtttgaaagttttatggaatttgatggtgcagtaggtgacattgcaattactacagaaagaacaaggatggtggattttactcagccatatattgagtctggtctagtggtagtagcaccggttaggaaggaagaatccaatgctttggcctttttggccccttttaccccaaagatgtggtgtgtcacagctatctttttcatattagtgggagctgttgtttggattttggagcatagggtgaatgatgaatttagaggaccacccaaaaaacaagtagttactgttttatggtttagtttttcaacaatgttcttttcccacagggaaaatacagtgagcgcacttggtcgctttgtgttgattatatggttatttgtagttcttataattaactcgagttacacggcaagtctaacatcaatcctcacagtgcaacagctttattcgcccattaaaggcattgaaagtttagtaattggcaaagagcctattgggtacacacagggttcttttgctagaaattatttagttcatgaaattggtattaatgagtccaggcttgttcctctaacaacaacagaagaagctgctaaagcactgagaaagggtcccgaaaatgggggtgttgctgcttacattgatgagcgtgcctacactgacatcttcctttccagccgttgtgatttaactgttgtaggtcaagagttcaccagaaacggttggggatttgcctttccacgggactcgccattagcagttgacctgtcaactgccatattgcaaatgatagataatggagatttacaaaggatccatgacaaatggcttttgagtagcgcttgcttatcacaaggtgcaaagcttgaagtggaaagactccaacttaaaagcttttggggcctctatatttggaggcaataccacaagcactacgtctctgaagaacttgattcttctgacggccaaagcttaggatcaaaatcttcacgtcttaagacttttctttcgtttgcagacgaaaaagaagagaccgttaagagccggtccaagagaagaaaaatggagaggatctcatacagaagcagtgaaggaagctcatccatcagctctaataagggatatgctccacgcagaagtgaatgtgctagcgaagtatga

SEQ ID NO: 15124 - DNA, 618 bp, Glycine max
  Peptide Sequence Number=SeqID_106809
atggaaaatcaacaaaagcattattcattattattgttgacagatgacgcgcgcgttcagaattctaaactccgcggacaacgccaccgcggtagccgcggcggcgcctccgccggaggcggtagcgctggagtccgacttcgtggtgattctcgcggcgctcctctgcgcgctcatctgcgtggtggggctggtggcggtggcgcggtgcgcgtggctccggcgaggctcgggtgccggaaactctcctcggcaagccttggcgaacaagggcctgaagaagaaggtgctgcagtcgcttccgaagttcgcgtacgtggacagcaacccgagcaagtggttagcgacgtcggaatgcgcgatctgcctcgccgagttcgccgccggcgacgagatccgcgtgctgccgcagtgcggccacggcttccacgtgccctgcatcgacacgtggcttgggtcccactcctcttgcccttcttgtcgacaggttttggcggtggccaggtgtcagaagtgtgggcgatttccggccaccggtgccggagcttccagaacgccggcgaccgaacccgaattgaagtccagagaagacaacaatgccgcgagttacagcaataa

SEQ ID NO: 15125 - DNA, 828 bp, Glycine max
  Peptide Sequence Number=SeqID_106810
atggagggaagaatctgcgaggaattaacgcccaggtattatgctctttgtgccattggaggaatgctcagtgctggcaccacccatcttgccatcactccctttgatgtcttgaaagttaacatgcaggagttacaatataaggtgggctggatggttaagggagaagggaaggggaaagggaacaagggccatctgttctttggaaaggttggaccggcaagttctttggctatggtgctcaaggaggatgcagatttggtctctacgagtattttaaagagtgcgtctgctgaagtgtttgccaatgtagctctatgtccatttgaagctgttaaagtgagggttcaagcacaaacctgttttgctaagggattgtatgatggctttccaaagttatatgcatcagaaggcacacgaggttgggggctaggttacttagagaaatcaggcatgttacctataaataagagggtagggaagagagagatcatcttgccatctgtgagagaattgaggcctttgggcattgggaggtgcaaaccctcaaagttttgcaagttaggcactgtatcaaggggagaaatcccttatctttctgataagataccagtttccatggttatgttctcaacatttgagcattccgttgattttttgtatcggaatgtggtcaaaagaaaaaaggaggactgttcaataggtcaacaacttggtgtaacatgtttagctggatatgcagctggatctgttggtagcttcatttctaatccggctgacaatattgtatcttctctttataacagaaaggctgatagtcttgcactg

SEQ ID NO: 15126 - DNA, 2076 bp, Glycine max
  Peptide Sequence Number=SeqID_106811
atggaagatacactttctgcgttgaggtctttgatgctttctcagtctccaccgcttgatgccttagttgttccttctgaagattatcaccagagcgaatatgtgtccgcacgagacaagcgccgcgaattcgtttccggcttcactggaagtgccgcatccatcggtttagggtttaagttacctcctgtttcggcgttttcctgcaattgtttcaattcaacatatcgcgtattaagtattcaactgattggttcccgcggaagcttggcacttataacaaagaatgaagcactgctgtggacggatggacgatattttttgcaggctgagcaagaacttagtgctcagtggaagcttatgcgtattggtgaagatcctgctgtagatatctggatggccgataatttgccaaaagaggcatccattggggttgacccttggtgcatttcaattgatactgctcaaagatgggagcgtgcttttgccgaaaaacagcaaaagctggttccaacctcaaaaaatttggtggatgaagtttggataaatcgcccacagccacagattaatgctgttatcgtacatccactgaaatttgcaggtcgctctgttgcagacaagttgaaagatttgagaaaaaagcttgtacatgagcaagcccgcgggataattttcacagcacttgatgaagttgcatggttgtataatattcgtggaagtgatgtggcctactgtcctgttgttcatgcatttgctattgtgacatccaattctgctttcatttatgtggacaaacgaaaggtttctgttgaggtacaagctcatttagtggagaatggaattgaaattcgagagtatacagctgtaagctctgatacgacattgcttgcaactgatgagcttgattctgtatctaccgccaaggttgctttagctgaaacagaggtccgaaaaattcccaatgaaactgctaagcatgcaaatggtgaacatcaagcagaagaaaatagtaatgacctcatatgggctgatccaggttcatgctgttatgcactgtatgcaaagttgaaccctgatacagttctcttgcatcaatcacctttggcccttgcgaaagctttaaaggttaactcggtggaattggacgggttaaagaaggcacatattcgggatggtgcagcggtcgtgcagtatcttgtctggctggataagaagatgcaggatattttgggagcttctggttactttttggagaacgattctgtgaaaaaggagaaacatttgcagtctttgaaattgactgaggtgactgtaagtgaccagcttgaaggttttcgagcatcaaaagagcatttcagaggattgagtttccccactatttcttcagttggcccaaatgcagctataattcattattctccaaaggcagaaacatgtgctgaacttgatccagacaaaatttatctttttgattctggagcccaggtcctaaagggtcacattgctcttggaaatgctagatttcccaatgggacaaatgggcattctcttgatattcttgctcgaattcctttgtggaaggatggtcttgattatcgacatggtactggtcatggaattgggtcctatttgaatgttcatgaaggacctcacttaatcagtttcagaccacaggctcgaaatgtaccattgcaatcttccatgactgttacagatgaacctggttactatgaggatggagagtttgggataagattggagaatgtgcttattgtcaaagaggctggtacaaatttcaattttggtgatagaggttacttatcttttgaacacattacctgggcaccatatcagaccaagttgattgacctgaaccttctatgtcctgaggagatagattggctgaactcgtatcactccacatgcagagatattctagcgccatatttgaatgaagttgaaaatgcatggctgaaaaaagccactgaacccgtaggttttcccggcatagagagcatttgctcaggccgatccggcatggatatagcgtgggttctggacaaaaagcagcaataa

SEQ ID NO: 15127 - DNA, 2475 bp, Glycine max
  Peptide Sequence Number=SeqID_106812
atgactcgagcaagacgggaatgggagttggacattctttcttgttatcattcactgatgttctcttcacaggcgcatgtgacgaaagatgatgctagacaacaatttcttcatatattgagaacacttccctatgggttttccgttttcttcaatgttcgcaaaattgatgatcctattggactattgcctgggcgaataatattaggaatcaacaagagaggggtccattttttccgtcccgttccaaaggaatatatgcactctgctgaattgagagacataatgcaatttggaagcagcaatactgcagtattttttaaaatgcgggttgcaggtgttcttcacatattccagtttgaaacaaagcagggagaagaaatttgtgtagctcttcagacacacataaatgacgtaatgttgcgacgctattccaaagctcgatctgctgtgggtgaatctttgaatgaagacacttctaatgattttaagccttctaatttggaactatctgaaaaacgtcttcaagagttatcaaaacttgttgaagaatctcaaacgaatgctgatcaaataaagaaaccagtttcttgcatgaaattatgtaaagacatgttgctggataaattgcgtgagaagcaaaaacaagaagaggacatgctacaagaattagagggcttacaaagatctttaagagctgacaagcagagtcttgcagaagttacaaatgaccgtgacaaacttaggtcattatgtgaagaaaaagataaggcacttcaggctgaaattctagagaaaagaaacatggaagcaaagatggcagagttgagtaatctggttacagagaacactaccaaaaaggaccacactcaaacaaataaccaagtgtcacagaaactcgaagatgacctaaaactatgtaaaggtgagttgcgtgtagctgaagaaactatcaaaaacctgagaagtaataagttgattttggaacagaagctatctgagcttgagaagaagagtgctgaagaggctagttctcttcaatggaaacttgagcaagaaggcaaaactctgaactctaaagtatatgaccttgaacgaaaactggatgcgtttagacaagaattaagtgtggctgagtctacagtctcggtcaaagactctgaattggctgcattgaagaacaatttagatgaactagaagaattgagagaaatgaaagaggacattgacagaaagaatgagcaaacagctgccatactgaagatgcaagcagttcaactagctgaaatggaattgctttataaggaagagcaggttctcagaaagcgatattttaataccatagaagatatgaaaggcaagataagagtttattgtcggttaagacctcttagtgaaaaagagattgcaagcaaagaaagagattctcttactactgtagatgagtttacagttgagcatccgtggaaagatgataaaccaaaacaacacatatatgaccgtgtgtttgatggtgatgccactcaagaagattacttagtgcaatctgctgtagatggttataatgtttgcatatttgcttacggtcaaactggttctgggaagacttttacaatctatggagctgaaaacaatcttggacttacccctcgtggtactgcagaactttttagaattttaaggagagatagtaacaagtattctttctcgttgaaggcatatatgttggaattatatcaagatacacttgtagatcttctgttaccgaagaatgcaaagcgtttaaaattggatattaagaaggattccaagggaatggtagcagtagaaaacgtaacaattgtgccaatttccaccgtggaggagttaaatagcatgatacagagggggtctgagcagcgacatacatcagggacacaaatgaacgacgagagttcaagatctcatctcatactatcaattgtcattgaaagtaccaaccttcaaagccaatcaactgcaaggggaaagttaagttttgtggatcttgctggctcagaaagagtaaaaaagtctggttcttcaggtagtcaacttaaagaagctcaaagtatcaacaaatcattatcagcactaggagatgttattagtgctttgtcttctggtggtcaacacataccttacagaaaccacaagttaactatgttgatgagtgattcacttgggggtaatgccaaaaccctcatgtttgtgaatgtatctccagtagaatcaagcttggatgaaacacataactctctaatgtatgcgtcacgagtgagatcaattgtgaacgatccgagcaaaaatgtttcttccaaagagatagctcgactaaagaaaatgattgcatattggaaggagcaagcaggtaggagaggagacgatgaagatttggaagaaatccaagaagaaagacaaactaaagagaggactgatggtaggcattctatgtag

SEQ ID NO: 15128 - DNA, 399 bp, Glycine max
  Peptide Sequence Number=SeqID_106813
atggcctgtactcctaaacctaaaggcgatccctctgttgctgcctccatcgccgccgccttcttcaaacttgtcattgtcatcgaagtcagttatgaggatgatagctttcgcgaatcattcaccaacaccgacatccaccgccttgcctccaagaggttcatagtcaaatacgacaacctcatggcagacgagaaaatcatgaagaagttgagagaagtcattggtctccaccacctctgccttttcccccaacgaagactaattgtgaattcaaatttggcaactagttccacaacaacggctgtgcccaaggagcaattggtcttttccaaggaacaactcatgctctaccgcgagtggttaaatcatgattgggtcccaccactatacggctaa

SEQ ID NO: 15129 - DNA, 465 bp, Glycine max
  Peptide Sequence Number=SeqID_106814
atggcaagcaggtttattggtatagtgctcggtataggattgggtaactgcataggctcctccacaccccttgttcttgcttcatttactgtcttgacctggatccacatgtactgcaatctgaagtcatatcagtccattcaactacggactttaaatccttaccgtgcaagtttggtttttagtgaatatctactgagtggccaggcacctccagttaaagaggtcaatgatgaggagccactatttccagctgtgcccatattaaatgcaacttttgcaagcaaagcacaatcatttgctttatcatctgaagcaaaagatgcagctgcagaaattgaacatcgtctgcagcttggatccaagctcagtgaaattgtcaacagcaaggaagatgtgcttgccctctttgggctttataaaaatgaaggctacatcttgtcagagcacatgggaaaatactct

SEQ ID NO: 15130 - DNA, 231 bp, Glycine max
  Peptide Sequence Number=SeqID_106815
atgagggaggaccatgctactacccggcttagaatgttcagtgaattgtaccaattgtctgcatttgctaagtgccaaaaagaagacccgcgtacaaaggtgtctgagcatccaatccaactgaaatggttgaaggaagagggaggaaaaaagagcatgcctttcaagaaaaaaagcgagcggagcaacaatagtgaaggcaaggaaatcgcggtaaaagcagaaaactag

SEQ ID NO: 15131 - DNA, 318 bp, Glycine max
  Peptide Sequence Number=SeqID_106816
ggtttgggagatggcgtcgagtgtgttgaagagcctcctcctgagattttcctcatcgaggaacacgacgaccaccagaagtttcagcctcgttacccctcaaatcagcaaccacaccgccaagatacaagcaagaaatctccgatggagctgattaatgaagttcctccaattaaggttgaaagcaggatagttgcttgtgaaggagataccgatcctgcccttggacacccgattgaatttatatgccttgacttgcccgagccagctgtttgcaaatattgtggccttcgttatgttcaggatcatcaccattag

SEQ ID NO: 15132 - DNA, 1863 bp, Glycine max
  Peptide Sequence Number=SeqID_106817
atggcgaaaacgtacgcagcgggattgttgtctgccatagctgccgccactgcagctgcatctctgaatcagaacaatgcttatgcagatgggattttaccaccgaatccttctgaaattgaaccttccccggcgccgccgccgcctaaggttcgaaacgatcatccaaggaccacttctgctgggttcgatccagaggccctcgagagaggggtcaaggctctcagggaaatttctaaatcaccccatggcaaaaaggtctttgaagttatcaaaaagcaagaggagacaaaacaaactgaactttctgcaaaggttgctgagtttaggcaaatgaaagcacagcatgagactgaaagacaaaggattatatatgatgaacaaaaaaagctagcgcagcatcaggcacaaacaaaatcccaaatggccaaatatgaggatgagttggcgaggaagaggatgcaggcagaaaatgaataccatcgggccaggaaccaagaactagtgaaactgcaagaggaatcatcaatcagacaggagcaagctcgacgtgcaacagaagaacaaattcaagctcaaagaaggcaaactgaaagagagaaggctgagattgaacgcgaaacaatcagagtaagggctatggcagaagcagaaggaagagcacacgaagcaaagctagcagaagatgttaacaggcgaatgttggttgatcgtgctaatgctgaacgagaaaaatgggttgctgccataaatactacttttgaacatatcggagggggattaagagccattctaacagatcaaaataagttggttgtagcagttggtggagtgactgctctggcagcaggggtctacactacaagggaaggtgcacgggtaatttggggatatattgatagaatattgggacaaccatcattgatccgagagtcatccagagggaaatacccatggtctggcatgttttctcgcaccatgagctccctatcacgacatactaatccaggatctgctttgaaaaatggaaatggttttggtgatgtgattttgcatccttctcttcaaaaaagaattcagcagttgtcttctgctacggcaaatacaaaagcacatcaagcgccattcagaaacatgcttttttatggccctcctggaacaggaaagacaatggctgctagggagttagctcgtaaatctggattagattacgcattaatgactggaggtgacgttgctccactgggaccgcaggctgtaacaaagatacaccagttgttcgattgggctaagaaatcaaataagggtttattgcttttcattgacgaagctgatgcatttctgtgcgagcggaacaagacttacatgagtgaagcacaaagaagtgcattaaatgcccttctctcccgaactggtgaccagtctaaagacatagtccttgctcttgccacaaatcgtcctggtgatcttgattcagctgttacagacagaatagatgaagtcctagaatttcccttgcctggggaagaggagcgcttcaaacttcttaagctctatttggataagtacatagcccaagctggatcaggaaaatctagtttcgttaaagatttgttcaaaggaaaaccgcaacaaatagaaattaagggattgactgatgatatcataaaggaagctgctgctaaaacggagggattttctggaagagaaatagcaaaactgatggcaagtgtccaagctgctgtatatggaagtgagaattgtgtgcttgatccaagcttgttccgtgaagtggtagattataaagttgcagagcatcaacagagaataaaattggcagctggtgataaacctatcgcatga

SEQ ID NO: 15133 - DNA, 1075 bp, Glycine max
  Peptide Sequence Number=SeqID_106818
cttgatgtcttggtcgtgccctctgaagattatcaccggggtgaatatgtgtctgcacgagacaggcgccgcgaattcgtttccggcttcactggaagctgtagcatccatcagtttaaggctggacaagaacttagtgctgagtggaagctaatgcgaattggtgaagatcctgctgtagatatctggatggccgatgtgagtgtcctgcttaacttgccaaaagaagcatccattggggttgacccttggtgcatttcgattgatactgctcaaagatgggagtgtgctttttgccaaaaggcatcagaagctggtcgatctgttgcagataagttgaaagatgtgagaaaaaagcctgtacaggagcaagcccaggactccattttttccttttttcggatggtatattcatatctgaaagaggttcacaataagttttttcaaaatggactatttgtccctctgttagaggtgttccagaaatgtctagggataattttcacagcaattgatgaagtttcatggttgtataatattcgtggaagtgatgtggcctactgttctatagttcatgcattttccattgtgacatccaattctgctttcatttatgtggacatgcgaaaggtttctgttgagtatacagctgtaagctctgatgtgacattgcttgcaacagataagcttgataccgtatctactgccaaggttgatttagctgaaacagaggtcagaaaaattaccagtgaaactgataagagtgtaaatggtgaacataaagcagaagaaaatagtaatgacctcatctgggctgatccgaaaaaatgctgttatgcactctatgcgaagttgaaccctgacaaagttctcttgcagcaatcacctttggcccttgcgaaagctttgaaggttgtatcacttaactcagttgaattggatgggttaaaaaaggcacatattcaggatggtgcagccgtcgtgcaatatcttgtctggctggataagaaggtgcaagataatgatacaaaagcttggttcaatgtgcagatgcaggatatttatggagcttctg

SEQ ID NO: 15134 - DNA, 189 bp, Glycine max
  Peptide Sequence Number=SeqID_106819
atgagggagtccatccagtcgtcggagtcgaagtcggagaagcggaaggagtgggggtcgggttggaagtggaaagggggatcgggttggaaggggtcgggggggaaatcggtggtgggagcaagtgttgctgctgctgttgctgctgctgctgctgctgctgctgctcttgctgctgcttctgcttaa

SEQ ID NO: 15135 - DNA, 267 bp, Glycine max
  Peptide Sequence Number=SeqID_106820
atgaagaagactcagaaactgaggcaacaagatctttctggaatcttcggtggtcatcctggcaaaggtagtggtgatctgttcggagcattgggtggcccacaacaacgtccgacgtccggcggttgcagatcgacggtggcatggcggtatccaacagttgcaaaggatgagcggtcgaagctcaaatgggaatcttatcagtcgcatatgcagatggcaggacctaagctcaggcaaaggcaaccaatagtgagaccagcataa

SEQ ID NO: 15136 - DNA, 132 bp, Glycine max
  Peptide Sequence Number=SeqID_106821
atgagctatagcgggaacatgaagcggagtggctggccaccgctgctgacagcaactatggcttcactcacagaacctgttcagccaccaccacctcctccagtgggatgggtgaagccttactggtcctaa

SEQ ID NO: 15137 - DNA, 1518 bp, Glycine max
  Peptide Sequence Number=SeqID_106822
atggcttctgttctgcctatttaccacaactacgttaacctcccatgtcctcttcccctttcaaaaccatccaccaccttcaacacacccataattctcttcttcccaaaaaccaaaccttcactaaccctcaagtgctcctcttccgcttcaagcctaaccccggaactggaccaagaagaagaaacatttggtaactttgatgagcctcccttgagcgaatcgtggaaggaaatccaaggcttgaacaactgggatggtctcatagacccaaccatgaaccctcacctccgaagagaaataatccgctacggcgaactcgcccaagcatgctacgactccttcgacttcgaccctcactccaagtactgcggaacatgcaagtaccacccttcacagttgttcgagaaactcaacatgtcccaaaccggctacatgataagccggtacctctacgccacctccaatgtcaacctccccaacttcttccagaagtccaggctctccaccagcgtctggtccccacacgccaactggatgggctacgtggcagtctccaccgacagggaccaaatcaaacgcctcggacgccgcgacatcgtcattgcatggcgaggaaccgtcacctacgtcgaatggatctacgacctcaaagacattctccgtccagcgctcttctccgacgaccccaccatcaaagtcgaatcaggcttctacgacttgtacaccaaaaaagaagattcatgcacctattgctctttctccgctcgcgaacaagtactctcggaagtcaagcgtcttctccattattacaaaaacgaagagatcagtattaccatcacaggacacagcctcggtgctgccttggcgattctgagcgcttacgacatcgctgaactcaagttaaacgttgttgaagacggtcgtaacaaaattcctgtgactgtgttttcgtttgcggggccgagggttgggaatctgaagttcaaggagaggtgcgaggagctaggggtgaaggtgctgagggtggtgaacgtgcaggacgtggtcccgaccgtgccggggataataacgaacgagaagtttcagttccagaggtacatagaggaaacgctgtcgtttccgtggagctacgcgcacttggggacggagatggcgttggatcacagggagagtccgtttttaaaaggagggatgaatgatttggggtgcgcgcataacttggaggtgcatttgcacttggtggatgggtaccatgggaaggggaagaggttctgtttggcaaccaagagggacatagcgcttgtgaacaagagctgcgattttctcaggagtgagtacggtgttccctcgcattggcgccaggatgagaataaggggatggtcaggagccgagatggccgctgggttctgccggaccgcccaatattggaggctcatccgccggacatggcgcaccatctgcagcaggtcctcaacaaccacttagcagctcagcaattcgaaaccagtacttga

SEQ ID NO: 15138 - DNA, 348 bp, Glycine max
  Peptide Sequence Number=SeqID_106823
atggcaagttatagcacttatttgtccttggcaatattggtggttgctggatctttaatgtacaacacaaaagaggtttcagctcaatgtggaggaagtcttacggatctcatagcacagtgctcacagtatgtgcaaaagtcgggaccacaaatcaagccttcagcggcgtgttgtgcagtgctgagaaaatttaatgtgcaatgtgcatgcaaacttattactaaggaagttgcaagccttgtgagtattccaaaggccgtttttgttgcacgcacttgtggattcaaccttcctcccgggatgcattgtggagctgttaaaattccgccgaaggccatgaagtga

SEQ ID NO: 15139 - DNA, 482 bp, Glycine max
  Peptide Sequence Number=SeqID_106824
atggcgtttagctgtgcggttgagaaaccattgcattcaatgaattggatgattttaacgcggcgccaaggagcatttttgtgcttctggttgtctgtgctttttgtggtagtagacttttgctatggtgaccatagtacagtcgaggtagtagggttgggagaatgcgcagattgcaaggagaaaaacattcaaactagccaggctttctcaggtttacgtgtgacagtagactgcaaggcagcaagtggaaactttgaaaggagaggggtcggtgagcttgatgaatatggaaacttcaaagtttcccttcctcatgacactgtaaaagacgataaactgatagaagaatgctatgctcagctacttagtgcatcagctgcaccttgtcctacccatgatggcccattgagccacaaaatagtgataaagtcaataactaataatgagaaacacatccttggtcctgctgggaaactcaa

SEQ ID NO: 15140 - DNA, 894 bp, Glycine max
  Peptide Sequence Number=SeqID_106825
atgacgcggcctttcggtgtgaagggggggaggaagcgaaagcacgcggaacccaaatacgacgcccatgacgaagaagaagaagaagaaacgcaaccaaagaaaactgtggtggaggtggagcacaaccaagaagaagaagaagaaactccagcaccagcaccagaggatgatggattgagcggtatcccaattgcgcccagtgcgaacaacactaacaaacccaacgtcatcttcattcttgaaaaagcttctttggaagtcgccaaagtcggcaagacatatcagctcttaaactccgacgaccatgccaatttcctccgcaaaaataacaagaatcccggagattacaggcctgacattactcatcagtcccttctatcaattttggatagcccactaaataaagctgggagattgcgatcagtatacataaggactgaaaaaggtgttcttatagaggttaagccctttgttcgtattccaagaacattcaaacgctttgctggtgtcatgttggaactgcttcaaaaattgagcatatctgctgttggcaagcgcgagaaacttctccgaaccatcaaaaaccctgtcacacagtatttgcctatcaactcacgaaaaataggtctatcatatagttcagaaaagcttgtagatatggatgactacgtatcaactgttaccagcaatatggaccttgtctttgtggtagtcttactagttcaacttttaatttctctgcctattgtctcggttggagcaatggcccatgggaagattgagacagattatacagaagattatgtagcaatttcggggtaccctctaagtgctgcttattgtattacaaggattactggcgcccttgagagaaagtggaagattttgtga

SEQ ID NO: 15141 - DNA, 189 bp, Glycine max
  Peptide Sequence Number=SeqID_106826
atggctcctgacactgttgacgaattcctcatacactttctagctttcaggacatggttcattgaatccaccctagttaacgaggtgggttattttttcgctagcggctacaacttgtgtagggggaataacgaatcggaggatgagacagttattggccagggaagaagaggaatggacagacactag

SEQ ID NO: 15142 - DNA, 924 bp, Glycine max
  Peptide Sequence Number=SeqID_106827
atggagggaacaggagcaggaaccgcaacagggtgttacaagtgcggcaaacctggtcactggtcacgagattgccctttctccgctcccaatccaaaccctaactctaacaccgccaccactcccaatcccaatactccaaatccttcttcgtcttctttcaagtccagatccgccaccgaaaagcccaagaagctcccccgaacaaaacccaaactcacaccggagcttcttctctccgacgacggcctcggttacgtcctccgctatttccctcgcgagttcaaataccgtggtcgcggccacgaggttcgcgatttgggtaatctgcttcggttgtacaccgaatggcactctcgcttgctcccttattactctttcaatcagtttgttcacaaagtagagaaagttgctgctactaggcgtgtaaagacttgccttagagaattgagagaaagagttgcaagtggtggagatccaacaaaactgcgtgaaccacctgttgtgcatgacattccatctgatgagcacggattttctgtatctgctgaagatgggggagcaactcatcaagaggcagatttgtttgcagaattcgaaaatgttaatgacattcaggaagatatgcttaatgatatatatgataaagctactgaagaaccttctcagtccatgcacaatgtgattggcactagcatggcttcagaaagtaacgcaactgaaaagacatcagaggaaaatggatccagccagtctggcaaagctgagataacagaagaacagagagcccgtatggaagcaaataggttgaaggcactagaaaggcgagctgagataacagaagagcaaagagctcgtatggaagcaaataggttgaaggcactagaaaggcgtgctgccttatcacaggcctcccaactttga

SEQ ID NO: 15143 - DNA, 357 bp, Glycine max
  Peptide Sequence Number=SeqID_106828
atggaaataaatttggggaaacttgcatttgacattgattttcatccctcagataatcttgttgctgccggtctaattaccggtcaccttcacctataccgttatagccctgatactgtccctgtgaggctgttggaagtccatgctcacactgagtcttgcagggctgctcgattcatcaacagtggacgtgcactcttgacaggttcttcagattgctcgatactggctacagatgtggaaactggttctacaattgcccgtgttgataatgctcatgaatctgcggtcaatagattgataaacttgactgagtcaactgttgtctcaggagataatgatggttgtataaagtga

SEQ ID NO: 15144 - DNA, 789 bp, Glycine max
  Peptide Sequence Number=SeqID_106829
atgcagatccaaacacgctctatgtatgattataatcatagccaaatgatgatgtcatcttctgcatcatcccctccaacgctaggctacattcagcatccaatttccaaattggacacgctagctggcatagcaatcaagtatggtgttgaggttgcggacataaaaaagatgaatggactagttactgacagccagatgtttgctcttaagtctattggcattccactaaatggaaagcaccctccgcccattattacaggatatgatgataacacagacaacagtccagctgctgataatgcaaagtccctgagaaggaagtcctccgagcagaagctctccccggtcatgagctgtttacgaagtcactacggaactaaaccgacaatgaagaaatctgtatctgaaatctttagcatggtggagtacgaaaaaagggcttcaaaatgttcagaaaatggttcattctacaagaaatcaccaatgtcccctcaacatcatagtcatcacaaaaaatctcatagtttggcgaacgaaactttggatgacattatggaagttgtaaaagccagaagaagtgattctgataggagtggtacacttatccggaggagttataaatctgaagctaaccttcagcgtattccagagttgctcttgaagcaggattgtaataacagtaatggtagcttttcattttcagcaagatcagcaaagggactagctcagaggcagaaatctggtagccgaattgcactgacagcttattcgaatcacgtggtttaa

SEQ ID NO: 15145 - DNA, 450 bp, Glycine max
  Peptide Sequence Number=SeqID_106830
atgaggtcgaaggaatgcttagatgttggttttgaagatttggagcagatgctgggagatgagattggaaaaggagcttatggtcgagtttacaaaggtttggacctggagaatggagattttgttgccattaaacaagtttctttggagaatattgctcaggaggatctcaacattatcatggatgctgaggagcaaacacaagtggcctggtgcagatcggaaacagaccaccagagtagacaaggagacactgtccctgatgcaaatgctgttgcagctgcagatagagaggagaatgcaagtttcactacctcatcgttggcagccacaattgttttcctttcaaagaggatatggggaagtaaactgaagaaggcacagatgaattacagaacgagatgtaggaagaaggagacaagtgatgacccaaggcaaaagaagccctag

SEQ ID NO: 15146 - DNA, 2466 bp, Glycine max
  Peptide Sequence Number=SeqID_106831
atggaggaggatgcagcacacttattcctacattgcagcaaaattctccctatatggtgggaatctatgtcttgggtgaacgctcttggtgcctttccgcagaatccaaggcaacatttctctcaacatgtgactgttttggctgatggaattagggttaataggtggaagtgctggtggttggcttttatatgccagcttttggttcccatcgagactgttttaagtctgatctatggaatcacttgtctggaatattacaactttgtaatctttgtacctctagcacatagaagggatgactgggcttggaaaccagacccaagtggtcaatgctcagcaaaaagtgcttatgatgtgttgaggggagacataataaaggggactgatgatgcaactggtgccagaccatattctgggaaagttggaccagatgatgcagacaaagttgacatggcatacagggttgttgcagatcacatcagaactctttcatttgccattgctgatgggtctcgtcctggtaatgatggtcgtgagtatgttctgagacgtatactccgtcgagctgttcggtatggacgtgaagtgctaaaagctaaagagggtttttttaatgggcttgtaagtgttgtggtgaatgtgatgggtgatgttttcccggagctaaaacaacaggaaacacacattcggaatataattgaagaggaggaggaaagttttgggagaaccttaattaagggaattgagaaatttgaggcagctgttcgacaagttcagggaaacatactgagtggggaggcaactactcccccccccaggttcttgcaagaagcatttgtcttgtgggatacatatgggtttccattagatctcactcagcttatggctgaagaaaagggattagttgttgatgtcaaaggttttgatagtgctatggaagctgcaagagagagatccagaagtgctcaaacaaagcaagctggtggtgccattgtcatggatgccgatgctacctcagctttgcacaaaaggggcattgtcccaacaaatgatagcttcaaatatgcttggttcaaggaccatgagagtgtggtaaaagcaatatatactggttctgagtttgttgatactgttaataccggtgatgatattggtgtagttctggagtctacaagcttctatgctgagcaaggtggtcagttttatttgcttcagaaaaagatttttgatactggatcacttgagggcccacatgctttatttgaagtgcgtaatgttcaagtttatggaggctttgttcttcacattggtaatgggactggtgtctcagttggcgacaaagtagtgtgcaaggttgattatggaagacgcgcccttatagcccctaaccatacctgcacacacatgttaaattttgcccttagggaagtacttggtgatcatgttgaccagaaaggatccattgttcttgctgaaaaattgagatttgacttttctcatggcaagcctattgaagctgacaatttaaggagaattgaatcaattgttaatgagcaaattaaagctgagttggatgtaagtgcaaaagaggcaactcttgctgaagccaagggtatcaatggtttgcgagctgtttttggggaagtctatcctgatcctgttagagttgtgtcaattggacaaaaagttgaggatctccttgctgaccccaagaatgaaaaatggttatctatttcatcagagttatgtggaggtacccatatttcaaacacacgagaggcaaaagcttttgcacttttatctgaggagggaattgcaaaaggaatacgcagaataacagctgttacaactgatcgtgcgtatgacgcaatgaaagtggcagatgaatttgagcagcaagtagatgatgcggctaagttagtaggaactttgctagaagagaaagtttcatcattgaaaagcaatattgaaactttatctattcctgctgccaagaaagctgacatcaagatcaagatagttcgacttcaggatcaagtaagaaaagcacaaaagcaggtcgctgaggaaaacaagcgtaaagctgtaatgattacagcagagaaggctgaacttgctgcttcaaatgggaaaacattttgtatatctcttgttgatgttggtctggatgtagctgcagttcgtgaggctgttacaaaagtcatggaccagaagggcttatctgtgatggtttttagcacggacgaatctacgaacaaggctgtagtttgtgccggggtgccagagaaaggaggtaaaggtaatctggatgtggcagattggctgagtaatgctttggggcctctaaaagggagatgtggtaaaggaaaaggtggtcttgccacgggtcagggtacagaggcatcacatgtaaacgaggctatagatcttgcagaaaaatttgcgtcgatgaaattgagttaa

SEQ ID NO: 15147 - DNA, 1860 bp, Glycine max
  Peptide Sequence Number=SeqID_106832
atgtggatttattgcaggcctttaactaaaggtcagagaggagaggtatatgaggttaatggagatcgagttgctgtcatcttggatattaatgaagatagggtcaataagggcgaggtggagaatcttaatgatgatcatacaaaacccccaatttattggatacatgttaaggacattgagaatgatcttgatgctcaatcacaggattgctacatagcagtggaggctttatgtgaggttttgcatcacagacagcctcttattgtctattttccggacagttcacaatggttacataaagccgttcctaagtcaaacagaaatgagttttttcataaggttgaggagatgtttgaccggttatctggccctatagtattcatttgtgggcaaaacaaagttcagtcaggatcaaaggagaaagaagaattcacaatgattcttccaaactttggacgtgttgctaagctgcctctttctctgaagcgtttgactgagggaattaaaggggacaagacatcagaagatgatgaaattaacaagctcttctccaatgttttgagtatgcatccacctaaggatgagaatctgctggcaacatttaagaaacaacttgaggaagataagaaaattgtgacttcacgtagtaatttgaatgtattacggaaggttctcgaagaacatcagctatcatgcatggaccttttgcatgtaaatactgatggcatctttttgacaaagcataaagctgaaaaagtggtaggctgggcaaaaaatcattacttgtcatcatgcttgcttccttctgttaaaggagaaagattgtgcctacctcgtgaaagtctcaagattgaagggccaggaaactatgtcacggaagccttctcaaagcctcaaggcatgaaccttgcaaaggatgagtttgagagcaatttcatttcagctgtagtacctcctggtgaaattggggtgaagtttgatgacataggtgctcttgaagatgtgaaaaaggcacttaatgaacttgttattcttccaatgagaaggccagagcttttctctcgtgggaatctgttacggccctgtaaaggaatattactttttggtcctcctggcactgggaaaacccttctggccaaggcacttgcaaccgaagctggtgcaaattttatcagcataactggttcgacccttacttcaaagtggtttggagatgctgaaaaactaaccaaagcgcttttctcatttgccagcaagcttgctcctgtcattgtatttgtcgatgaagttgacagtctgcttggagctcgaggtggtgcttttgagcatgaggccactagaagaatgaggaacgagttcatggcagcttgggatggattgaggtcaaaagaaaaccaaagaatccttattctgggtgcaactaaccggccatttgaccttgatgatgctgttattcgtcgtttaccaagaaggatatatgttgatttaccagatgctgaaaatcgaatgaagattttaagaatctttcttgcacaagaaaatttgaattctgattttcagtttgacaaacttgctaacttgactgatggatactctggcagtgatttgaagaacctctgtattgctgcggcatatagacctgttcaagaactcttagaggaagaaaagaagggagccagtaatgatacaacttcgatactaaggcctcttaatttggatgattttattcaggcaaaatccaaggtgggtccatcagttgcatatgatgcaacaagcatgaatgagttgaggaagtggaacgaaatgtacggagaaggcggtagtagaacaaaagcgccgtttggatttgggacctga

SEQ ID NO: 15148 - DNA, 588 bp, Glycine max
  Peptide Sequence Number=SeqID_106833
atgggttcacaggaaaggtgtgctatacaagttactgcatcaacacaattgtctgaggagaatttcaatggaagatcaaacatgtcaattgtcaaacctgtagaagacaaggtctctgatttatgtggcaaaatggacaaatccattgaacatggaagagtacaacaacacgatgccctcatactccacctcgctctgctagtgccgcattgggccctcgttgctgctgtgtatgggtcaccactgttaccgtcgcaattcgattgttgctatcataagaaggcaattgaaaaggagaaaagaaaagctgaggcactggcctctggaattgactggctaagtgatgattcagatgatgagcctcagaaagaaaacagagaacctcccttgtgtaatcttctcaaagatgaagaacatcaccagctaataattgatgcattagcatccttgcaaaggtattgggaagcactggagattattaatctctttctaagattggcccatacatctctgtctactgaaaaaaaagaggagcttcgatctcttggagctcgtaagtcccgaaccctgacaggcttgtacttctag

SEQ ID NO: 15149 - DNA, 963 bp, Glycine max
  Peptide Sequence Number=SeqID_106834
atggcaaatgctggaaatctgatatcaccaaggaactttaatccaataatattcaatccataccactatgcaactaagctcaaaaccttgaggttgctctctcggtttcactcttacaacaataatgccactgtcactgcttccaaaagaaaggatgacttgcaatctccattgattgggaagaacacgagcagggctcctcgccgtctgatcacaatatcaccaggtgatggcaaatatcatggggattggacttgtgactatcgcgtctctttgcacgacctagagttacaggatttgattgaagatgataataactcacgtaaggatgctcaagttttcatcaatctctctatccaaaagtccgttgaacatggtaatgccagcatgctagctttggtttatcggtggatggaagagtcaccacatccttcactagaaaatgtagcacctgttcttctccgtattgccgacagctgtaggggagggatccgagactataatggttcggttattgtttcatttgctttcaagttgggtgtttgttcgattacgcaagctgagctttgggccgttgtgcttggaattcaaaatagcatgttagagcttatgaggatattggtggtcttttctcccggtgtcacacacaccaggaaccaggaggcaaatcaaattgatgcaaaatttaacgtatgggttcttatagcacgtagagatgaccgcaagataccgctacctgatattggaggtgaccctaatgtgatttatgttagaccgggatacgaagttgatcttgattctcttgtacaagatgccatccgattaaactctgtagtaaaagatacttgctcagaattgtgcgagaaatctgagggtacaatacaatatataactggacaaggccaagcttctgttgataaaaggtggtcaagactattggaactaaagaaagaaaatttatga

SEQ ID NO: 15150 - DNA, 570 bp, Glycine max
  Peptide Sequence Number=SeqID_106835
atgcttctggacaagaatgatactcaggaaacccattatgaggttctcaatgtaaaggaagatgcaaattatgaagaaattcgtgctagttatagaagtgctgtactcagcttacatcctgataagctattgaagacgtccgagacatccagcagcaatcaaacagcggaagagagatttcttaaagtacaaaaggcgtgggagattctgagtaattcaagctcccgctcgttttatgataatgacctgcgtagttcaaggcaggatgtcttggctgctgatgttgccgaagatttgagcttgcaggatatgatgattgaagatgatggagaagcattggaactgttttaccaatgcagatgtggtgattacttctctgtagactcgttggaattgaagaatatgggatattccttattgagggagggaagtgggatatctataatgaatgttgatacatcaccaggatcagtgattcttccttgtggatcttgttcgttaaaagctcgtttgctaatcaatatggatcggtctgtcaccgggaaaattcctggggcagaaatctggagt

SEQ ID NO: 15151 - DNA, 1068 bp, Glycine max
  Peptide Sequence Number=SeqID_106836
atggttactctgaatgctcctgctattaatactggtggtcgtgatgctgctgctcttaaaccctctagtctacagaactcgccatcggctttggatttgatcaagaagaaattgcaggactcaggaacacctgttgcttcctcttctattcctgccccatctgtacaaacaggacctgaatcaaatggttcaaaaacagttgattctacagctaagggcttgcaagtagataataacaaagataaagcaaaagatactaatggtgatgctaatgtctctgatacatcctcagattctgaagatgaagataatgggccttcgaaggaggagtgcatcattcaatttaaggagatgcttaaggagcgaggagtggtaccattctcaaagtgggagaaagaattgccaaagatagtatttgatccacgttttaaggccatcccaagttattctgctaggagatccttgtttgagcattatgttaaaactcgtgcagaagaagaacgtaaagaaaaacgtgctgcacagaaggctgcaattgaaggatttaagcggttactggatgaagcctcagaagatattaattacaatactgattatcaaactttccggaagaaatggagaaatgatccacggtttgaggcattggaccgcaaggaacaagagcacctattgaatgaaagagtgcttcctttgaagaaagctgctgaagaaaaggctcaagcaatgcgtgcagctgctgctgccagttttaagtcaatgcttaaagagcgaggagatatatcttttaactcccgttggtccagggtcaaagaaaatttaagggatgacccaagatataaatgtgtgaggcatgaggatagggaagttttgttcaatgagtatatatctgaactgaaagctgctgaacatgcagcagaaagagagaccaaagctaaaatggaggagcaggtattagctgcaaaatacttgaagttgaaacttgtttataggacaagctcagggaaagagaacgggagctgcgcaaaagaaaggaaagagaagaacaggaaatggaaagggtgcgactaa

SEQ ID NO: 15152 - DNA, 1890 bp, Glycine max
  Peptide Sequence Number=SeqID_106837
atggcggagaaagcggcggcgccaccaccgtcgaagcctcttacaactcaggagtgggaaaccctaatcgaaggcttccagaacggcgtgcactgcaaatggagctctctggatcctctcttcgatccccttctctcctctctgcaccggaaggacttccctctctccctcaagctccaactcctcgtcttcctcgacgaattctctctatccttcttcacctcacataaccacctccaccgtctcgtcgacgcgctcaaaaccgtcgttcacgcgcccctcgaagccgccgccccttcagcttccaccttcaaggaccaattcatggtctccaccacctcaattctcatctgcgcatctgaaaacgtcgttgtcgaggctcaaacggagaataacttggtcgagttcttgttaacggtcataaaccggccgaatttcggttcggaccggcacacgcgcggcgtcgcgtgcgaatgcctcagggaattggagcggtggaaaccgggattgctttcggatgtggttggacacttgtggagtctgtgccagaacgagcgaactcacgcttcacagtattacctcctgctcttcacttcggtgattcatagcatcgtcgctcggaaactcaacgtctcgattctcaccacgtcggttccgatggttccgttcaatgcgccaaattgcgtgacggattcgggttcgggttcaagttcagatttaggttcgggattgaatgtgaaggagttgaggagggcgttagcgtttttgctggagtggccgcaagtgatgactcctagcgggatgatggagtttatgtgtatgataattcccgtggctgtggcgttggaattgcaaccttccatgctgaaggtgcagttgtttggaatgattcattcctttgaccctatcctgtgtcatgtcgttttgagcatgtatctgcgtttcttgaatgcgtttgatggtcaagagggagaggtttctcgcaggctcttgttgatttccagagaatctcagcattatttggtgtttcgcttgttggctctgcactggctgttgggtttcaatcgaatgattttcaacaaggcaaagccttcccttgaattgtgctccactttctttcctgttttgtttgatcctctggctttgaaagccttgaagcttgaccttcttgccttttgctcggtttgtgctcgtgtattgaggctcaaaggtggttctcatgagctaattgatccggtgaggctgtttgaggatggccttgtttgtgtgtcttctttcaaatggttgcctcctgggagcacagagactgctgttgcagtccgcacctcccataagtttctgattgcttcatcgtctcattccgataatgatccttccaccacgagggatctgttggactctgcgatatttcgcactttgcaggggttgcttgtgaacatgatgttggagagtaggagactggttcccattgttgttgcttttgttgaccgtttactctcgtgtcaaaagcattcttggttgggtgagtgcttacttcagaagtttgataagcacttgcttccaaatgtgaggatggattataagttggtttactgcttcccaatatttgaaagaattgctgaaaatcagacaatacctccttgtgcattgttagagctgctcacaaacttcatgattttccttgtggagaaacatggcccagatacagggatgaaatcatggtcccagggaagtcgagctcttggaatttgccgaactatgttgatgcatcaccatagctctagattgttcctaagactatctcgtctactttcttttacatgtctctattttcctgatttggaagtccgtgataattcaaggtattacattatgaattgctgctcttga

SEQ ID NO: 15153 - DNA, 444 bp, Glycine max
  Peptide Sequence Number=SeqID_106838
gttgttgtaactgagaacaagagagggtacatctcttgtggatcagttctagtggagggtacatccactaagttgttcaaagagaacaagggagggtacatcccttgtggatctttgcttgtaaaggattttacaagcttaaaaagaaatctcaaggaccgcaggtcgcttggggactggatgaccttcgtaactcttgaggtacgtgctagaggaggagctgcaaccacttttgagaaatctcttgaggccactcctgagcctccaacactagttgcagatacaacctcaccgcaacaggcagcagacccgtccactcctgaggatcagactacaccagtcatgcctccgaacgcctctcctataactactcttgtggttcattttacggacaaggaggatgttcagacacaggacactcaggaccaatcacatgacttttaa

SEQ ID NO: 15154 - DNA, 525 bp, Glycine max
  Peptide Sequence Number=SeqID_106839
atggttctacatgaaaaaaccattggtgttaatcttgaagatgatgattcaacctttgatacttgtcagactcttttctccacatacatgcataccgactatggagaagaaaaagtcgatgacgtccaagaaaatcataatgatcctgatgaaggagaattaattaacatcatggctacaccactgagctcccctcctcttgagtcaacaccttcaccgtttatgttgaagaggattagaaaagccacacaactcagatccttgtctgccagacctgtgggggtggagataccagtggttcatgttgatcttaccactgagaaagctctagcagatgacaaggatgatggcgatgacacagtctatgagaagtacgagcaccctgatcgtgttcgtactattggagtaagtgtgaagatcaaacaatactttggaccaacttcagcaggctcccgcacatctatgttgatcatccctgaagagctggatcgactcaaacaaaatattaaggatgagctaacatag

SEQ ID NO: 15155 - DNA, 210 bp, Glycine max
  Peptide Sequence Number=SeqID_106840
atgaaacccgaatcttggaggctggcttgtcaaactattgtcggaaacaaagaaaactctggcaagatgtctcaaagaatgaggcataaaaatattgagagctcaagttgttgttcaaaggattcctcagtggaagaagtaatagaccatgctaagcaggacctctggattcttagaaagaagagcttcatatgttcctcctcaatttaa

SEQ ID NO: 15156 - DNA, 147 bp, Glycine max
  Peptide Sequence Number=SeqID_106841
atggtaaaaggaaaaaacggtaaagaaattcaaaaagaactcgaaataacaaatggctgccgaaagcgggaagtgaggggtcgtacccgtggagaaagcgaaagcaataagtggagagaagttgttgaggaacatcatgttggataa

SEQ ID NO: 15157 - DNA, 549 bp, Glycine max
  Peptide Sequence Number=SeqID_106842
atgcaagaggtaaagcttgataagcttagtcttttggatgtatggaaacaaggctttcttgggataaattccttcaattatccctacaactacactaggcaagaagactgttgctcccaaccccaatgtgtagaagcaaagcttcatgaagaatcaagattgattcaaagatgttttgatgataacaaagatgatgacaaaggtgatgacaaaaagctcaaaggtcaatcaaagaatgagttgaagatgttcaagatagaatcaagaacacttcaagattcaagaggaaaggtacatctacttgggttgttgactgagaacaagagagggtacatctcttgtggatcagttctagtggagggtacatccattaggttcaaagagaacacgggagggtacatcccttgtggatctttgcttgctaaccgctaccaagacaaggagctactaattgaggaagatgaagatgctccaccgaccagatatgtcaaggcttatcctagaagacttttcaaacatgagcttgaggctttgaagcaaaagatttag

SEQ ID NO: 15158 - DNA, 536 bp, Glycine max
  Peptide Sequence Number=SeqID_106843
atgggatcaagtcaggcgccttcgtttaaaaagaggttctatcaagtcaagatcaagagcctaggagtcgccagtctgaaagagttaggacagttgatgggtcagctccagcgacaagccttttgcaaagcttatggtaagatctgggacctaaccatggtagtggtctccatggaggccattgcctccctcacccaatattatgaccagcctttgaggtgcttcacctttggggacttccagttaacacccacggtggaagagtttgaagagatcctgggatgccctttgggaggaaggaaaccatatctcttctcgggattctatctctccttagctagaatttctaaaatagttaaaatctcgacacatgaattggaccgtgggaagcaagtcaaaaatggggtggttggggtaccaaggaaatgtttggaagcaaaggcgagagtcttggcaagtcaagatgaatgggccccgttcatggacatcctagcacttttgatcttcgaggtggtcttctttccaaatgtggatgg

SEQ ID NO: 15159 - DNA, 537 bp, Glycine max
  Peptide Sequence Number=SeqID_106844
atggatgacactgctgctcacaactccgacctccctctgcctaagtgccagttggtgtgtgccatcctgacacagatgagcattcacgtggcccaggtgattgctgatgccatttatttgtttgcaggaatggcacctactaggcacccattggacccggagaagtccaatagggccctagggtttccgactttgatcacgggcctctgccagttctacggagtgcaggtcgcccccagcaaggccgcgggcgcaccgccaccacctcggcaggccaatccggctgggccactgagcgtggagcggtatctacagcatttggttcgccaacaggcggccaaccatcgaggacaggggcagggttccgcccctttcgtatgccctaccccagagcagtttggggctgaggtcgcatggcctggagactggcccgaggcccaggcatgggaggagcctgcagaatcccctggtaagacggatgaaccccgtatggacgaggatatggctgacctgatcggtttcttgggagggagctga

SEQ ID NO: 15160 - DNA, 723 bp, Glycine max
  Peptide Sequence Number=SeqID_106845
atggctagcaacccctccagagctcagaagaaggccaagcttgatacatggttcacaaacgagaataaggagaatgacttcaagatgctatacacagtgaagaatatgagaatacccaagtttctagacttggagtggttttctcagcaagggtttaactttcctgatttgctagaagcacagggtttgtccaagcttgttcagatgaaaggaactttctacctggtgttggtgaaagttttctatacttgtgtctacgctgatatggaaggtaatatgttttctactgttaatggtgtagaaatggttattgaagctgcagttaggaaggcaatagccagactagacataggtggagtctgcaagtttgaagaatctattgatggttacagtaagatgcaaaattatagaggtatgctccttgacctagtaaggaatttgaggaatcacctaggtgtatgtggtttaactattgaagacagaatgctcatgtacctcataacatacattctcacaccaaggtccagcaaccacgcacagatgaaagaagcagaagatgaagctcggcaagagcatacaaaccaatggagtccttttgagtctcttatgatttcaaagatggatgccatgcttcaccttcatcaagagcactcagttgatggtgggaactgtaaattggctgtgattgcttgtaaagattctttatgcatagtgaaaatctaa

SEQ ID NO: 15161 - DNA, 1135 bp, Glycine max
  Peptide Sequence Number=SeqID_106846
atgacacccatcgttaagcaatccgtgaagttccgcgacatgccggaagtcggaaggaagcattgttgtgcaatccgtaaagctccgcaacatcctagaagtcaaagaagggattgttgcgcaatccataaggcaaaagggggttgttctaaggatccctcatcctcctggctatgcattttagccgttttgggtgaaaaaaattgttttcgtggagaaaatccaagtcgagatgcttccgtaatgcttccgagacgtttccgtgagcgaatccgtgaaggttttccgtcgttcttcatcgttcttcatctgttcttcattcgttcttcgttcgttcttcgttcttcaatagacgcacccgtgagtctcgcgtcgccctcccgccgaaggggattaagaggccaagggtctcttgttgtaaagaaatctgaacacaaaggaagggttgtccttgtgtggttcagaacttgtaaagggattttacaagatagtggaactctcaagcgggttgcttggggactggacgtaggcacaagggagttcttgtttaaaagaaatcttgggttgttgggccacttgtccaacattgcactgcctccggagcctctggttggtcccttaggtcctcgagtaagcacaaaggagagttatgttgatccctcaggaaatgatcctgagacgggtgactcatacaggtgcggcttgtacatcgaagtaaatcctacccgcctggttgccctgagaagagtttatgagggatccactattgttcatgacactcctttgttgcctggccaagtaaaggtgggtgtggaggaagttaaagatccagatgctcccgttcttgtacccactgatgaggtttccttagtggggcaggcaattcacaccttccttgcttggccgacacatctagtcaagcctttatcgcagcagacagttgtgtctccggaaaaaccacctcaaatgctagatccgaaggtcaatgatccgctttatctgatgacattgaccatcccagagcttttcttgaggccttaccaggttacatgggatgccaccatgttcggggtctttaatccagacttcccgctctacataaagcatgaagacctctccaaaatcgcacatggtg

SEQ ID NO: 15162 - DNA, 84 bp, Glycine max
  Peptide Sequence Number=SeqID_106847
atggaagtaaggacacttctccatcgacatctagaaagctttgtctgcaccatcaacctcaaagagtgcaatattgacctctga

SEQ ID NO: 15163 - DNA, 345 bp, Glycine max
  Peptide Sequence Number=SeqID_106848
atgaatgatgttgttgtagatgaccccttgcgtgagttgattaagagcctagttgacatttatgagaagcctgttcaattggtgtgggatgttagtaaatttggaattccaaatgtagatgcatccttgttcttaacatgtgctgatgtcaatgaaataatatcaagcgtacaatgtttgaacatagctatactacagttgtcgaccatagtaatagcttgggtcatggatcggtgtatagattccttgagccgcagtcaatactcaatgcaaaggatagacgtgaccaatgtcaagattacattgagaaatggcttaaggaattgcaccgagagatctatctag

SEQ ID NO: 15164 - DNA, 339 bp, Glycine max
  Peptide Sequence Number=SeqID_106849
atggcagaatcgtcaaagaagagaaagggatcatcctcctccaccgttgctgctggccatcgccgtcacggaccatccgaagcacccacagcacctatccatccttccttgtcatctccaagatcatccactctattttcttccgatgatcaacgtatatggtacctctctcaattttcttctaggatcattttagaccctaagtacctagacatagatttcttcaatgatgagacatttgattgttatcaagtgtttcaaaattctggtttcgttgatttcatgtctttaaaatttccttattatcctgaacttgtcaaagtctttactgcaatttaa

SEQ ID NO: 15165 - DNA, 249 bp, Glycine max
  Peptide Sequence Number=SeqID_106850
atgtgcagaaagccctacatacctgctggaacatcgacggactctgacgttccctccctcatcctctcatcgtcaagcctttgtggtcgtggcggtggtgctgcggtggctgtaaggtggtgctgcaaatatggttcgaataagatgaacagggggaaggtggattttttagtggttgcacgtgcggagaagaacaaggtagaaggaagagagaggaagggaaaagaaggatcatggtgggagttatga

SEQ ID NO: 15166 - DNA, 648 bp, Glycine max
  Peptide Sequence Number=SeqID_106851
atggcttctgcaatcaacaattctgatcctcctcctcctccaccaccaacttcaactccagtggttgattcttctattccggtgaatgtgacggggaatgcgacagagattcctgtttctgcaacaccaatccaaacagtgttaccaatggcgacaccaattccacagccgattctgacgactactccgactagtgcaaccggtgtgacaccatcgccgcaatcctctacttccttctcgcattcaatttctgcgaagttgacaaattccaactacttgttttggtgccagcaagtagagccagtgctgaaaggctacctcatgaatgagtccactgtgtctttgatatgcagtaagtttgaacctctttccattgatgaggtcaaaactctgatgttaggtcatgaagctaggcttgataagttttataaaaagaattcctcagttactgttaatttgactcaaggagcttcatcttcagacagttctgttcaacctattcaagcagtccaggttcctaaatcagtggttccagctcctacaacaacaacaacaacaacgccttatcccactaggtggggtcggctacatggatcaacttccgccataatgttctatcaagtaccatacttctatccaaatcattaa

SEQ ID NO: 15167 - DNA, 126 bp, Glycine max
  Peptide Sequence Number=SeqID_106852
atgggcaagattggtgaagtgcagaattcattgactcggatgagttgtacagaagtgttgagcgagtgtcaactcgctaagcgcaccgccttcatcctccaggctgagcgagaagactggcactaa

SEQ ID NO: 15168 - DNA, 654 bp, Glycine max
  Peptide Sequence Number=SeqID_106853
atggctgcgtctctcttccttccctcttctccgttcaaactcaaccctccaacgcccaactctgttacctcgctgcttccgtttccgtttccgtttccagccccaacgtgcgaaccggtcctgatgaatgtcgatcttgttgcttccattctctctaagacaggaaaactcaaggctctggatagtgaatggattcaagttatatttgaagcgcctgaattgaaggttaggattgggttccagaggttccctgtttgtttttcaaagaatatgaaatcaaaatgtgataagaaaaaattccttcaggccttcagtgaaagttctgtcaagctagcctctggctcgcctgggcccccaaattacttcaaggtgaaggaaccagctcgcttgggcgagccagttactttaggagtaagcatcagctcgcctgggcgagctgccattgccccaagtgcccattttcctataaataggtgtgctagggaggatgaggagaagttccaaggttcagtacttgagggaattgaaagaattaagaaagaagaagaagaagaagaaagaagaggaaatgaagctgaggcgctgccaaatcacgactgtgatcaatctctagatcgttcctcgttcggtattctttgtgctaccgttggttag

SEQ ID NO: 15169 - DNA, 1683 bp, Glycine max
  Peptide Sequence Number=SeqID_106854
atgggggatgagaaaggtgagaagaaagaaactagtcccagtgccagtgccagtgccgggaacgataagaagaacgagaaaaagaagaaaggttttatttcgcgaatttggaacgcgatattcaggtccaaccgcgacgattttgagaagaggcttcagtatatttccaaagaggaaaacgcggttgtgactagaatgagcaatagatctcgctcttggaggcgaacctctcgccaacttattctattctctgttttatttgagggtggatgtaaggttttaaattgcagtcgctgtcgcggagtctctgaaaatcttgacattgtgaaaatttgtggccgcaattgccgtggcgatgtggattggtttttggaggaattggggttaaaaaagttatttgtgtttgggaatgatgcttggcattctgggaatgctgttttaaaagtcattgctgtaggatatgctattatgacaacaagatcaatggatatgaattggaaaatgagggcaatccgagttttgccaatgtttcttttgcctgccttgtcatcagctacatatactgcatttgtcagcttcaccaggattcctccgtctcaactggcagatgaaacaacaatcctcccattgttatctttcctccaaccggcagaggaaacacccatcctaatcctcagtcctcttgtccaactacttcagctggcagaggaaactttcccactactcaatcctcgtggtttcttatttcctgtccctcttgagaaagcctacgatgaaatcgagctcaagcaaatttcagaagtttttcaagtgctgggattggattctcttggaggagatttgtcagattgggatgttctttcttcaagttggatccatttggagttatacaagatggaccagaaaattcttgaaagtcttagagctgaaaggaaggcaaaaattgatgagctcaaagagaagacaaattattacattactcaacaactcattcagagatatgatacagatcctgcagccaaggcagctgctgcaactgctttagcatccaagttgggtgcagattcaggtttgaaagtgtatgtgggggatgaatcttctggtgcttcaacagggaagaccaaggatgttgaagttgttcagtctagtgggcttcgaaatcgcaaacaagtcacttctagatccactagttcagggacaactacaccaaattattctgatcaacaatttgttggttctgggaaaattgatcaaacccaaactcctgagcataatcagcttgtagttgttgaacatcacaatcctcaaagttcaacaatgaatgatggaggatggattgctcgaattgcagcattgcttgtgggtgaggatccaacacagtcttatgcgctcgtatgcggtaactgccgcatgcataatggtcttgctcggaaggaggatttcccatttattacttattactgcccacattgtcacgccctgaacaaaccaaagcaatcggatgagcgtacatctggtttaaattcccaaaacactcagtctcctaaagcagatgacagggaagaagttaaaaatgctagtgattctgaatccgagagtgtaataagaagcgataatcccgtaaatactagccctgagattgaggaagtttctgaaccggctatttcagtggagaaaaactag

SEQ ID NO: 15170 - DNA, 3291 bp, Glycine max
  Peptide Sequence Number=SeqID_106855
atgactagaccaacaactcgaagtaaaaataaaaggcagagacagggggatgatgatggtggtggcacttctgacatatggaggaaaattcacataacgggtgcggtgactgaagatgatatgaatcaactgtatatgatttggaagccagtctgttcaggctgtcgtgttaatactaaagacaacccgaattgcttctgtgcattggttccacctgcgaatggtacccgaaagtctggtttatggcagaagatggccgactttgtcgaaagtcttggtcccgacccaaatatggatcttcgtgtttctgatagttcacctgcagaaccggatgttttacaacaacaaccagtgttagatcaactgactcaactttttgtacatttgcatgctagtaaaatggctttcatagattcttctccatttgtaaaaacattggagctagacaatggaattcagcaggatagccacgagttcttgacattgcttctgtcattacttgagcgttgtttgagccattccaaaattgccaaggcaagaacaatagttcaagatctttttcgaggaagtgtgtctcataatccttttctcgttgtcggtcaaaagctaagatgcattggcactgatatggacagaggacatgacagtgacacagacgcagcagcacaacaaaatttgatgtgttcgcaatgtggaagagactctgaggcttcttccaaaatggaagacttctatgggttagagttgaatatcaagggactgaaaggtttagatgagagcctagatgattatcttgctattgaagagcttcatggagacaatcaatatttctgtgagtcatgtaaaacaagagttgatgctactcgcagcatcaagctgtgtacattgcctgataatacaatgaagaagaaagttacttctgcattttcatttcctgctgaacttgatatgcgccatagattgtctgagccatctcagtttgaattgatatatgacttgtcagctgtactgattcacaaaggaactgctgttaatagtggtcattacattgcccatatcaaggatgtaaacactgggcaatggtgggagtttgatgacgagaatgttactaacttgggttgccatccatttggggaaggaacttcttctacttctaaatctgttaagacagatgtacttcattctaattgctctgaagcaatgctagctgacagtaatggtttagatgccactcatgcgcaatctttgcttgtggagacattttcatctagtgatgcttacatgttgatgtaccatcttaagcatagcaaaaatgttggtgaaaaggggggaatcgtttatggtgctaaccttgaagtagagggcaatgcagttactgcacaagacagtgcttgtcttccttctcatttttgcaaagagattcaaaatttcaatgcttcatatcttgattcttgcgagcagtacaaacataggaaagagttagaattgagccatatcaatgagaggagacaggaagttcgatccattttagctgaagctcctactcaaccactggagcaaccgtatttttggatttgtagtgactggcttcgccagtgggctgacaacattattccaattgctcttgacaatacatctatccaatgttcacatgggaaagtcccagtgtcaaaggttacctcaatgaagcgattatcttctaaagcatgggataaattattgtctaaggaaactattgtcatatgtgggtctgaaggaggactggagtatggtgggggaccaactctttctcatgaagactgttgttgggattgtctgattgatggggctcagaatgtggtgtcagctgacacttatcgggatcaaagagaatcattgaagcgacttgcacgggatattctcgatggaaattgtgaagacggaatgtactatgtgtctagaccatggttgcagcaatggtggaaaagaaaagttgttgatgctccatctgaagctgatgctggaccaacagcagccatttgttgtccacatgggcaacttatgcctgagcaagctgttggtgctaagcggttgcttgttcctgaggatttctggcttttcttatataaagatgccatttctgtaaaacctgatgatcctctaggttgccctacttttcctttagactccagaaggtgttcccaatgcagtgatgaattatctgaagaggcttgcttggaggactctttgagattagtaaaacaaatgcaacgccaaaatcatgagaaattatttgttggtaaaagtatgccgctttctctacattgcaagtatttcttagttccttcttcgtggatttcaaaatggagaaattacattaatttggctgtcaagaattcagataaacctgaaactttagatggggtaatcgattcactgatgtgtgaaaagcattcacggctcattgaaaggcctcctgaactggttttcagacgtggtgctataattgccagagaatcttctgtaagtggcttaaccatcatatctgagaatgattggaaatgcttctgtgaagaatggagtggtattgagaccaaaggaatatctgcaagaattgagaatgttaatgattcagaaaatgctttgactggatcctgcagagagatgccaatatgtgaggatcaacttaacacttgggataaagtgaataatgaaagtgggaatggacacattgtgattaagacttgtcctgaggtttgtgaaagttgcgttggagaaaaggaaagctgtgagttaatgcagaaacttaactattgcaatcaggacattagtgtaattcttgtccgtggaaaggaggtccctaaatcaatcttagaggcttcaaagggctttgttgaaatagacaggcgggtttccaaacgttcccggaagactaaaaatgggagttccattagtctaaaagtttctgcttcaacatctatttaccagctgaaaatgatgatatgggaatcctttgcggttgtcaaagaaaaccagatactacaaaaaggtgatagaacaattgatgttgataatgaatatgctacgcttgtggatgcaaacatatttgctggagatcagattattgtgagggactccgagatccatgaaaatcgagatattgcagatgagctttgtgatgaggaaatggaaacacaacataccgaggcaggatttcgtggaacactcttaacatcgaacgtttcatctcaggaggttgcaagtgatggtggtcacatggtagttgatgtggggatttggcgtgacaagtag

SEQ ID NO: 15171 - DNA, 318 bp, Glycine max
  Peptide Sequence Number=SeqID_106856
atgataatctacacaacaacaccagctgccatccttctttttgaacaaaagcaccggcgaagagaatgggctctgactggaccggatgaggccagcatcgagcatagaagccatatgtctttccaatttggttttctggcagtaagggtatcagtatggcttcacgttgacaaagttagaatggggaaggagatggataaggtgagtgatggagcgatggggggtgaagaagatgaacttggggggttggtgcattgccggggacatgggctaaatgaaataaggcaaacacactttgggtttggaagtaacatttga

SEQ ID NO: 15172 - DNA, 435 bp, Glycine max
  Peptide Sequence Number=SeqID_106857
atgataaaagctttggaaaaaatttccacaaattggacaaaggcagttactgatgcaggagttcctgtggtggttcttgtaaaacttttgcactcaacacttagcatagcccttaatgcttcaagagttcatgacagaagcggtgcttcaagtgctgagcagatgatggaagctgttgtgtctaggtatgctatagggcctttatccaagtatctaaccagatcacagtctggcaaacttctttctgctttagctttggcctttgggagatctttcccagaatgtcgtgcattgataggtttacttgaagatcggccaactgaagaaatgaagggtggtggctatttgtgcattgcaaaagaactgctgctgtctccaaacgcagaagttgctgcacaagccatacattgcaagaatatgtgtcaaatgagttga

SEQ ID NO: 15173 - DNA, 522 bp, Glycine max
  Peptide Sequence Number=SeqID_106858
atggttagaacacgaggtttaggtcgtgctttagctagggttataggcagaggtagaccggatgagcatgatgcaattgatgttccccggaggcataggcctacagcatcagcccgtaggcaacaaatgactgaggatgtccctcatatggctgacgatgttcctcagatgagtgaagatgcacctcagatgattgcggacgtagatgcgactattgcagaggaattaggtcgtgatggtgctgaggggtcacatgctgatgagggattccctggtgagccacgtgacccatcagtgttgacttcatttgcggagcatgttgcacatgccatttggactggacaggagcgtcatgagccgaagttggtgtcgcacgggaggaaggtggctttaattgggaggccagtgcctgagattgaagggctggttgctgccacaggattaagtccattgatcgggtgttcagttgcaaccggtgatcctggacttattgatgtgccatcattttcttctattttctaa

SEQ ID NO: 15174 - DNA, 382 bp, Glycine max
  Peptide Sequence Number=SeqID_106859
atgactagagacaatccatctgacttacaaccctttgatcctgagatagctaggacatttcatagattagttaggcatcattttataccttttgatcatcctgagcattccattactggtgaatctgtgcattctgttattggtgattttgaacatcctgattttgagcattacaattttgagcattctgattatgagcattctgattttgaacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 15175 - DNA, 452 bp, Glycine max
  Peptide Sequence Number=SeqID_106860
tggtggctgggacgatgaggggtcacgtgctagcaaatctgaagttgggaacagcgcacgacactaatagtggtggtgatgcagtaaggtcaatgttgcacgacgaggtggtggtgtgtgaccttggtgttgggataagagggaggaacaagtggtggtcatcaaggaagttgattggcaaggaggccttgacgcctaaaggagtgtgcagactcgaagaatggcacgacaaggatgcactaatggtagagtcaaccttgcaagtaaagtccatcgatgcctgcttgaataacgtcgcgttaagaggaggtcggagagggcgaaagcaatggtcatgcttaacgaaaaatttgagatactgtctccaccaacaccaccataggttcagagttgaggtgcaaggaaagggaagggttgcgttaaatcacgaaggagaaggaaagggagctagg

SEQ ID NO: 15176 - DNA, 171 bp, Glycine max
  Peptide Sequence Number=SeqID_106861
atgaagaaagtcgttattggtatttgttatctttacctttccatgcaagtgtatcgccagcatgaatggcgagatacaccagtccttgacacgtggccggatatcgccaatggagctggcgagttcggtgtggatacctgtttacgctggaatttggtaaacaaccgctag

SEQ ID NO: 15177 - DNA, 525 bp, Glycine max
  Peptide Sequence Number=SeqID_106862
atggtggagttattcttggtcattttggaagctacaaaaagaaagaaagaaaacatgggttctgcttcaagagttgaaagtagcaactacgattactactttaaggaaaatggaactaggtggcataggatcatatataccacgttcttgcaaattcaagaactgttcctctcaaaggaaaccctaggaactgagccactaccaattatcatggttaggaccagaggattagatcgtgccttaggtcacgttactagtagaggagatcatgatgattccgatgatgctccgctgcgtcgacggcctaccacatctgcacagaggcagcgagtacctgtgactgcggcgcacgatgagccagtgctccctgcgccaaatgtagaggctgacgtattttcggatgacccgatggcaccagctaatgtagaggacattgggccagacattcctgatgacacaggtgcccaggctgcagaggatgaggatgagggatttctggggggtccgagcgacccatccgtgtag

SEQ ID NO: 15178 - DNA, 357 bp, Glycine max
  Peptide Sequence Number=SeqID_106863
atggcaaacgagatgaacaaagatgagtggatgtatgaaataatgtctgaacaagcggatatggattatgaaaatgaagaagcatgtggtgcgaatgaaccacatgttgattgttctaatgcgttcaatacttctcaggtgtttgagtgccgagaggatgttttgcggtgggctcgattcgttgctcatgaaaacagatttgtgacggtgattttaaggtcggatacaaacataggagtggcgagtatagatgtaggaaaaaagaatttatctgaagagacactgagactaggaaatgtgggtgtcccttcaagcttcgttgcaagccagtggttggaggagaaggctgaatggtga

SEQ ID NO: 15179 - DNA, 804 bp, Glycine max
  Peptide Sequence Number=SeqID_106864
atggctgccacggtgaaacaaatgtctttgatcgtgtcactgttcggcgtggtgtccttcattttgggtgttgttgctgaaaacaagaaggtaatgtttttaaatttcaattatgatagtggagatgcagacatccgaaaccttaataaaaacttcgtaccccattgcccagaggctcttcgctatgcgaaggttcaatatgatttctttttgaagagtgttgttgattctcttacctgttattctgcattaatcggtgatattgactctgttattcctgcggcaggaacacccgtgcctggtttggatggtgtctctgtcacctgcaagtacccagctgatccaactgttgcattggggtatctttctacagcatttcttgttgcatccactgtgactggatatctgtctttgttttacccttacaaaggaaagtctattccacaaggggttctgtttaagcacaccactttcacagtgttcttcaacatttctttgttcaccactggattagctgcagctatgctgttatggccaacaatcaccgaacacattcacctgacacgcaatgtgcaccgcaatatcaactatgaatgtcctacagctaaaactggtctacttggaggtggtgcctttctatcacttgattcatctctcctttggttgattgcccttatgctagctgacaatgctcgcgaggacttctttgaagaagaaggagaagatggtgacaagggtgaatttggcacagcctcctctgatgcttattatgatgctgattcaggaccgaaggctagttcctga

SEQ ID NO: 15180 - DNA, 867 bp, Glycine max
  Peptide Sequence Number=SeqID_106865
atggtgaacaacccctcaagagctcagaagaaagccaagactttgaagaggaagcaaggtgaatgctttcaggttgctctcaacaggttggacacatggttcactgatgaaagtaagaagaatgattacaagatgatttatgatgcgaagaacgtgagaatacccaagtatttgaacttggaatggttctctcagcaagggttcaactttcctaatctgttggaggcacaaggtttgtctaaattggtgcagttgaaaggaacattctatccggaactggacaaggttttctacacctgtgcacttgttgacctagaaagtaacctcttttttattgttaatggagtagaaatggtcattcacattgaagtatggaaggaagtagtcggtctggacatgggtggagtccacaagttcgatgaaacagctgatgggtacaacaagatgcagacctataggggaatgcttcttgacccagcaaggaacttgaggaatctcctaactgtctatggtctaaaatcaggtatcaagatgaattgggtacttttgatagaagacatcatgttaaaaagtcatcagttagtggactacaaatttccttatgttgtacttgcctcaagattcattgactacttcaatatcgatgtctccaatgagatagtggattttaccaaaacatctagtgagatttaccaaaaggcatctcaagaagcttggaatgagaaaatggatgctatgcttcacctccatcaagagcactcagctaaagttcacagttcgttggagaacataactacctggctggaaaacataaaaactaggttgacccttagcaacctccttaaccctgatgaggatgaagcttag

SEQ ID NO: 15181 - DNA, 201 bp, Glycine max
  Peptide Sequence Number=SeqID_106866
atggtaagcttgaccaggcctgctcgagctggcaaagctctcctcaaaccttatcatgaatgcgtggtactccagcgaacatctccacgaaacgtgaagtgcacgagggacaaggtggggagaatggcgtttcctgttgtggtgaggactgaggagtggaacactcacattgacactctcaaggatttgttcaaaggctaa

SEQ ID NO: 15182 - DNA, 189 bp, Glycine max
  Peptide Sequence Number=SeqID_106867
atggttagaatcaaaggattgcaacagactttaggtagagttttaggtagatccttaggtagacaggttagtggtgatgaggaagaagcccctcagcgtcaaaggtcgacatcattggcacgaacatacttagttgaagttggtctctcatgggaggaaggtggagaaatttggaaggtctacacctaa

SEQ ID NO: 15183 - DNA, 774 bp, Glycine max
  Peptide Sequence Number=SeqID_106868
atgctccaaccatatgagatcagcataggcttaaaggagcactcaaacccggtgacccccaaggcctacactccgaagagtccgtcagggcctctccctcctgattcagccagcgatagtaacatctctagcggttcgctgagattccttccgactgctccgatagagttctcaaacgtcagagagatgaagaagggattgaaacctccacttgtactgtcttcatgcgattcaattttctccctccacgaatattatctcaaaaatcccaacggtggaaacagttttgggtttctgcggaaaattaaaatgctacaatgcgaagggttttcctctaagctcagatatgattttgaaattcgcaacgttgagaatgttctgaattgggttgcaaacgtggtactcaaatttcgcgacgatccaacggtgaacgagtctgagatcgtcgtttttctgagacagatgcgtgaaaacccaccagacggactccatgaagttgaggtccatggttttgtaatcgttcttgaagttgatccacttccagacgtcctcgcgcttcttgatgccaagcttcttgtcgatctcattctcgacggggaggccatggcaatcccagtcgaagcggtgggtgacgtggtgggcgatcatggagtggtagtgcgtgacgatgtccttgatggtgccgacgagaatgtggtcgtagtgagggaggtcggtggcaaagggagggccattgtagaagatgtactcgggcttgtctttggtcagagatag

SEQ ID NO: 15184 - DNA, 486 bp, Glycine max
  Peptide Sequence Number=SeqID_106869
atgagcaatttacatgttgacgaagatgatgatgatgatgacgatgatgattatcttgtgtctaactcatacgttgaagagtctttagacgaagatgacagtgttaatggtatatctgatacagacgatgaagtcaccgacatgattcaatcagtaagaattgttcacccagcagaaggtgcacaaggaattgaaaatccattttggaatgatgctttgcattataacaatatcaactggagttatcctgatgaggaggacatttgcggtttggagatgtcgtcgacctttaatgttggccaagaattatatgttggcttggaatttgatattgttataaacatgatcagagaagatccatcaataaaagtttctttgattcaagagaggattaacagtgaatttgcgtacaaggtgtcgtacaaaaaagcttggttggcgaaacagaaagccattgcaattgaatatggtgattgggatgagtaa

SEQ ID NO: 15185 - DNA, 504 bp, Glycine max
  Peptide Sequence Number=SeqID_106870
atggaaaagaaatcacctgaaccacccgaagaagcatcacagtcacgagactcatcgcgagataaccagacctggataactgcacaaaacattctgagagaaaaactgatcacagaggactgtttcgcatggaaattacaagctggttccaaagaggaagaagcattgagatacgttggtggggttgacataagcttctcaaaggatgacccatcaagggcatgtggcacccttgtagtcttggacttccacactcttcaagttctctatcaagatttctctttggtcactcttcaagtcccttatgtgcctggctttctagcatttagagaggccccagttcttctgcagcttctagagaaaatgaaaaggagcaataatcctttctaccctcagctattaatggttgatggaaacggaatacttcatccccgaggcaagtgcttcacacgaatatttttgcatcccccttacaagagtcatgcacaagatttttctgattga

SEQ ID NO: 15186 - DNA, 192 bp, Glycine max
  Peptide Sequence Number=SeqID_106871
atggacttcagggctacatttgcagtgtttttcgagaatgatattccatgtgaaaacgatgatctcggacccattcaccgttggatcgtcgtgaaatttgcgtaccacattcgcaacccaagttcaagcattctcactgtcgggaattgcaaaaacgtgtcagagctaagagaaatacccttcgcaccgtag

SEQ ID NO: 15187 - DNA, 285 bp, Glycine max
  Peptide Sequence Number=SeqID_106872
atggccaagatcatgttgaatgtcacggttgcatcagaggctattttaaacatcaataatgtcaaggaccagatttacggtgaagttagtaggtcatttgctatgagatggaaagacgtgcttgaccgttattggcatttgcttgacaaggatggaaatttgcataccgttctctacaaccaagatttggatagacctgccattgtagcagggtggacaacactgaggaatttctatcgcatgcatgaccggagatcatcaagggtcgttaacccattatggtaa

SEQ ID NO: 15188 - DNA, 237 bp, Glycine max
  Peptide Sequence Number=SeqID_106873
atgagtttcatctacgaactcggaggtgtactagtgggttgggaacatgatgatgttgtcgagaatggaggctgtgaagaaaagtggaggaggttttggtgtgacggggttctcgtgacccaattggccaaggagtttttctctctatgcttcacttctgattgtgctggagatggatttggggaagcaccgtctggatctgatgaggttgcttccactcactctggaggagcttga

SEQ ID NO: 15189 - DNA, 648 bp, Glycine max
  Peptide Sequence Number=SeqID_106874
atggattccaacttttttttttatcatacttattgggatgttgtgggaattaaggtttgggagatgattgttcatagttttcactcaagcaccattaatcctgccttagtggaaactcttattgttcctattcctaaggttgacaacccaatgagccttaaagattttaggcctatagccaagacttctctggtgaagatggttcaaaaggaattagacatgttttgtaaggccacgggtctaatgattaatattcaagagtcgagaatgatggtttctaaaaacatttctcaaaggaaagcttctaagtttgctaatattcttggtttcaaatcgactcagaatattgggtttccagcgatgaaaggaggaggagttagcacaggtgaggaccatgacatggctgacagaatgcaatgtagtgaccacccttacagaaacaaccctagtgggatctacgccttttgcctccaagaaaagctcgacaagcttatttcctcttctttccctctctctatctgtgctccttcttccccttcttttagatctgatgccataacctcttcttcaccaacgctaccacctcaacacccctccttacttttcttcttcctcctccctcaccaagaacaacgacaccagttatga

SEQ ID NO: 15190 - DNA, 186 bp, Glycine max
  Peptide Sequence Number=SeqID_106875
atgggtggggtagggaagggtatgagtgggcaacttgagtttcgaacaaaagaattgttctccactgtgacgggaacaaagatggctagaaagataatttcatcaataatgaggaatttcggaagatggaagatgataggggaacatagtgtggactgcggagcacatagtgcgtctgacacgtga

SEQ ID NO: 15191 - DNA, 138 bp, Glycine max
  Peptide Sequence Number=SeqID_106876
atgggtttgtcaggcttaaaggagcactcaaacctggtgacccccaaggcctacactctgaagagtccgtcagggcctctccctcctaattcaagtccaacccctaaaatcattttagcacacagactctatctatga

SEQ ID NO: 15192 - DNA, 561 bp, Glycine max
  Peptide Sequence Number=SeqID_106877
atgcgaagatgctacaaagaggcactcatcccaacttcgactcagttccgacgggaatccgtatacgtgacaaagattccaagaatagagaaggagaaaaggattaggagggttccaggaacgtgttcttccttctccaaaatcgaaatggaacttctctctctaaaaaatgcagtttcaactttctctctcatcgcttcgccagaatctcgccacctccatcgccggaaagtttcaactttctctctcattgcttcgctggaatcttgccaccgccgtcgccggaaaggtgagactcagagcttgcaagtcgtgacgctgactcgagttaaagcagttttcgttgctccgtggttttgcaacgtcacccagaatgtgaggaattcaggttggtcacaacctgatttgatcatggaggaatcaacaataggggcagcgttcttttcacaagtactggcagtaaatgacgcgacggtaaagtttgagatttgggacacatcaggacaagagagaggtgttactgctgctatcattgtctatgacatcactagctcggtatga

SEQ ID NO: 15193 - DNA, 1371 bp, Glycine max
  Peptide Sequence Number=SeqID_106878
atgggggttgctgatatttttccagaatacactcaaacgccaatcaaacgcaaagtcaagaaggagcccaaagaggaaccacagtttgtggttgatcagacgataggcactcaagatcaacctgttgatcttgagtttggatctatgtctcaacagacacgggacccacctccaccaccatcagatcctaaactctcaaaccaccccaagaaaccaaagaaacaacctacctcagaccctagaactgcccaaaagagaaagattatagattctaagcagagtgctgggaaagccaccatgattgagattgacagtgagctagtgcctaaggaagtgattgttgagtcaatccaggaacatggacatgaagctgagcttatgtcaacatatgttgttgaaagactagcaaagattgaagctaccatggttcctgaagatatggatcctatggagaaggatgttcttgaggaggctatgctccatcctatcattaaagcatcccttaaagatcaagaggatgatattgttgagacaaattgtgtgtatcacatgctagtgattgctaatgatgaaaagatgtctggaatagaagaagattttgcatctcactacagagcccatgatatttgcatatctctcactagtctcgacaaacgtctgatgaggccagatgaacgacaagccacaaagtggattttaccttcaagaccacctatacctaaagctagtccaagtttacaaggctgggagcaatcaacttatggccttgagcttcgaatgaagttactcgcctataaagaagaaatcagatctagacaaacttcattcaaacaaattaaaaggctcaatgttcacatgcctttcatgattgggttccaattctcatgttttgacacccacaacacccaacttcagatattagtagacaagcctatgcagtatcaaaaggttaattactacaatggaaaggaattacttattgaagatgatgaagatgcttctccaactagatacgtgaaagctcatcctagaaggctttttaaacatgatcatgaggctcttaagcaaaagactgagctcacaaatttgaattggtatgccataaagaggtttcacaaactgaaggctcattgttcaggaaatgcctttcaacatgatctattcatggacaagggagttttttgctctgatcgcacgttttcctttgttgtgaatcttccccattctagattcactttcactcatcatatgcaacctatcattaaggaagtggattctaatgttgaagctgaagttgatctcagtgccatggctgtagaagtgtatgatcgtccatcttcaagagagtatgtcaaattgattgaggcttag

SEQ ID NO: 15194 - DNA, 201 bp, Glycine max
  Peptide Sequence Number=SeqID_106879
atggtgggttacacaccttcaagatttgcggatttggtctttgccggcgaaaggatcgaagtgagtctgaaaagaggcaaatctaatcatcctgctttgatgaatgcaaaaactggggcaaatgaagatgatgagaatgagggagaaacccttgctatgactgctattcctacacggtcaaatttccgatcagcccaataa

SEQ ID NO: 15195 - DNA, 1005 bp, Glycine max
  Peptide Sequence Number=SeqID_106880
atgggtcatcaattcaaattcatttgtgtcaaagatgtagagaatgtattgaggttggagaaagatctagataacattcttattgatatcatcaagatacatagcaaagggaaacaaaacaaagagggggaaaataaggataatcgaagacaacaaccaacttatgcactgaagagattatcggggaaagggaagcctacaagagacaacaaccaacgtacattacaacaaatctgcaatggaacaaaaaaccacaatgggataaacagagtgaatctagagccagccagcaatgggggacggttgcaaaatcagatatggcaagtcaaaaaaggaaacatcaaagaagacaactttgaggaatggacaagtctcaatgtcaaagcaaatggaatacaagcgcagaggctacaagaatgttgggtaggcactctcaaagatacgatgttttgcaaactacatgaggagtgctatgagggaaatatgggggagattaagcttaagctttggaaaattggaaaccaacaatggtacctggtacaagaggcaataagggatggagatggtggctgtaaggagagatcgatagaggaaggaggaaacaccaatgagatgaaggcggttattgatcacaagggagaagacgaaatcatgcaaagcacaccagttaccttgatagatggaaattcggggggagaaaaagaaggagtaggagatataatagggattggtggccctagggtgcatgtagttcaaaacacagacttatactcaagtggcatggactgggcaaacaaatctcaatcaagagtgtggaacactcccactcatgactttgctcgaacaactttaggtgctatggtcttgtctggacgtctaatgcatatggggagcatatcaagaggcaataatatggtacatttgacgaatgctaaagtaaaggcaaggaagataatggatacttgttggggcttactcactatggacgccaagatgaaatggtga

SEQ ID NO: 15196 - DNA, 495 bp, Glycine max
  Peptide Sequence Number=SeqID_106881
atgtcctggagcttcaagccaactattgacatgaatcttacttttgaggagacacatgtttgtgcatatgtcttcaaccctaatatggacccgagcgggaacaaaattttgtatggggtgggaaacaacttaggcacacgacaaaactttcattcgtggtgtcccaataagccaataagggaggagataatactattcatggctttgaaggttgcttacaaccaactttaccgcacaaggagtgtttggttgcccccagcttttgcgttggacgtaattgatggaactgcagtggaaactctcgttgagcattatggaaaggattggatgccttcattttcaaacttaaagttgcgaaaaatcagaattatggatcttagaatggatgcaaatggaggagtcatttgtgagtctgttgtatggagtggtaagaatgttgcagctgtgctagatgaaaagaccgtcagaatgaaggtgacaatgaccttgcgttaa

SEQ ID NO: 15197 - DNA, 207 bp, Glycine max
  Peptide Sequence Number=SeqID_106882
atggaagcgcagacacgaactccacaaatgcaaactcgacaatatggttgcagtcacagaagcgcagcccagtttgcgacaaacacgaactcaggcagaaggagaaataacaataaagccctggtcacggaagcacaggcgactttgacacaaggagaaagaagaagaacgatatggttcaagcgcaaggagaaagaagaagaatga

SEQ ID NO: 15198 - DNA, 699 bp, Glycine max
  Peptide Sequence Number=SeqID_106883
atggtgaaatctgagggtgaattagggttttgcggaagaaatttgggagaaagagtgggagccctagaagggatcaagattggttccttgagagtagtatgtaggcatgagtctcgtctctcactcttgtttgtttggatgtatgagattgttgatgtatgtggcaagagggctacacacgtgtggatgatggacaaagatacattggggtataatgaacggagaggttcgaagaacctaggaaaattagcgagtggttattacccaacatttggtggactcatctggcatggagaactcagtcctcactttgctacttttgacgagcttcgagactatgcttttttgagctgggagcttgggaatcaatgtacgttgtatccgaacaaaggactcatctctacaaccaataactttcaagtatcgatgagatcgagaacgtggcacccgtgcgagcttggcgtagttcgtagagggaatgggtatggccatgtgagcaatgttcttagctactgcatggagctagtggtaatagctgaagttattgaggataaaggagaccattctgatatgacgtcagaggagattgaggagtataaagaactattgtgtcaattagagccttcattcgagtatgagagtatgaaaatcttcctgaggacatgtcttagatatagtttggtacttcgagtcgggtag

SEQ ID NO: 15199 - DNA, 300 bp, Glycine max
  Peptide Sequence Number=SeqID_106884
atgactacaccacccaggtctccccctcctcctccttctactgatgcagcatcacattcccctcctaccttgaagtggacaagaaaagccacacgcctgagatcattggatactagaccagttggagcagagagacccctggtctatgtggatcctgtgactgggaaagccgacggtccccacagaaagaagttaagaacatttttggggattgtcgctcatgataaggtggatgtgacatacgagaattggaaacaagtccctgttgcgcagaaggatttgatatgggaggatattcag

SEQ ID NO: 15200 - DNA, 699 bp, Glycine max
  Peptide Sequence Number=SeqID_106885
atggtagaatcatacaagaagcgaaaaggatcttcctccaccaccgctgctgctggccatcgccgccaaggaacctctagagacacaaccgcaccaattcctccatccatttcatctcctcgatcatctacattattttcttcagatgatcaacgtcaaaggtattattctcaattttgcaatagagtcattctagaccctaagtaccttgaccttgaattttttgatggcgaaacatttgattgttaccaagtgtttcaaaattctgctttgactgattttatgtctttggaactgccttactttcctgaattagttaaggtcttctataataacttgaaaattcaggatggtattatttactctgaggtgcataatattcccattattattgatcaatccttgttcttttccttgacaaaactgcccaatcaagttgttccttttgagggcacccttgttgatgactggaaatttgattattctagtcatgatgctcgccgcatggtctgcaatgaccaggctgatatgaccgacaggttacttgttgggtcattaacttttgattgtctcatcatgcattatatcattgttcgtattttacttcctcgatcttcaaaccttgctcaagcctctgaggaggatttgattctgatgtgggcctttcaaaccggtcgtcagatcgactgggccatttag

SEQ ID NO: 15201 - DNA, 279 bp, Glycine max
  Peptide Sequence Number=SeqID_106886
atggaccaggccttagaagcaaacattcaattgactatcgacaatgctaatttgaatttcaatgtggataacttgaaggaatcaatgaaaaaggctgaggaggtggtagagaaaaggaaagtcgagtatcaaaccttaatgaggggtgcttgtgaaaaagtaattcaagaacacaaggctggttttgacaaggctatccaacagcttctcaaggaagttttctcaaagaagcttttcaaggaagttttctcaagaaagcttctcaaggaaactacctag

SEQ ID NO: 15202 - DNA, 648 bp, Glycine max
  Peptide Sequence Number=SeqID_106887
atgggatcaaaccaagcaccctcttttaagaaatggttctatcatgtcaaaatcaaaagcctagaagtagctagtttgcaagagttagggcagcagatgggtcaactccaacgtcaagccttccacaagacatatggaaagatatgggatttggctatgatagaagggtctttcgaagccattgcatccctcactaaatattacgaccagccgctaaggtgcttcacgtttagggactttcagttagtaccaaccatggaagaatttgaaggggtcttgggatgcccactaagaggaaggaagccgtattttttctctgggttatacccctccatggcaaggatagccaaagtggtcaaggtcttgacgcaagaattggaccgagtaaaaaaaagtagaaatgaggtggtcagaataccaaggaagcactgggaagagaaagcgaaggctttggtggatcaaggggagtggacttcattcattgatgttttagcacttttggtgtttggggtcgtcctctttccaaatgtggattgttcgatggccggcatgtgcaccagatcgcgcagcctaatcctagccaagcatcagatccccctattctttggcattgatcacacttcaagacatggtgatgggcatctttga

SEQ ID NO: 15203 - DNA, 657 bp, Glycine max
  Peptide Sequence Number=SeqID_106888
atgcttttcttgcttatcaccacagcaaggaaagtccggtcgttgctattttggctgatgcctatgactcatttgattgaagatgctagaagagcaacgcaaggattgtctgttgcacacccgctctttatctatggctggtctctcacatttttcgtcaagaaagtagacccgtctgtcccctacaaggtcaccgcatgtgcaccgagaaagggaaagcaaattgggagaagctcttggctggaaggaagggcggagttgtcttcatgtgaagggatcccaaatgtccccttgatggggacaaggggttgttttaattataatcccgtacttgccataagacaactaagctatcctatgagaggggcaccatcagaagagagtatcacgcctttcatcgcacgaggcttcagtgaccccaatgcaaaaatgcttcaaagagtccgaaaagcatggaatgcggtacaaagaaaggataaggagcttagagggagcaacaataatgttattggtgggtatcatcaatggttgaaggctcggatgcaagggataacttggctcccgaagctaaaaagtccaagtggggaagagactgaagtccctgaggagagtgaagaagtgcaagccttgaaagagaaacttgaaagaacacaagtg

SEQ ID NO: 15204 - DNA, 297 bp, Glycine max
  Peptide Sequence Number=SeqID_106889
atggcctttgcatgtgatattgtgaagtttgaattatggaatgaatttgtgcatgtatggttgccatttggggtggatgtggagtttgatggacataggttccggagtgaggaacaccagtgccgatttgaggaaattaagggtcggtcgttcctcaaggagaggcgggtccaattgagggacagagagtatgccgagttccaggaggaaattgccaggaggcaacggactcagcttgcgacacccatggctaaatacgatcttgaaatagtcatggagttctacgccaatgcctag

SEQ ID NO: 15205 - DNA, 348 bp, Glycine max
  Peptide Sequence Number=SeqID_106890
atggcacatcacaccgccatacctcttgagcttgaggttattcctaaagtaaaggagttgttggataagggtttggttcgtaagagcttaaatccttgtgctatattggtatccaaaataggtattatgaggcaccaaatccctatgataggtggtatgatgaatgtgttgagtggtgcacccctcttttgcaaaatcactaatgcaccgaacatcttcatgatttgtgtacatagggactcattaggtagtgatcaagggcttcccatggaccttaagagaataaaggtcattttcgagtggcctactccatcaagtatgagggaatttggggctttaatgacttaa

SEQ ID NO: 15206 - DNA, 315 bp, Glycine max
  Peptide Sequence Number=SeqID_106891
atggtggctgtgggtgatggagaaagtgcttgggacattagaaatggctttggaagaaagaaaggagaagaaatggcatttttcctaagctacacgaaagcaaaggctgaacttctagcacactccagacatattcgcaaagatcccaacggtcagatcatggacaagtgtcttgtgaagtttcagaccaaatttcgagaagatccaacggttaaccaaggatgggcagtgtttttaccaaggcagcttcatgtagctttctctagaagcttcattaagaggctttctccagaagcttcatcgtggcttctttga

SEQ ID NO: 15207 - DNA, 207 bp, Glycine max
  Peptide Sequence Number=SeqID_106892
atgagattttgtgtggtggtgacgacattggtgatgatggtgacgctaatagcagcgacgacaaaagagataccggtgatggtggaggtggcattggtagtggttgcgatgttgatggtggtggtagtcagtggttgtggcactattggtggtggtgacaatgacgaaggtggtattagtggttgtggcggcggtgacgatgattga

SEQ ID NO: 15208 - DNA, 5099 bp, Glycine max
  Peptide Sequence Number=SeqID_106893
ggtttcgaatcgccaagagattctcaaaccctaatccctcaattcgccctcgtgatcttcgatatctgtgggacgaatcgattgttcggtggcatgtcggttgagacaataaccgcaatgcatggggttgttgggtattttggatttaggtttgtgttggatgagggcagaacagaaaactccaatgacactacatgtcccaagaaatcaagatcactggatcttaaaagtctatataaatcaaaatggacagaaaacacggcaaagacgaacttaaagaggatcggcaatagtagtgggggtggtgatgagaagaggaagaaaaaaaaggctagaaaggaagtctctttaagtagcttagaaaatggtgatggtagcagggagttgaagttagggttgagtcaaagatttagtagtagttgtagtagtgtgctaaataaaatttcatttagtgttggtgatgatgatgttcagattcccaagaggaagaggagttttgtggggaggaagaaatcggaacttggtcaagcatcaaaactggtggagcagcctggtctgaaaattggctatggcgatcaggtgccaaagttaggtagtgatgatttgggcaatggggttgagtctttcaagattaagcataggaaagaatttgatgaatttaaggaaaataggattagtgattcaaattcagttcagcatgatgtatcaaaaaattcagttcagcatggtaaggagaatggggattgttcatttcattctgttgtaaatagtggtgattcttctttatcaaagtcacgaaggaagaataggaagcgaaaggcttcagcattagatagaactaaggtttccaaggaggctgaacctttggtttcaagttgtaaaatatctgatgatttgcaagaagatgaagaggaaaatcttgaggagaatgcagctaggatgctatcttcaaggtttgatccaagctgtactgggttttctatgaaaggttcaaatggtttgtctgttttccgatcttctagtcaaagtattgttaaccgtggtttgaattctcagttaggttcagaatcagcatcagctgatactgctgtcagagttttgaggcctaggaaacaatatagaaacaagggtaattcaaggaagaggcgccatttttatgaaatccttttaggtgatgtggatgcatattgggtactgaatcggagaattaaaatcttttggccattggaccagagttggtattatggcctcgtggataactatgatgaaggaagcaagctttatcatatcaaatatgatgatcgagatgtagaatgggttaatcttgaaactgagagattcaaactcttgttacttcgtagtgaagttcctggaaatgcaaagggtgagagagccttaacgaaacgtagcagttttgatcaccaaaagggaagcaaatccagaaaagaaaggcaaagaacagaagcgaatgcaggggatgatcgttgtggtgatagcagtttggactcagaacctataatttcgtggttggctcaatcttctaatcggcttagatcttttcagggcattaagaaacagaaaacttctgttacagttccaagtacaatgtcatcattcttatatgatgaacctgttacagcaaaggggcatttagctaagagttctttgaggggtgttgaaaataatttctctagttgttgtgtatcacaagataaatcaagtgatgattttaaggataagtcctcattgcaatgtgtcactcgtgctaaagatggaaaacagcctatggtctatttcagaaggcggcggatttttaagccagctccaatatcccctcatatctctgaaagaaaccatgctagtataagtgcatccggttctgttgcctttgaccatatgtttggtggggttgagaatgtgaaaaatccaattgacaacagggttgaggttgggggcccattgttcttcacttacaaggctggagtatcaaattttttttgggacatggagtcagcatcattcaaatttggctttaactttccaatgcgtttggtgttgagtgacttttttcaatcagaaaatgtgtggttgctttacactgttttgctgcttcggttcggtacagttatggccaagtggcctagagtttgtttggagatgctttttgttgataatgtggttgggttgaggtttctatcatttgaaggctgcttgaacatggctgcagcttttgtcctttttgtccttagggtgtttcatcaacctgcttgccaagggaagtatgttgacttgcaatttccatgtacatctattggattcaagttttctagtgttcatgttattaagatgccacttgtgtttgagttctataatttctctgaagtgaagaattcaaagtggatgtacttggattctaagctaaaagggcattgcctgctcagtaagcagctccagctttctgaatgcacatatgataacatccaggcacttcaaaatggatcaagaaggttctccataacttctatcagtgggccttcctcagtcaaggtcacacagaagagtaggccagggattaacatcattggtgtttccaaagggtccactcaagctgatactcttccatattctgatgctggcgagaggaaacttcctccatttggtctctcttttgctgctgcacctacattttttctttgtttgcatctcaagttgctgatggagcagtctgcaacatgtataagattttgtgatcaaacaccaatatttgatcaggaagaccctggtttgatgacaaatggatgtactagcactgatgattgctcaaacaggaattctgaagttattcttaggagaggtatggagactttgtcaaacagtgctgcagatgatggagggtcttgtgctgactcagataatccctctacttgtaatgaccaaattctcactcgaaattaccagaacattggtcttaacggtgctattacttccatttctcatgattttgagaggctttgtaaaactcacttacccgaatggcaatcccactatttggagcaagagttagtctctttaccttcaagttctttaaaacatcaagataaggctaatgatggttctcattcttttattggtgatctcagtattcaaattcctgctgttgatcaatttgagaaacctgatgataacggtgatttatgtgatgctgaacactctcctgatttctcttggaatataaatggatgtggtattccaagctccaatccaactgctcacagaagttcttggtatcagaaccggaataattccttgtcattgggatttcagtctcatgtgtggtctgataaaaaggttgattctctttgcaatgatttgagcaatggacctaaaaaaccacgtacacaagtatcatactcagtgccttcagcagggtatgaattcagttcaaggcaaagaaaccatcatcagaaagggctttctcacaaacgagttagaaaggctagcgagaagtcatcagatgttgctagggtccctgaaaagaatatcaaatgcttatcttgtggtgcaaatgtcttgattactcatggtgataagggttggagagaatccagggcccatgttgtactagaggtgtttgaccacaatgagtggagactttctgtgaaactttttggaattactaggtattcatacaaagcacaccagtttctgcagcctggatcaacaaatcggtacacacatgcaatgatgtggaaaggagggaaggattggatcttggaatttccggataggagtcagtgggctcttttcaaggagatgcatgaggaatgctacaaccgtaacatccgttctgcttcagttagaaacatacctattcctggtgttcatttgatagaagaaaatgatgataatggatctgaggaaacttttattcggagctgtatgtactttcaacaagttgaagcagatgctgagatggctttggatccatgccgtgttctgtatgacatggatagtgaggatgagcagtggatttcaaatgctcaaaattctgtaaaagacaacagtgaattttcttggatctctgaggagatgtttgagaagacaatagacgtgtttgaaaaggctgcatatgctaagaagcttgatcattttactcctgatgagatagaggacctcatgcttaatgttgggcctttgtgtgttgtcaaaatcatttatgaccattggcagcagaggaggcagaagaagggaatggctttaattcggcactttcagccccctctgtgggaaagatatcagaaacaagtgagagagtgggaactagccatgaccaagaacaatgccccttctaatggatgcctggacaaggttacaactttggagaagccggccatgtttgctttctgtttgaaacctaggggtctggaatcactgaacaagggattgaaacatcgatcccaaaagaagatttcagtctctgggaatgcaaacagtaatctagatcaggatggcttccacactttcagaagaagacagaatgctttaccttttggcgatgaaaaccaaggccacagttacgattcttttgatgattcatcattggctctgacctcagcaagggtattcttacctcgtgatgctggcagcttgaaatactatcctactagtaatggagcaggatatagaaatcatatcccaaaatttcacaagcccagatatgattcgcctggtagcaggcatcactttcttgctggccctaagaggcaagggattgagcagttggatgcttccgtccttgaggagttaagacaacgtgatgccatggccgaggctcgttttaagtgccatttggctaagctgaagagagatagggctaaaagattgctatataaagtagatgtagcaattcacaaggccattgctactctaatgactgcagaagcaatgaaagcttctgaggactcccttgtgaggggaggagattctgttgctgcagattgcaactccttcccactgtttagtgtcctacttggaaccttttccagcttgggatctgctcagttcagagtaactgtagcactgatctgcatggtgtatag

SEQ ID NO: 15209 - DNA, 339 bp, Glycine max
  Peptide Sequence Number=SeqID_106894
atggacgatgaccaccatggcaaacgcgacagtgacggtgccatttcggtcaacgaaatacgcaacaacgatgacaccattacgatcattgtcgaaaccccaaaacaaccgtccattgatgatgaagacactagccaacgatggtgtcattatggtgtgtgttgttgtgatcaccatcgacgggaacaaatgtatggtggtcatcattctggttgggaaatttgggaacaaaccactttcaagaacgaggttgtggaagtgtgggagatgaagcacaatttggaaacgaagaagtttcgggaaggaagctttgaaagtgtgggagatgaagaaaaatga

SEQ ID NO: 15210 - DNA, 91 bp, Glycine max
  Peptide Sequence Number=SeqID_106895
atggatacctcagagccctacactggagcaatgagaggcattatgcatgagcctcaagcaaacctagggacagataagaagttctcacccg

SEQ ID NO: 15211 - DNA, 219 bp, Glycine max
  Peptide Sequence Number=SeqID_106896
atgctaaagttgttgtcaaagataaaggttaagaaaaaccatacttttccggtggtttacgaacgcgagtactatgacgtaaagggactggttctagttgaagcgttgaatcaacaaccagaaaatgatcgggagggggccttggagggattgaagatgaacataacagacacaaccaaaggtgcagagaatggaataattggatggcttaccaaataa

SEQ ID NO: 15212 - DNA, 548 bp, Glycine max
  Peptide Sequence Number=SeqID_106897
gtagacttttaagaagaggcttaggtagacaagttactggtgatgaggaagaagtccctcagtgtcgaaggccgacaacatctgcatgtagacaatggacaactacaatcgttgctgaggacattaaccatgtggatcatgcagttgacgaggcgacatcagtgttgatgtcatatgctaatcatgtggcaactagagtttgggcaggagaagtagagaaatttggaagatatgcacctgaaattgaaggcatagtggctgctacaggattaagttctctgattacatgtttgttagagacaggtgacatgggacttttatttgtttttgcggagagttggaacaaggaaactagtagtttccatatatcgataggagagatgactgtaaccctcaatgatgtggcatccttattacatctgcccattataggcgccttccataccttcgatgctattgatgaaggggacccatcaccaaagccatggctaggagactctagcaagattaagcaagggatgcagaagaaggccctaggattctcatga

SEQ ID NO: 15213 - DNA, 1434 bp, Glycine max
  Peptide Sequence Number=SeqID_106898
atgagtctaaaaaaccacaccttgtttttcgggacaagtctgcatggttctttggaaagtggcaccagcaagaggagcccttttcgtttggacaagaggcagttgttgccgcagaaggttctctgcagttgcacgtgctgcgtgtccccaaaacggtgtcgtctgaacaaagcaaagggtttcattgaggccaatttgttgccttctgtttgttcagcaatcagtgagcacattcagcgtgaccttgtgtttggcaaggttcggcaaatttcgctgttgagcatcacgttggagtcgtgctcgtttgggcctcataaggaggagttttcgtgtggcgaggctcccacggtgaagcttcgcctccgtccctttgtgagcttgaggagggggaagttggtgattgatgcagttttgtcgcatccaagtctcttggtggtgcagaggaaggactttacttggttgggaatacctttcaatgaaggtggcagggagagaagctgctcggctgaagaggggatagattatcgcacgagaaccaggaggcttgcacgagaggaagcctttgctcaatgggaaagagaaagggatgatgcagctagggaagctgctgaggtagggtactttgtttctgagcggagttgtggtctatcccaaggtgatgatggtttgaaggagattgaaactcgatcattggagtcaagtgagtctgcgccctttttctgtatgaatgatgggaagcacgatcatcggttgatggacaaaggtgttaattatgatacaaaacactcagctttggaaaaatcatttggagtaagatttcctggaacaggacttcgattttggtctagagtaatatcagggcctaggaaacacaagtttaagaggaaggctactgggagtaacatctttccatctggtggtgctatcaaaaagagaatgtttgaacgtagtgcgtcagctgctcatgcatacttttgtgatcaatcacaatggaagtttggggagccttcctcatcttctgaaagttatggttttatgagtcatgatatgcatttggtgaaaagtgagacaagggagagtgaaattgaaaatttgcaatctactgatgatgttgcacaacctgctaatccaaatagtagtacagtgaaaaatgaggagtgtgtaccatatgttgctgacaatcaaattgatgataacgacaattcatcagggggccaacgagatttgatatctcattttctttctggttccattgaaatgttgaagtctgatgtgggtctgaaagttgaagatattgtttcagaacatgttgatggggtagattttgtgcagtctgaaggcattacgaagactctgcctattacgctggattcagttcatttcagaggcgcaacactgatgctacttgcatatggtgacaaggaagttaggtga

SEQ ID NO: 15214 - DNA, 1173 bp, Glycine max
  Peptide Sequence Number=SeqID_106899
atggaggtaatcgtttcctcaacaatggccatggaggtggccgcaatttctctcacggtggtggtcgcagctaaggcgatggccgtgggggtcgtggtgcacccaaaccaataccaaaatcagtatccaaaccagtatcctactaatcaatattcaaacgaatatcccactcaatcttccaattcatatcctaatcagcctccatatcagaatgcttcacctcaatacaacaatccaccaccacaagctcatctaactagtgctcagtcctcttcttcacaaaattggtatccagattcaggcgcatcacaccatgtcacaaatgtttctcagaatattcaatcgaccacaccctttgaaggaccagatcaaattactattgttaatggtcaggggttaaacatcaatttctcaggagtagaggatgtacactttctggagaggaagctggacaacatcatccttggggggttaaagatgtacgttaacatccccaaattcgatagaagcaagctgggaatgccatgccaagcagctcagggaagagaaatgggagagcaacaggaggaggagtacagaggtaggtacctgagaatgaagccagaagtgaatgcgggagtgaagggcggatcatatgtggaagctgtgacgagaaacctctccacaatggcacaaaggggcagatttaccagggatgatggtatctactacaagtcgcgatccacggtgcatctcaatataccggcaacagggcagaagtggcttaaggaagcatgggtggggagattgaaaaacgtggcattgcatgacagagtcgaagaagaactcccgtgggaaatagccgctaccacatcgtcaaaattgaaggacagattgaaggacaagaatccattttctactcaatggagaagtggaatccgaggatgcgtccagggcacaggcgagatgatggatgttgaagacgacgtagagaatcttcggcagctggacgtggcacgggtgttgataaaaacaccttggagccccctaatcaaccatacagtcagcgtacacatgcaaggggagatcctcaatgtgcacatcatcgaggaaagcgcaagcttagcagacccaccctattgcaggcgtggaagagaggctagttcatcagaggaagtgttctcggaggagtga

SEQ ID NO: 15215 - DNA, 438 bp, Glycine max
  Peptide Sequence Number=SeqID_106900
atggagtggttttataagatatctcacccacttatgagtctgccacaacttggggagcctcctagacatcaacccatggtgcatgatgatacatatattatagtagatccacttgtgttgcccgttcacacaacaactatgccacaaccacctgcacttgcagctattgatgcaaatatgcctcaacatgcaatggctgcttaccaaaagatggcaaaaagcttggaacacatgataaatatgaggatagttactattggaactgatgcatacactttgactgagcactatttaggattagccatactctgggctcagataaaccttggtctgaaaaacttagcctctgccaaaatatatggactgtgtcaagtgagtgatcatgttgttcatggcttcccaaacactatatgggtcttcaaggctattttgcagtag

SEQ ID NO: 15216 - DNA, 2484 bp, Glycine max
  Peptide Sequence Number=SeqID_106901
atggagactgagattgtagaattccacatgggccatgtaccatatgattttgcaccaatgtatacagttctgggtcatcttcatgggaaggacttagaggcagcaacaattccagaggaagaacctcaatcttctgaggcatcttctagttttcctattatagaacatcctcatttagatcctattgaagactacatcatggctgaagatccaagaagagttactctggaagattattcaagttctaatgtgccacaatttttcactagcattgcacaactagaagttcaagcacaaaccattacttatccaccatcattgatccagttggctggagtgcctgaagatgcaatccgtctgagcttgttttcattttctttatcaggagaagccaagaggtggcttcattcattcaaaggtaatagtcttaagacatgggatgaagtagtggagaaatttttgaagaaatatttccctgagtttaagactgcagaaggcaaagctgccatctcttcttttcatcaatttcccgatgaatctttgacgccaacatcattctattttaaagtcattggaagtgcacttagcgcaggtagtggcgctaagcctgaatcactcactaaagcgctaagcgccaatgctgcgctaagccccaaatgcttactggaagttacaacttcaagcagaggcacttgggttgctaccttggcacccaaacctttgcactctctcatctctgagcatatttctgtttctactgtgtgcttaccagcccctctgcatcccttgcttcttcacactctgcattacacaatccaatatcttctgggattcacgatgaacgcgctaagcgcgcctgctgcgcttagccgattcatcgcaactctcttgaaccaaaacgatgcaaacgctaagaacgccagtgcgttaagcgtcaatgcacgcctgtgcgctaaggctcagtgtctctctgttgagcctgagctaagcgccagcatgaaaaaatgttttctgtgtcttcgagctaagcgccagcttgctgcgcttagcgcttgtgttaatttcataaggaaaagaaaggcatcatctacacccacacaagttagatttaacaaatcaagatttacttcccaagaggcttgggaaagatatacagacattattgtgcctaggaagcttttgctagagaggaacgtggtggacgaggagttgactgactttggggatggcaacattgatgttgccattgttaaggaattctatgccaacctctatgaccccgaggaaaaatcacctaagcaggtgagggtgagaggtcatctgattaaatttgatgaggatacgcttaatgctttcttgaagacccctgttattgtggaagagggggaatcactctgtgcttattccagatttgcactcttgaggcttgatcctcaggagttggctgctaagctctgtatccaggggagggtattcgagcttaatgctgatgggcagcccctgaagattttgaggaagaacatgaccaccttagctcagatatggagtgttctttccttctttaacttgattcccacctcccatacttctgatgtcactcttgacagggccagactcatttatggcattattatgaagatggatatgaatgtggggggagttcagtctgactctagatccttggagagcctgagtcctgccattaatttggcttacattaagaagaactgttggaatctcaatgatctaaccatcacattcagaggacccaggaaggccaaagggaagagatctgaggccccttccacagcaccatcagaggcaccagcaccctcttcttctacacatcctccttcttcctccatagatattccagtgattcctccagcaccttcacaaataccactaccaactcctctttctgcaagtccagtagattttattttcactcctcagatgcctcagatgcttcattccatgctccaaagcatccatagaaggcagtccatcatcatgcagagacttcagggcttgggtttaccctctattatgagcatagaggagtttaacgcacaggtggcctggccaggagaccagccttcttcctctggagagggagagtatcatccacagaagatggttcaaggcgaatttgtaccaaatttgggggaggtatatcaaggtaaatttgtcccaaatttgggggaggcactgggtatgaaagctaagtacctaagaaaaaaaggcaagtatggggaaggaatgaatgaaaaagtgaaggttattctatggatgaatgctctcctagaacctaagcttttgaatcctagaaaaaccatgaattgttggcagcctaaccccattacaagcctagaaagttcatcggattcatttttatgtgttcatttctgtatgataggagatgaaatgcaaaggttggaacttgtgttggttgtttatgatggaataagcctaaacacttga

SEQ ID NO: 15217 - DNA, 837 bp, Glycine max
  Peptide Sequence Number=SeqID_106902
atgtggtataatgaaagaatatcaaaacataaaaattgtgtgagcccaaggttcagcttatgttgtggagatgacaaagttgaacttccattattacaaaatccacccaaacatctccaacgacttctctttgatgataatacaattgatagtaaaaattatcaacataacatatgggcatataacatgatgtttgcctttacttctgctggtattaagctagacaaatcaattaatgattccataggacctcctacaattagaattcagggccaaccatgccaccggataggcagcctattaccaatgcctggaaaagaacccaaatttgcacaactatatatctttgacacaaaaaatgaacctgctggaattcaaccacacattgtttcaagtttaagtcacatgttggatgaacacaatgtccatgctaaaagttttagaatggccagggatagattggcagatagtcaagtcgataatatcagattgaaattgatagctactcgtgaaaaagatggtcatgtatataatctcccaaatgttcctgaagttgttgcacttattgtaggtgattttgatccaatctcaaaaagagatattattgttgaaactcaacatggagaactacaaagaatccatcaattgccatgtagctatctaggcctacaataccctctactcttcccttatggtgaagatggatatagagttgacatacttcactgttctatgatgcctccccactgtagttactttttgtgcatttatgtctcaaggaaattttcaatggggagttttctcatcggaaagctcaccgggtcatcaaatatttaa

SEQ ID NO: 15218 - DNA, 144 bp, Glycine max
  Peptide Sequence Number=SeqID_106903
atggtgcgcacgcgcggtcacggggctgggacgtgcggaggtcacggatctggtggcccctccgacggcacgccgtttcgtcgtcttactttcccttcatcttcagatctggatttggatggtgtgacatggtgtgatgtttaa

SEQ ID NO: 15219 - DNA, 421 bp, Glycine max
  Peptide Sequence Number=SeqID_106904
atggcagaaccatcaaagaagcgaaagggcacttcgagtcggagtcaatggcattccgagtcacaggaaacgctgattccttcatctattccctctggatcattgttttcatctgaggaacagcggatacggtacacaaatctcttttcatctcgtttcattattgatccaaaattcattgatatggatttcttttcaaataagagttttgaatgcattcaagcatttgaaaactccaatcttattcatttcatgtcgttaaaattgtctgtttattctgatttagtgaaagccttctattcaaacctagaaatccaagaaggcactttaatttctgaagtttatgggattaagatggtcattgaccaatccctattctatgatttaacccaattgccaagtgaaggtgtaccatttgaag

SEQ ID NO: 15220 - DNA, 534 bp, Glycine max
  Peptide Sequence Number=SeqID_106905
atgtcaaataaagacaaatcagaaatttggcgacccggtcgtacagctctgcctcctcacaggaggaagtccaacacgtcggccatttcatcgtcctctggagctctgcctccctttccagaggccccaacggagaaatcgggccaatctccaggccatgctactgcagccttgaactgctcaggaccacatgacgtatacaacattccaacctccgcaagtgagcagaggtgcgtcctccactacctgctactgaccgtcctcaggctcctgtggtgcttggccctgcgcctgcctgggtgcacagtacttctcaatgaaggccttgttaataggaggtcagatgagcttgctgggggtgatgggcactccatagaactgacagagagggaggtcagagttgtggtcgctgggcaggatgttgctaagcagcaatgttatccaaatcttagtgagggtggtcatgctggtgcatatgattcgcactcatctccctgcggcagtccgggcgaagtcttgccccagtacgcatag

SEQ ID NO: 15221 - DNA, 498 bp, Glycine max
  Peptide Sequence Number=SeqID_106906
atgcttcgaagcattcatcagggacaaattattttacttcagagtttacaggtggtggcgcctctaggatccattcctttcgttgagcagtttctggagagggtagcctggcctggggcccaaccttctcttcatagggaagatgaaggtcccacagcccaggtaccacagcatgtagaggatgagtcatccgaggccaccattccagagccattcattttagaggaggaggcaggtgagacacaggctagacaggaagctgctgctactcttgagagatctcttgaggacacttcagagcctcttgcaccagtggtggacctatcctcgcctcagcatgcagcagaaccctccactcctatactcaagataccagaggacccgaccacaccagtcctgactctaaacacttctccttcagctactccagtacttcatctgacagatgaggaggatgttcaaacacaggacacccaggaccaatcacatgaattctaa

SEQ ID NO: 15222 - DNA, 204 bp, Glycine max
  Peptide Sequence Number=SeqID_106907
atgccagtttcggccaaaacaaaacgtccgttgagctcgcacaaaaaaaccaaaccgacctacatcgtaaattttttatgcaacaccaaaaccacaaaacttcttctacggctaaaggcccaagtggagaaggacgaaggcctaagtggagaaggacaaagcccccgagtggagaaggatgaaggcccaagtggagaaggatga

SEQ ID NO: 15223 - DNA, 678 bp, Glycine max
  Peptide Sequence Number=SeqID_106908
atgaccaccctgactcagatctggatgactttgctgctcagcaacatccagcccagcgaccataattccgacctccccctgccgaagtgtcagctggtgtacgccatcctgacgcggatgagcattcacatggctcagttaatcgctgatgccatctatatatttgcaggtatggcgcctaccaggcaccctctggacccggataagtccaacagggccctgggatttcccgccttgatcacaggactctgccagtcgttcggcgtccccgtcgcacctagcaaggtgattcggccgcccatcacccgagcttttattgagaagtattgcacacagagacaggcccagggggatgctccgcaggccgcaaacgcgccgccacctcatcaggctggtccaaccggatcgtttgatacggagcagtatttgcggcatttggttcgccagcaggcggccaaccaccgggctcatgtacagacccatgattgtctttaccagatgagcctcagcctgcagagccagggttttacttcttttccgtgccctactccgaaccagttcagggcagaggtcacatggcctggagattggcctaaggcccgggcaggagaggcaccagcagaggctcctgacgaagcagatgagggagcggggccacatgattgggagatcccttga

SEQ ID NO: 15224 - DNA, 441 bp, Glycine max
  Peptide Sequence Number=SeqID_106909
atgatcaaccgctggattgaagaagatggtctcgttgatacgctggaggaactaggcattggctccatcgtcttctcgccgctggcgcagggcatgctgacgacgaaatatctcggcggcgtgcccgatggcagccgcgcatcgcagagcaagtcgctgaacccggctttcctcaacgaacgtaatgtcgagaatatccgtgcgctgaacggcatcgccgaacgccgcggccagacactggcgcagatggccatcgcctgggtgctgcgtggcggtcgcatcacctcggcgctgatcggcgccagccgcgtcgagcaggttgaagactgtgtgaaagcgctggacaaaccggatttcacgaccgaagaactcgctgaaatcgaccgctatgccaaggacgcggatatcaacctctgggcaaaatctgccgaacgcgtctga

SEQ ID NO: 15225 - DNA, 507 bp, Glycine max
  Peptide Sequence Number=SeqID_106910
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcttcaaccaggagttgtttctttgctgctcaaaggaattttggagagggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 15226 - DNA, 728 bp, Glycine max
  Peptide Sequence Number=SeqID_106911
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 15227 - DNA, 135 bp, Glycine max
  Peptide Sequence Number=SeqID_106912
atgacatgcctttccaaagacaacccgataaggagacattcctatgtgtcgcaacgttccctttgcgggcgagcaagggcgaggctcacgggtgcgctttccaaaggaggaaagatgcgcggagtcgccaccaat

SEQ ID NO: 15228 - DNA, 510 bp, Glycine max
  Peptide Sequence Number=SeqID_106913
atcataggttctccacctgcctcccttcctccctcagacgcatcggcttcgccgtctaccgtgaagtggacacgcaaagcctcacgtctacgatcgttgtccactagaccacctggtgctgagagaccagtggtgcatgttgatcctgctaccgggaaggccgacgatccccacaggaagaaattaagaacatatttggggattgtggcacgtgataaggtggacgtcacctacgagaactggaaggaggtccctactgctcagaaggacttgatttgggaggatattcaggcggaatttgatatcctagaggcttctgacagtaggacgaaaaggaagttactacagaccgtgggggagagatggaggcagtttaaatcagacctcacgaggaaatgggcccttgcggccgatcaggacggtgtcgaggacactgtctgtgagaaatacggcatcaacaaggaaaagtgggccaagttttgccagactcgcagagacccttctcgggag

SEQ ID NO: 15229 - DNA, 48 bp, Glycine max
  Peptide Sequence Number=SeqID_106914
atggagcttgcatcaggtatcatcactcaagataataatattgtgacg

SEQ ID NO: 15230 - DNA, 420 bp, Glycine max
  Peptide Sequence Number=SeqID_106915
atgaatcaacctactactgtcaatgtcaaccctgatcgatggttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15231 - DNA, 339 bp, Glycine max
  Peptide Sequence Number=SeqID_106916
atggtttctatcagctgtccttcctgttcagctactgacggggattggttatccgcgtcacaattcggcacacaagcatacgagccggaagcatcagcgctggcaaggctgcccgcattcgtccagttcagggaaacctgtcggcaactgcataatgaatcggccaacgcgcgggcgatcgagtgcgggcctcttcgcgtattacgccagctggcgctaaaggcggatgtgctgcatactggcgattactatgttggcactgtaacgccagggtgttcccagtcagacagtgcttctgtggagaaaaaagctgcaccggtgcgtcagctgaatatgtga

SEQ ID NO: 15232 - DNA, 783 bp, Glycine max
  Peptide Sequence Number=SeqID_106917
atgaccccaaggataaatcacctaagcaggtggagggtgagaggtcacttggtgaaatttgatgaggatactttaaacacatttctgaagaccccagtcattttggcatatattaagaagaacggttggaatcttgatgatccaatagtgacatttatagggccaaggaaggccaggggtaagagatcagaggtccccactacttcagtagcaccagagacactagctccttcttcttccacagctctagtacctcacattcagactccagttattcctcctacatctactcagataccacttccagctctttcatatgcaggaccattaaactttatatttacacctcagatgcttcattccatgctccagagcttacacagggggcaatccattatcatgcagagcctccagggcttgggcttgccatccatcatgagcatggatgagtttgatgtgcaggtggcctggccaggagctcagccttctccttttggaggggatggggcctccacagcccaggagtctattcctgaggagccagcaacagtagcagcagaaggggaggatgagctcacccctcctgagcccttttattttgatccaggtgaacatatggctcacgaggaggagacttccacagaccagatcccggagccatccccagtacccatacctgatgatgctataccatctgcacaagcatatgagctagagcagcctatccctcaggattcaccaactgctcaggtgttagatcttaatgagcatacaaaggagtaa

SEQ ID NO: 15233 - DNA, 468 bp, Glycine max
  Peptide Sequence Number=SeqID_106918
atgaccggctctctcgatgagttgatctcttgctttctcataagggtggacccttggatactagtacctatcgccttaagagggttgcatgccttcaccttcagagggctgcacgtcctcgcctttagagggctccacgtcctctccttaagagggctgcacgcccttgccttcagagggctacacgccctcgcctttagaggactacacgtcctcaccttcagagggttgcacgccctcgccttcagagggctacacgctctcaccttcagaggactacacgtgctcaccttcagaggactaaacgtccttgccttcagagggttgcgtacccttaccttcagaggactacatgtccttgccagcagaggactacatgtcctcgtcttcagaggactacacgtcctcaccttcagagggccacacgccctcgcatatagaggactacacgtcttcacctcgccatga

SEQ ID NO: 15234 - DNA, 366 bp, Glycine max
  Peptide Sequence Number=SeqID_106919
atgcattttatggacacgagagcccggaagatcatctcttcttacttacaacatttgggcatcatggttcatttgcagtcatcaccacagtgccccatgtatgcatttaagaagaagcaaacttcattgcttcatgatgatgaatcaagattgattcaaggtgattcaaggtgttttgatcaaaacaaagatgatgacaaaaagcccatgagaaagattcaagagaagtttcaagtttcaagttttcaagaatcaagaatcaagaataatcaagaactagattcaagactcaagattcaagaatcaagaaaagactcaatcaagataagtactgaaaagtttttcaaaacattgagtagcacatga

SEQ ID NO: 15235 - DNA, 297 bp, Glycine max
  Peptide Sequence Number=SeqID_106920
atggagtgcttagagagtgtttgggagaccctcgaaggcaatgagaggtgccgattccgtggcacaattcgactcactgctacttcgctagtgtcatcctctgaagaggatcttgaagaggacccagaggagttacctcctgaacctgctatggatgcccctgacttaccagaggatgatgaggacccgctccctgacattgattctccagaggatattatgttagcatctgaggtagactcaacagaggagagtggccctggagggacagcgaatagtgacgactcttcatcatag

SEQ ID NO: 15236 - DNA, 171 bp, Glycine max
  Peptide Sequence Number=SeqID_106921
atggcctccaggaagaggaaagccacaacatccctaccccaggagccctatgacaccaccagaagacaaatttccaaaacaggttcgagtcagggaaagctgattaagtttgatgctgcattgctgaatgctttcttggagacaccaccagtcattcagccaggggaatag

SEQ ID NO: 15237 - DNA, 474 bp, Glycine max
  Peptide Sequence Number=SeqID_106922
atgcggtggtctgacagcgagcaaaggtggctcgtggttgtcactggtggtcagtggtggtggaggaggaggttggggcctgcaacactcgcccaggcaaaatttggctcacctgggcgagctgatccagctcaaattttaatgctttggttaaaaaatcatatatcatactcaagatgttatattgcaaatcccaaaggtcagaatgttcaaaattgggttgcgagcctacagtccacaattgaaagcgatccagcgttatgcttccatgattgcatccacaaagggatgaaattggtgggcaatgatcaaggcatgatcgtcaggctcttgacgcgatatcttcaccatagttgttgggctcccattttcaagggttcccatggtaggcattccaaacaaaggagatgcttgcctttgtggtggtattccttggttggttgcgggggcgttattggtgttcgcttccattga

SEQ ID NO: 15238 - DNA, 225 bp, Glycine max
  Peptide Sequence Number=SeqID_106923
atgggcccaaaatctaccctaaggctcatgagaaccctagggccttctcctgcatctctggcccaatctacttggagtcttctatccaatgcccttgctgtagaagcaaagcttcatggtaaatcaaagatgatgacaaaggagatgaaaaaaagctcaaaagtgaatcaagaacagttcaagataagaatcaagaagaattcaagacttaaggagaaagtttag

SEQ ID NO: 15239 - DNA, 126 bp, Glycine max
  Peptide Sequence Number=SeqID_106924
atggacacctatgttagtcctttgtccacacaaatcactcctaacgttgttggagatgaagaacctgacgacgttcacgctaatcgaagtagctacaaaggtcgttcaaaagttgcaaccacgtga

SEQ ID NO: 15240 - DNA, 172 bp, Glycine max
  Peptide Sequence Number=SeqID_106925
tgctttaaaaggtcttgatgatgctccacaacctaaatcaaaggttcctactaggtggattgtcgtcaagatgaccaccatcattttaggaagtttcagaaataactgggaagcgtattttaacgatcctagaccattggagtcagagagattaaaggcgcttcgaatctag

SEQ ID NO: 15241 - DNA, 235 bp, Glycine max
  Peptide Sequence Number=SeqID_106926
atggaatctccttccctcttaggtgctttgttcgcttatcctcgatcctcaaaggcaatgtttcatatgtcaagttctccttcacttacaggggtaatgcaatttgggatgtgtcgcaaccgacccatcggcgggagggcgacgcgagggctcatgggtgcatcttccatgggaggaaaatgcgcggagtcgccaccaacgtttattcgaggaaaacgtcggaaaaaccggaaag

SEQ ID NO: 15242 - DNA, 443 bp, Glycine max
  Peptide Sequence Number=SeqID_106927
atggcacagcattggagtcagaggctagctactgctccagagactgtggagtgcaaggctggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggagcggagatttcctggaagatgccaggaagatacttaacagggaa

SEQ ID NO: 15243 - DNA, 193 bp, Glycine max
  Peptide Sequence Number=SeqID_106928
atggctgcaaaagacgtaaaattcggtcgctctgcgcgcgaaaagatgctgcgcggcgtcgatatccttgctgacgctgtaaaggtaacgctcggcccgaagggtcgtaacgttgtcatcgacaagtcctttggcgctccgcgcatcaccaaggacggcgtatcggtcgccaaggaatcgaactgggaagaca

SEQ ID NO: 15244 - DNA, 387 bp, Glycine max
  Peptide Sequence Number=SeqID_106929
ccatctgccccatctgatttgtcaaactctgaatggaggctcttgtctcttgctgaaattgcatattctggatggtcatttgcctcactaactcctctaaggaaggttgagaaggggcctcaattgcttgttgtctttgttgtcgctgctgcattggaggaggaacatatggcctacttggaccagcagcattttggaagggagggacaggctgttgttgttgctgttattgttgtggaggatttgccaatctcatatttggatgattactccaacctggattgtatctgttgcttgaaagatcataattattctgttgttgttggttttgctgctgagggggtctattataaatgtttgcagcataggcttcaggttgctcattga

SEQ ID NO: 15245 - DNA, 117 bp, Glycine max
  Peptide Sequence Number=SeqID_106930
atgactgagaattgggaattggaaggaggattgatgccatcccttgaagaatttgagtcaagaagaaaggggccaaccaccttaagagctattggactaagaagcactccaaattga

SEQ ID NO: 15246 - DNA, 851 bp, Glycine max
  Peptide Sequence Number=SeqID_106931
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttttatgtgaatacggctatacacagctagtgactaaactgccgaccatcactacttttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15247 - DNA, 743 bp, Glycine max
  Peptide Sequence Number=SeqID_106932
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaaaacatcaatactaacataatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15248 - DNA, 208 bp, Glycine max
  Peptide Sequence Number=SeqID_106933
aaccttaccagggcttgacatgccgcgaatcctcttgaaagagaggggtgccttcgggaacgcggacacaggtggtgcatggctgtcgtcagctcgtgccgtaaggaaggtgaggatgacgtcaagtcatcatgccccttatgccctgggcgacacacgtgctacaatggacgggacaaaggatcgcgatcccgcgagggtgagctaa

SEQ ID NO: 15249 - DNA, 231 bp, Glycine max
  Peptide Sequence Number=SeqID_106934
atggcctctggtaatcgattaccaagggtgggtaatcgattacaaggcttaaaaatgaaggaacgtgagagggcttctagtaatcgattaccaatgctgtgtaatcgattaccaggcttagaaatggagacaagtaacaagccactggtaatcgattaccagttatgtgtaatcgattacacagtgcatattgcaggttttcatgttctgaagctgtgtaactcgagttga

SEQ ID NO: 15250 - DNA, 266 bp, Glycine max
  Peptide Sequence Number=SeqID_106935
atggcctccaggaagaggaaagccacaacatccctaccccaggagccctatgacaccaccaggtttacatctgagggcgcctgggaacgatattcacagaacattcactctcggaacatccttctggagaggaatgttaatctttttgtgactgagtacgatgaattccgccgggagctgatcaggcagaactggcacaaggccttgacccagcatatggacagggacattgatgtagccctggtcaaggagttctactcgaactt

SEQ ID NO: 15251 - DNA, 51 bp, Glycine max
  Peptide Sequence Number=SeqID_106936
ggaattggaaaggaggattggtgccgtatcttgaagaatttgagtcaagaa

SEQ ID NO: 15252 - DNA, 714 bp, Glycine max
  Peptide Sequence Number=SeqID_106937
atggtgaaagttggaacctcttacgtgccgatcaacgtctcattttcgccaaaagttggcccagggcttcccggtatcaacagggacaccaggatttatataataaattcattaactgatcaatccgtcactatcaagcttattcgcaaaggcgcccgctttccattcgggaaaccatgtcggtgcgcaactgcatatgaggccaagcgcgggcgatcgagtgcgggcctcttgcgtattgccggcgctaaagggcggagtgtgcatacggcgattaagttgggtgcagggtgttcagtcgaagtgcgttcatgtgggaaaaaaaggctgaccggctcagcagaatatgtgatacggactcactatgggcgattcctcgctgactccacgctcggtggcggcagcggaaagtggcctacacgggctgcaggaattcgaagatgccaagaagatgattttaataaacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtag

SEQ ID NO: 15253 - DNA, 249 bp, Glycine max
  Peptide Sequence Number=SeqID_106938
atgggggtgcaaatagcaaccaggccaacttgggccctccttgcttgcctgggcgagctgggtggcaagcttctcccccattttcttataaataaggggagaagtgaagagaaatttcgttcagccctcctgccgaggcacttccgtaacgtttccgtaacgtttccgtgggtgatttcgcgaaggtttttgaccgttcttcgacgttcttcattcgttcttcatcgttcttcggtcttcaactggtaa

SEQ ID NO: 15254 - DNA, 738 bp, Glycine max
  Peptide Sequence Number=SeqID_106939
atggcacgagaatacttcccaaatgaatatatgatgtggaattgcccctcaagagtaggtagatggcatgaaggtttcttttcaaatgcaagtgtgtgcgtgacgaaatggccccgaggaagctcgcctcaaagagatttaggaaggataaagcggctgaaggaaccagttctgctcccgagtatgacagtcaccgctttaggagcgctgaacaccagcagcgcttcgaggccatcaagggatggtcatttcttcgggagcgacgtccagctcagggacgacgagtatactgatttccaggaggagataggtcgccggcagtgggcatcactagttacccctatggccaagtttgatccagacatagtcctcgaattttatgccaatgcttggcctacggaggagggcgtgcgagatatgaggtcctgggtgaggggtcagtggatctcgtttgatgcagatgctatcggccagctcctgggatatccgttagtgctggaggagggccagaagtgcgagtatggccagaggaggaaccggtctgatgggtttgatgaggaggccatcgcccagttgctatgtataccagggcaagattttgctcggactgctgccgggagacgggtgcggatcatgcgcaccaacatgaccaccctgactcagatatggatgactttgctgctcagcaacatcctgcccaccgatcataattccgacctccccctgccgaagtgttag

SEQ ID NO: 15255 - DNA, 840 bp, Glycine max
  Peptide Sequence Number=SeqID_106940
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttgtttcacgttcaacaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15256 - DNA, 770 bp, Glycine max
  Peptide Sequence Number=SeqID_106941
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcaacagaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15257 - DNA, 695 bp, Glycine max
  Peptide Sequence Number=SeqID_106942
aatttcaggctgcatgccctcaccttcagaggactacacatcatcgccttcagagggtacacgccctcacctttagaggactacacgccctcaccttcagaggactacacgtcctcaccttcagagggttgcacgtcctcgccttcagaggactgcacgtcctcgtcttcagagggctgctcgccctcaccttcaaagggctgcataccttcagaggactatacgtcctcaccatcagaggactacacgtcctcgctatcagagggctggtcgccctcaccttcaaagggctgcatgccttcgcctttagaggactacacgccctcgccttcagaggactacacgtcctcaccttcagagggctgcacttcctcaccttcagaggactccatgtcctcatcttcagagggctgctcaccctcgccttcagaggactacacgtcctcgccatcagagggctgcacgccctcacctttagaggactacacgtcctcgtcatcagaggactgcatgtcctcaccttcagaggattgcacgtcctcatcttcagagggctgcactccctcgcctttagaggattgcacgtcctcgtcttcagagggctgcacaccctcgcctttagagggctacgcgtcctcactttcagtgggctccatatccacaccttaagagaatttaaggtcctctgcccttaa

SEQ ID NO: 15258 - DNA, 337 bp, Glycine max
  Peptide Sequence Number=SeqID_106943
atgccgactggcgctgctgctcgagggcgatcatgttgtgctgctgctaatgccgaccgcaagttctggatcggcgcgcgcaccggcagcagcatattgccacgtttacacaggtcaagctggaaaaacgcctgcactgacgcactggctcagcggactggccgagctgcagatttatggcgcggcgacgctgtggcgacagcggctggatcaggaagaacgtgcgtggcaacaggcgcagcagcagcaacaccggctgcaggcgctggcgcagagcctgcttacgttgatcgccggcagtaccgttacgctgctgctgtggctggccgccagcggc

SEQ ID NO: 15259 - DNA, 519 bp, Glycine max
  Peptide Sequence Number=SeqID_106944
atggcgcaaaacggtaatatgatggtggaagtgaagccgtggtacgtggtgggcagcaccgatgacaacccggatatcaccaaatatatgggctactatcagctcaggattggctatcagctgggtgatgcggtgctgagcgccaggggccagtacaactggaacaccggttacggcggcgcagaagtgggcttaagctacccgatgaccaaacacgtgcgtatttatacgcaggtctacagcggttacggcgagtcgctcatcgattacaacttcaatcagacccgcgcgctgaaaatagcgcctgtttcatttctggcatatggggttaacgtggcgcaggcggaagtattgaatcaggagtcgctggctaaacaggttttgcatgaaacctttggctaccagcagttccgtcctggccaggaaaccatcattgaaaccgtgctggaaggccgtgattgcctggtggtaatgccgaccggtggcggtaaatcgctctgctatcaggtgcccgcgctg

SEQ ID NO: 15260 - DNA, 848 bp, Glycine max
  Peptide Sequence Number=SeqID_106945
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggggccaagagtagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15261 - DNA, 291 bp, Glycine max
  Peptide Sequence Number=SeqID_106946
atgggttggagtatccttgcaagactgggtaaccctgacgtgccaccggcagtctcatctcaggcattggatagaagactccaagtagattgggccagagatccaagggaaggccctagggttctcatgagccttagggaggtgagcttagctattagagaggtatgtgatgcaatcctccctaggaagggaccaatcattagaaccatgagcaagaggctccaagaagattgggctagagctgctgaagaaggccctagggttctcatgaaccttagggtagatttctga

SEQ ID NO: 15262 - DNA, 657 bp, Glycine max
  Peptide Sequence Number=SeqID_106947
atgggagttttcttactatggctcgtagttgtgtctattcctaaatcgatacaaaaaagaaataagtgcaaggaaagcttccttcagacgactacaacaagtgaattggacaagccaattatgatccctaaggtagattgctacaagggcaaggagaagatgactggagaatatgaagatgtaccctctaccccctatgtcaaggcaagactagacagacttttcaagcatgaagtggttgtgatgcaacaaatgaaggaacttacaagtattgattggcaagatctacaaagatattacatagtgggagcttattgctctagtctagaacctaaagagaagtcatcaatagatggagttcatcacacaatagggcgctactttcaaactatcaatcacaatctctttgtcgtttatggaagagagattttgttatgtctgagcacaacttctcattcactgttgatcttccaaactctattttcacctttattcatcatgtcaagtcaatcattgaagagacttggccatgaagtctttgatggccctcctccatctcagaagtatatgtgtttgattaaggaagcactacttataactagggaggttcttgctgaagctcttcatgatcaagctcatgctgatagagaagcctag

SEQ ID NO: 15263 - DNA, 294 bp, Glycine max
  Peptide Sequence Number=SeqID_106948
atggccgttttttacatgaagggagatgaccttagttggttcaaagttgtctctagaatatgtcaattggatttaatgatgaaatatgtgcaatttcagttgagcttagctcatcagtgggctaagcgtgcatctatcgctaagtgtagcttcagcgtgacagaagaatctggcaaggcatcaatatcaaggccgtgtgctaagcgcgagatcagtgcgctaagtgcagcagttgtcttcagccaggctcagtgcatgactagcactaagctcaaatccacttactcgtgctga

SEQ ID NO: 15264 - DNA, 669 bp, Glycine max
  Peptide Sequence Number=SeqID_106949
atgacaccggtaaccgaaaggcaggaacagagagcgcacgaggagccgcagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacataaagccaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15265 - DNA, 480 bp, Glycine max
  Peptide Sequence Number=SeqID_106950
atgggcgccgcgttaacaaggggcggcgttccccatttcggccatttccagggcttgcgcaactgtttgggaaaggggcgatcgggtggcggggcctcttcgctatttacgccagctggcgaaaggggggatggttttcccagtcacgacgttgtaaaacgacggccagtgaattgtaatacgactcactatagggcgaattggagctccaccgcggtggcggccgctctagaactagtggatcccccgggctgcaggaattcgatgtttgatggtatctactactcggataaccgtagtaattctagagctaatacgtgcaacaaaccccgacttctggaagggatgcatttattagataaaaggtcaacacaggctctgcctgttgctttgatgattcatgataactcgtcggatcgcacggcctttgtgccggcgacgcatcattcaaatttctgccctatcaactttcgatggtag

SEQ ID NO: 15266 - DNA, 321 bp, Glycine max
  Peptide Sequence Number=SeqID_106951
atgacaccggtaaaccgaaaggcaggaacaggagagcgcacgagggagccgccagggggaaacgcctggggggcggagcctatggaaaaacggctttgccgcggtgccctctgcaggttccctgttaatcatcttccggcgatctcgaattcctgcgcccgggggaccactttcgagcgtgccgccaccgagcggtggagctcagtgattcgcgaggaagccggaatagtagtcgtatcacatattcgctggcacgtgcgccttttttctcctgccacagaagcacttcactgggaacaccctcatcaggccaacatataa

SEQ ID NO: 15267 - DNA, 300 bp, Glycine max
  Peptide Sequence Number=SeqID_106952
atgccctctaggggggaggaaaccatacctcttcacagggttctacccctcgttagaccacaggaagcaagtcgaaaatggggtggtcggaataccgagaaaatatttggaggtaaaagcaagaatcttggcagtttcgcaccttttttgccaagaggtgaggcatgcttgcccgttagaaagccaccgttcatgcacagagaaaggaagggcgaattgggatcaactcttagcaagcaaagaagaagcatctgtcaactggttccctcgatggaaggaaggaagaatcggcactactaa

SEQ ID NO: 15268 - DNA, 204 bp, Glycine max
  Peptide Sequence Number=SeqID_106953
atggacccgggtataaggcccattttcaactcacagtgtgtgcaaaaagtccccagtggagtcgctaactgtcgcaacatacctttcggcggaagggcgacgcggggctcatgggtgcgtcttccaagggaggaaggcgcgcgaagtcgccaccaacatttattcaaggaaaacgtcggaaaaaccggaacgtgtggtctatga

SEQ ID NO: 15269 - DNA, 435 bp, Glycine max
  Peptide Sequence Number=SeqID_106954
atgaccatgattacgccaagctcgaaattaaccctcactaaagggaacaaaagctggatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15270 - DNA, 230 bp, Glycine max
  Peptide Sequence Number=SeqID_106955
tcctacagggtgcccgttccccccggcaaggtcacgtcatcatgacatagggatcgcgcctgcaagacacccaatggacccgaagaagtccaatagggtcttggagttgtcaagctctaattacgggcaggcgcagggcaaaacaccacaacagcctggggatggccgacagcgggcaacagacgcaccgccatcacctctagagttcacctcagctcatccacaaaaag

SEQ ID NO: 15271 - DNA, 234 bp, Glycine max
  Peptide Sequence Number=SeqID_106956
atggaatattccaatgctggatcaattcatccgtgcatccaggattctattgaaaacattattggtgtcaaagcgaatggtaactgtggttatcgggcaatagctgccttattggtgtgggtgaagaatcatggcttttttacgagaccattgtcctttagcaccattggcgttgttgtggaacacgcattgtcattatcagacaaagcagtggcccaccccgtacataggtag

SEQ ID NO: 15272 - DNA, 107 bp, Glycine max
  Peptide Sequence Number=SeqID_106957
atgcctaaatgggagggcaaaagggtcattttaaagctttttctgacccctggcttgcccaggctagcctctggctcgcctgggcccccaaatagcttaagggtgaa

SEQ ID NO: 15273 - DNA, 258 bp, Glycine max
  Peptide Sequence Number=SeqID_106958
atggccacaatgatggaggccatgatgagcatgaagaagataacggaagccaatgcggttacagttgccactaccagcgctattgctaaggtgaacccgatgccctcatctggccttaaccaaatgaatcatccaacctcagatatgacacatgaaattccccaccacaatctagccgacttcgcgccttgcctcggatatgccactggagggcaagcagttgtggtacccatgccaaacactttggagggcccttag

SEQ ID NO: 15274 - DNA, 911 bp, Glycine max
  Peptide Sequence Number=SeqID_106959
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatgacaactttggaaggacttcaactgactcatacgcatttgagttctctcgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttctctctggcggctctctcgtgcgctctcctgttcctgcctttcggtttaccggtgtcattccgct

SEQ ID NO: 15275 - DNA, 768 bp, Glycine max
  Peptide Sequence Number=SeqID_106960
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtacttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 15276 - DNA, 321 bp, Glycine max
  Peptide Sequence Number=SeqID_106961
atgggcgaaagcctgacggagcaatgccgcgtgaaggtagaaggcctacgggtcatgaacttcttttcccggagaagaagcaatgacgttcgccgtcaaatcccagggctcaaccctggacaggcggtggaaactaccaagctggagtacggtaggggcagagggaatttccggtggagcggtgaaatgcgtagagatcggaaagaacaccaacggcgaaagcactctgctggggccgacactgacactgagagacgaaagctaggggagcgaatgggattagataccccagtagtcctagccgtaaacgatggatactag

SEQ ID NO: 15277 - DNA, 917 bp, Glycine max
  Peptide Sequence Number=SeqID_106962
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcagttcatttgtatctggttgcctgatatctcttacattgtattgtgtgggtctgtactgacgagtcttgatgtagcaacaaacagtcagttgttgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 15278 - DNA, 270 bp, Glycine max
  Peptide Sequence Number=SeqID_106963
atggctgtgatatctcccgggaagatctaccaacctcctttcccaaagtggtataaccctaacgcaacttatgcataccatgggaaaaccccgggccactctaccgaaaaatgcctggcccttaaatacaaggtccaacatttgatagacgccggatggctgacgtttcaagaggatcggcccaatgggaaacaaacccgctcgccaatcatggagggggagcaattaatgtcgtcgagtcgggtaggccgcgcaggtctaagcctttga

SEQ ID NO: 15279 - DNA, 376 bp, Glycine max
  Peptide Sequence Number=SeqID_106964
gtgctccagtggcttctgtttctatcagctgtccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacggggtggagacgatggg

SEQ ID NO: 15280 - DNA, 279 bp, Glycine max
  Peptide Sequence Number=SeqID_106965
atgttggtgcgcatgatccccactcgtctccatgcagcggcccgggtgaaatcttgcctcgatctgcagggtagctgcacgaaagcctcctcctctggttgtgctcgcatagttggccctcctccaggatcagggggtggccaaggaactaataaagggaaacttctggcccctcatccgggagcacaagtctcgccctctgaagtcgaggatgtgtcaccctttgaaggcaagggcatgcaaccctctgaaggcgagggcatgcatacaaccttctga

SEQ ID NO: 15281 - DNA, 492 bp, Glycine max
  Peptide Sequence Number=SeqID_106966
ttaggaacctcttacgtgccgatcaacgtctcattttcgccaaaagttggcccagggcttcccggtatcaacagagacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaccggagtgtatactggcttactatgttggcactgatgagggtgtcagtgaagtgctttcatgtggcaggagaaaaaaggctgcacctggtgcgtcagcagaatatgtgatacaggatatatttccgctttccttcgctcactga

SEQ ID NO: 15282 - DNA, 228 bp, Glycine max
  Peptide Sequence Number=SeqID_106967
atggctcaacctccaatcttgaggacttatcagatgaatacgagacttgttgggtcaaaaaccatgatagtgatactgactcctcttccgggcccgaaggagataacctgtctccatcccacgaaacaatattcaaatgggattggtaatttacggatcattcatgtcttagttatatctgctttgagtttacccaattttactgcagtaggagacatggtaacataa

SEQ ID NO: 15283 - DNA, 1108 bp, Glycine max
  Peptide Sequence Number=SeqID_106968
tatcgcggttgagcgccagcaggcgacgcagatcgccgcgccaggcctggcgcagcatcggcagggtaataccgcgcaggcgcatcacccgccacgccagccacaggccgagcaacagcgtggcgtattcggcgatggcggtggccgccgccgcccctcgcacgttccagcccaggcccatcaccagccagatatccagtacgatattcagcaggttgccgacgatcagcaggatcaccggcgcccgcacgtactgcacgccgagcagccagcccagcagcaccagattggccagcgccgccggggcgctgagccagcggatctcaagaaaacgccgcgcctgttccagcacttcgccatcgccaccgacgatccgcagcgccagttcgatcagcggataacgcagcaggacgatcgccgctccggccagcagcgccaacagcagcggttgcataaaggcgcgcgccagcgcctgcgggttctgtgcccccagcgcctgcgccgccaggccggtggtgctcatgcgcaggaacaacagcagcatgaacaggaagctggtcgccaccgcgccgatcgcgacgccccccagatagatcgggctgtcgaggtggccgatcaccgcggtgtccaccagcccgagcagcggcacggtaatattggagaaaatcatcggcaaggccaggcgccacagagctttatcggtgtcgctgcggtggcgaatggcaaggtcagaaacaaaaacgccccagaacaggggcgattgatacaggaggcggcactgagggtgcgacgattaaatccagtcgccgttgcggatcacgccgaccgccagcccttcgatagtgaaattctgctgacgcagatcgaccacgatcggttggaattcgttgttctctggcagcagttcaaccacgttgccgtgctttttcaggcgcttgaccgtcacttcgtcttcgatgcgcgccaccacgacctggccattgcgcacgtcttgcgttttgtgtaccgccagcagatcgccatccagaatgccgatgtcgcgcatcgacatgccgttcacccgcagcaggaaatcggcgctcggtttaaacagggaaggatccacctg

SEQ ID NO: 15284 - DNA, 411 bp, Glycine max
  Peptide Sequence Number=SeqID_106969
atgtgggtgcaagccattggtctgtttgctcaagtgacctgtgctcctgagtttggacttccaagaccgttcaatcagagattactcgtcttgcacgttggtgggggtgccgtaaaacaacgagtaaaatttcctacagctaatgtccaatcttttgaatttggaatgaccggccctctcaatgagtcaatctcttgctttctcataagggcggacccttgggtactagtaccctcaccttcagaggactgcacatcctcactttcaaaggactacgcgtcctcgccttcagaggactacacgtcctccctttcagagggctacacgccatcgccttcaaaaggctgcacgccctcgcctttagagggctatgcatcctcattttcagtgtgttccatatccacaccttaa

SEQ ID NO: 15285 - DNA, 210 bp, Glycine max
  Peptide Sequence Number=SeqID_106970
atgggtaaagcagaggaggtgcaagagaaggtgaaggccgacatggaggccatgaaagagcaaatggccacaatgatggaggccatgatgagcatgaataagataatggaagccgatgcggttgcagtcgccactaccagggctgttgctaaggcgaacccgatgcccccgtctggccttaaccaaatgaatcatccaaccttagctatg

SEQ ID NO: 15286 - DNA, 1017 bp, Glycine max
  Peptide Sequence Number=SeqID_106971
gccctgttcctgagaaactggtccctaaaagacaacagggagtgaagatttctgaaaaccctagctttgcaacaagccctagggaagaagacactgagatggataagaagatccgcagttttgtgaatagcattttgaaaaatgcttctgtccctgatgctgataaagatgtcccaaaatcttccaccccaaatgctgaagtcctctcttcatccagtgaagagaaatcaacagaggaagaggatcaagccacagaggagacccctgcaccaagggcaccagaacctgctccaggtgacttcattgacctagaagaagtagaatctgatgaggaacccattgccaaaaagttggcacctggcattgcagaaagattacaaagcagaaagggaaaaccccccattactaggtctggacgaatcaaaactactgcacagaagaagagcacaccaatcactcctaccacatccagatggagcaaagttgcaatcccttccaagaagaggaaagaaatttcctcatctgattctgatgatgatgtcgaactagatgttcccgacatcaagagggccaagaaatcagggaaaaaagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgccccccctcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacag

SEQ ID NO: 15287 - DNA, 210 bp, Glycine max
  Peptide Sequence Number=SeqID_106972
atggaggctgaaggtcaagctgtgaccagagaaatcttcaagagggtatttatggagaaatactttcctaaggatgtttggaacaagaaggagatggagttcttagagctcaacttgcggcttgaggtgaagcaagctatgaactatcaaggtctctgccagtttcctcttttggtgaacttatgtcagatttgggatgaggactcctaa

SEQ ID NO: 15288 - DNA, 1806 bp, Glycine max
  Peptide Sequence Number=SeqID_106973
atgaagggagtccggcataagctggagcgcagcaatgaggagagcggagtggagaagtggcgtaactggatgatagggatctgtctggtcagcacggccggcagcgtgtgggccgattcgctggatcagcaacgacagcgctatgcgcagatcaaacaggcctgggacaataaacagatggaccaggttgagcagctgatgccaacgctgcaggattatccgctctatccgtacctgcagtaccgcctgctggcgcaggatctcgatcaggagaccgggctggcggtgaaaaactttattcagcaatatccgacgctgccgccggcgcgttcgctgcagacgcgctttgttaacgtgctggcgcaccgccaggactggccgggcgtgctcagcttcagcccggatgagccgaagccggtgcaggcgcgctgtaactggtactacgccaaatgggcgaccggtcagcagcaggcggcgtttgacggggccaaagccatctggctgcgcgggaccgcgttaccgaacgactgcgacaagctgttctcggtgtggcgggcgtcagggcagctgtcgccgatcaccatcctcgaacgcatccgcctggcgatgaaagccggcaacgacagcctggtcaattacctggcgaaaatgctgccggcggattatcaaaccaccgccagcgcgctgattgcgctgcagcaaaatccccagaccgtcaccacctttgccagcaccctcggcccgaccgattttacccgcatggccaccagctacgcctttgcccgcgtggcgcgtcaggatatggacaatgcgcgcatgatgatcccgcagctggttcaggcgcagaagatgagcccggcggaagagcaggatctgaaagagacggtggtgtggcgcatgatgggtgccgatctcacctcggagcaggcgcgctggcgcgatgcggtggtgatgaacagcgaatccaccgcgctgattgagcggcgcgtgcggctggcgctgagtgaaaacgaccgtcgcggtctgaacacctggattgcccggctgccggtggaagccaaagagaaagatgagtggcagtactggcaggccgatttactgatggcgcaggggcgcaaagaggaagcggaagagatactgcgtaagctgatgcagcagcgcggtttctatccgatggtggcggcacagcggctgggcgtcgagtatccgctgcaggtggatcaggcaccggcggcggacaatagcgtggtgcaggggccggagatggcgcgcgtgcgcgagctgatgtactgggggctggataacctggcgcgcagcgagtgggccaacctgatcagcagcaaaacccatacccagcagcagatgctggcgcgctacgccaacgagcaggactggtgggatctcagcgtgcaggccaccatcaccgcgaagatgtgggatagcctgaaagagcgtttcccgctggcgtggcgcaatctgtatcagcaatacaccagcgataaaggcatcacgccaagctacgccatggcgatctctcgtcaggagagtgcgtggaacccgaaagcgcgctcaccggttggcgccagtggcctgatgcaggtgatgcctggcaccgccagccataccgtgaagatgtacaacattccgggttacgttaacagcagccagctgctcgatccgcagaccaatattcagattggtacgcagtatctggagtatgtctatcagcagtttggtcagaaccgcatcttctcctctgccgcctataatgccggcccggggcggcgctgccactgctgcagctga

SEQ ID NO: 15289 - DNA, 366 bp, Glycine max
  Peptide Sequence Number=SeqID_106974
gacatagactatgttataaggaaagatgaaccacctacaatcactaatgaaagtagtccagttgttgcgctatatgagcggtgggagcaatctaactggctcagtgtgatgttcattaagaccaaaatctcgactgagatacatgattctgtgaatcagcatgaaaaggttcgaaacttgcttaaggttattgatgaccagttcatcactttagataaggctttaacaaacatcctgatcatgaagttctcctttctccagctcactagtgtgaaaggttccttcatgatgcacttcattctgaacacccttccaccagaatatgggtcgtttaagatttcatacaacacacgtaaggacaaatga

SEQ ID NO: 15290 - DNA, 383 bp, Glycine max
  Peptide Sequence Number=SeqID_106975
agcttcaacattcaattttgagcgtctcgttatattacgggactcaatcagacatccgagtaaaaagttattgtcgtttgaatttgctcaaagcatcaacattcaattcgagcgtctcgatatattgcgggactcaatcaaacatccgagtaaaaagttattgtcgtttgaattggcttagaggttcaacattcaatttcgagcgtctcgatatattacggaactcaatcagacatccgagtaaaaagttattgtcgtttgaattggctgagagctccaacattcaatttcgagcgtctcgatatatgcgggacacaatcagacatccgaataaaaagatattgtcgtctgaattggctcagaggttcaccattcaattttga

SEQ ID NO: 15291 - DNA, 626 bp, Glycine max
  Peptide Sequence Number=SeqID_106976
gtctgccatggaagctcttgaggaaagatcttaccactctagcccaaacctggagtgttctatcttattctaacttggccctaacatcccatacttctgatcttaatctggatagggccagggctagaagatatgaggcccaatctccttcagctacccctgctccccctacttctgctccttctacttctgctctcccttcagctccagcaaccccaattcttccagagcttgcaccagggccagccctgattatgcagagcttgcaggatgctacctggccaggagtccagccttctcctttgggagggggtgaggcctccgtagcccaagagcctcagccagaccaggaggatgacattctagaggcctcaaagcccattccatcggagcttttcattgttgagactagcccaaccattccacaagaggatgctgcagcagttaccccacaggtgactccgcagcctcaaccagagcctaccactttagcgttggacttgtcatctcctcagcttgagccatctgcaccagtgccagacctgcctctttctcaggattcaccatcaggcactcctgcacaggatctgaatgagcatgccacggactctgcacaagatcattga

SEQ ID NO: 15292 - DNA, 522 bp, Glycine max
  Peptide Sequence Number=SeqID_106977
atggtgaggacgtgtagtcccctgaaggatagggcatgcagccctctgaaggtgaggacgtgtagtcctctgaaggtgaggacgtgtagtcctataaaggcgagggcgtgtagccctttgaaggcgaggccgcgtagccctcggaatgtgaggacgtgtagtcctctcatggttagggcatgtagccctatgaaggtgaggacgtgtagccctctaaaggcgagggcgtgcagccctctgatggcgaggacctattgtcctcttaaggcgagggcgtgcagccctctgatggcgaggacatatagtcctctaaaggcgagggcgtgtagccctctgaaggtgagtacgtatagtcccctcaaggcgagggcgtgtagccctctgaaggtgacagcgcatagccctcagaaggtgaggccatgtagccctctgttggcgaggacgtgtagtcctctgatggctaggacgtgtagtcctctaaaggcgagggcgcgtagccctctgacggcgaaggacgtatag

SEQ ID NO: 15293 - DNA, 606 bp, Glycine max
  Peptide Sequence Number=SeqID_106978
atgtcgctgggttggcgaattcttactttagctgtccctcttcttgtcattgcgggcctagagaccacctaccagatctctcagaaacgaaatggcttggctgatatcacatccgatggttatattcgctacacctgggtatatatccctgcgtttatcatgctcttgatacaggctcttttcgaatgcagccacttctctactcaggtcattcagccatacctggagttgagacgaggaggattgaccgcacaggaaagcttgatggacaattacctgtcgaaactcaccatgcatgctctttggagcgcactcatcaaaagaaagtatgcaatttttactactgcattgactatgatcctggcaccttgtttgacaatcgccgcgagcgggttgtattctaccgaagctgctagctatgtgcgagcagtgtctatcttgagaaacgactcgttcaactcgaccgtggagcctcaagcttaccactcgggacagaaagggataggccttaccggtgctcttgtcgtggggaccaatctttcatatccagattggacgtatgatgaggtagtacttccggctctgaaggaaggcacgctcatggat

SEQ ID NO: 15294 - DNA, 634 bp, Glycine max
  Peptide Sequence Number=SeqID_106979
atggcatcatcgggtggttatcatgaatggttgaaagttcgtacacgggggttagattggctctccaaattgaaagttatcaatgaggggaacttcgaagctccggaagaggatgaagaagtccgagctctaaaaacagaactaggaaaagcaagacttgccaaagaaaaattcaagttagtcgctacagacgtccagaaagagtgtgccgagttccgagaagaaaatgcagctaccgcaagagcccttgaacaagaaaccaagagggctcgcaaggaagagcatggccgagacaaattccgtggagctttgtggggtagcaacagtgagctcaagcttcaaagggaagaaagagaccaatcacgggcacatagcatggtcttgaaagaggagttagctgcttgctcaaggtccaaaagaaacttgtctcagcgtttatgcgagacagagaccaacatgttagccatcgtcagcaagtaccaagaagaactaaatctagccacggcccacgagcataaagtggcggacgagtatgcccaagtgtacgcgaaaaaggaggctagaagaagggtgatcaactcgttacatcaagaggcaacaatgtggatggaccgatttgctcttaccttgaacg

SEQ ID NO: 15295 - DNA, 270 bp, Glycine max
  Peptide Sequence Number=SeqID_106980
atgcaagaagagcagtgcgaggattgtctgttgtacgcctaccctttatggaaaggacaatgtaaattggggagaactcttggcaggcatgatatagttggttcccgcggtggaaagaagaagggacaattaggttaccctatgagaggtgtgccatcagaggagatcatcgcgcctttcatcgcgcggctatcacaaatggttaaagtcaagaacgcaagggataacttggctccaaaagataaagagtctgagtggggaaaaagctaa

SEQ ID NO: 15296 - DNA, 689 bp, Glycine max
  Peptide Sequence Number=SeqID_106981
atgaacgaaagagagaagcagatactcaagatcctgcggcgtaatccccttattcagcaaaacgaaatcgccgatattttgcagatcagccgttcgcgtgtcgcggcacatattatggatctgatgcgcaaggggatgatcaaaggtaaaggatatatcctcaccgaacgggagtattgcgtggtggtcggcgccatcaatatggatattcgcggcacggcggaaatccactatccgcaatcagcctctcatccgggcagcattcactgttccgctggcggcgtgggccgtaatatcgcgcataatcttgccttgttgggaagagacgtccatttaatttcagcggtaggcagtgatttttacggcgaaacactgctggagcaaacgcgtcaggcgggggtaaatgtctccagctgtatccgcttacacggacataacacgtcaacctacctctccgtcgcaaaccagcaggatgaaacggtgctggcgataaacgatacacagattctgcaaaagctgacgccgcaactgctggacaactcgcgggatctgctccgtcacgccggggtgatacttgccgattgcaacctcaccccggaagcgatggagtgggtctttaccatagcggatgatattccggtctttattgataccgtttctgaattcaaagcggaaaaaattaagagctg

SEQ ID NO: 15297 - DNA, 477 bp, Glycine max
  Peptide Sequence Number=SeqID_106982
atggggcatagggctgccaaatgttgccaggacttccagttagtgccgactgtggaagagtttgaagaaatcctgggatgtccgctcggagagagaaagccatatctctttttggggttctatccctccatggcaagagtagcaaaggcagttaaaatctcgatgcaagagttggatcgtgtgaagcaaaataggaacgaggtagtcggaataccaaggaaacatttggagggaaaggcgaaggcattggccaatcaaggagaatgggttctgtttattgacacctttgcattgttgatatttggagtcgtcctctttccaaatttggaagggttagtggacctagtagctattgatgctttccttgcttatcaccatagcaaggaaagcccgaccatctctattttggccgatctctatgacacgttcgaccgaagatgcgaaaagagcagtgcttgctgtacaccagctctctat

SEQ ID NO: 15298 - DNA, 363 bp, Glycine max
  Peptide Sequence Number=SeqID_106983
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctggagtcacaatttttcctcttttgtcacaggttaagcctcccagtagcttcacggcaggggtaccgagctcgaattcgtaa

SEQ ID NO: 15299 - DNA, 360 bp, Glycine max
  Peptide Sequence Number=SeqID_106984
atggagtggttctacattatttcacatctgtttatgactcccgcacagccaagggatcctcctagagttccgctgattcaacaatatgacatatttgttgaaccagatgtgtctcagcaatcggtggcggcagcggcacctgatgaagcagaagttgatgtgcatagtcctcgacatgcagtggatggttatgtagcaattgctgataaattggagaggctactgaacatgaggatcctgaccgaaggaacaaaagtctatattgttgttgaaaaatgtctgagcatcgcaagaagctacattggccaaccaattgtaggtcacagttcgaggcgtaggcgacatatggacgatcattga

SEQ ID NO: 15300 - DNA, 751 bp, Glycine max
  Peptide Sequence Number=SeqID_106985
atgcaggacgccgggcgccccctcgccgatgctggccgcgtgctcggcggtctcggtgccgcgtccgcccgcctcgaccccgaacagccgcacgccggcatcgttcaggaacggatggaaaaagccgatggcgttggagcccccgccgacgcaggccaccatcgcgtccggcagccgccccgtcttctcgatgatctgcgcccgcgtttcctcgccgatcaccttctgcaattcgcgcacaagccagggatagggatgggggccggcgccggtccccagcaggtagtaggtgtcgtccggatgggcgatccagtcgcggatggcggcattcatcgcgtccttcaaggtggcgctgccgtcccgcaccggacgcacctgggcgcccagcatcttcatgcgcgccacgttggaggattggcgcgccacgtcgacggcgcccatgtagaccacgcattccaggccgtacaacgcgcacaccgtggccgtggcgaccccgtgctgccccgcgccggtctcggcgatgatgcggcgcttgcccatgcgccgcgccagcagcgcctgacccaggcaattgttgatcttgtgggcgcccgtgtggttcaggtcttcgcgtttgaggaacaggcgggcgccgcccagctcgtcgctgatcgccgcggcatacagcagcgggctcgggcggcccacgtagtccgccagcatggcgcggtactcggcccagaacccgggttccgcccggacggcgcgatag

SEQ ID NO: 15301 - DNA, 858 bp, Glycine max
  Peptide Sequence Number=SeqID_106986
atgaattttgtggactatttgggagcatgcaatggaatggaggaggttctgcataagagggttaagtccacattgtcttttaaggaggctacaacttttctactacacgaaagtgacaagtttttggagctaagttttaaaggtggaggtggtgatggtacaaaattcaagtccaatgggagaaacagggaaccgaggtgtgaagaattaaagcataaagttttcattgagaaggggatacttgaaaaaaaagaggtctctcatgtgtctagtgggagtgttggaagtggtggtaaggttcaagaaatcaccaatactttgcatccttctaaggcttcttttgaaaatataaagtgttttgatgattttgaagcagtgaaattgtccatgatcatgaagtgcaaggaagttgcggttggtgaaaagcaaaagaggaggaggaaaaacaagaaaacaatttgtcaaaaacaaaacaagataaaatatgttctctcaatacattatgttcaagttttgaagtttctattaagaattgcaaatgaactaattgcattggtacattcttttgcatttggtttaagtgcaagaagaaaattgtcagcaaagcttgacaatgatcaccaccttgctgtgaaatctgatggtaacttcatggttgatgatgagaccaaggtagaggcaattgacaattacaaacatgaaggtatatggagaccagggtgggaatttacatggtatattaagttttatgatgtcatggttgtccccatggcaatagcactttcgggccaacctcttcttggtcaaccagtgatggtgatgatggaagcttgcttaagaagcttctatggaggctga

SEQ ID NO: 15302 - DNA, 237 bp, Glycine max
  Peptide Sequence Number=SeqID_106987
atgggtgctaaatacctcgaagtggtcaaacgagggtcgcatcccaacaaaggatggtccccagacaaaattaggacgcagaatgaccataatttgtctctgcgttttgttggacacgatcgagcctgggcgacgagacacagaatgaccataatttgtctttgcgtgccaccggacacgattgcctctggatggcgaaaaagtgatgcaatcctactccgcaagggcattggatag

SEQ ID NO: 15303 - DNA, 194 bp, Glycine max
  Peptide Sequence Number=SeqID_106988
ctttacgaagaagttacggaaactcacgaattgcgcaaaaacacctcttttcgatttccgccacattacggaatattacggatcgcgcaagcccgcttccttttgatttctaacacgcctcgggacttcatttattgtgcaacaaaggacaccgagtatctcaaagcggctaaccaaaggttgcatgtcatcaa

SEQ ID NO: 15304 - DNA, 123 bp, Glycine max
  Peptide Sequence Number=SeqID_106989
atggcgtgtgaaaaaaggatttcctgtggagccgaccgccaagtgatgatgaaaggttcatctttgtgggtgatggcaagaaggttgcagtggaagctattggaacttttagattacagttaa

SEQ ID NO: 15305 - DNA, 579 bp, Glycine max
  Peptide Sequence Number=SeqID_106990
atggttgagagagagatgatcaccatgatggtagacactctgccagtgttctactatgagaagctagtgggttacatgccgtccagcttcgcggatctggtgtttgccggggaaagaatcgaggttggattgaagagaggaaagtttgattacgtttcctccacaaacgtgaacgccaaaagaatcggggcaacaggggcaaaaaggaaggaaggagatgcccatgccgtctcttcaacacccgcgtgggtcaaaccccagcaaacacctcatggtacccatcagtacgcgcaacatcacccaagcttctcggctcatgcggggaacgcctctagttcaacacccgtgcagcctaaggcacccacccagagggaagctccccaagttccaactccgaacacgactcgacgcgggccggtaattccaacacgacaagggaacttccctccaagggccattgccggaattcaccccgctcccaatgacgtacgaagatcttctaccatccctcatcgccaatcatttggccgtggtaactcccggaagggtcctcgaaccccctttcccgaagtggtatga

SEQ ID NO: 15306 - DNA, 126 bp, Glycine max
  Peptide Sequence Number=SeqID_106991
atggccagaacacgaggcagagatagagctgctggcgaggatgctggcgatgttcccgagaggcgtaggcctactgcctcagcccgtaggctacgcgttcatcagatggactacggagggacgtga

SEQ ID NO: 15307 - DNA, 222 bp, Glycine max
  Peptide Sequence Number=SeqID_106992
atgaccatgattacgaattcgagctcggtacctattagaagcaagttgattgagcttgaggctaaaattgaggaaaacaaaaagataaggaacaaaattaaaattctcaaggacttccaggcttcatgcactagaagaacagggaatgcgttatcaatgaaaaaagatccacgtgttcagttaatatcttcaaaaaagccatttgctccaaagaactctaag

SEQ ID NO: 15308 - DNA, 405 bp, Glycine max
  Peptide Sequence Number=SeqID_106993
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcatgtgagcttagaactgagaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 15309 - DNA, 351 bp, Glycine max
  Peptide Sequence Number=SeqID_106994
atggccccgaggaaacttgcctcaaagagatccaagaaggataaagcggccgaaggaactagttccgcttccgagtatgatagtcaccgctttaggagcgctgaacaccagcagcgcttcgaggccatcaagggatggtcatttctccgggagcgacgcgtccagctcagggacgatgagtataccgatttccaggaggagatagttcgccggcggtgggcatcactggttacccccatggccaagtttgatccagacatagtcctcgaattttatgccaatgcttgtccctacggaggaaggcgtgcgagatatgaggtcttgggtaaggggtcagtggggatcctctag

SEQ ID NO: 15310 - DNA, 81 bp, Glycine max
  Peptide Sequence Number=SeqID_106995
atggtggaggccatgatgagcatggagaagataatggaagccaaagcagttgtagttgttgctaccagcgctgttgctaag

SEQ ID NO: 15311 - DNA, 441 bp, Glycine max
  Peptide Sequence Number=SeqID_106996
atggttgcctcctttggttaccgcaaagaacgtgatgactcttgggtaaaaaagggtgctcaaccaaatgatgatgaaggacacttactggctgaagaggactcttctctccttcagagtattttggacaggtttgatggacttcaaacctatgttggtgagaggtttgtcaccatcaaaaaaggggagattgtagaagcaagcttcatgatgatgaaacaagaaattttgaagatgccaaaagcccaagtgattgattcaagacttcaagatcaagcatcaagaatccaatccaagattcaagattcaagagaagaaatcaagaagcaacaagtcaagacttcatataggataagtattaaaaggaattttcaaaaaccaaatagcacagttttgttttacaaaagaattttctcaaattttctaaagttaccagagtga

SEQ ID NO: 15312 - DNA, 450 bp, Glycine max
  misc_feature (5)..(5): n is a, c, g, or t
  Peptide Sequence Number=SeqID_106997
ggggncggagcctatggaaaaacgccagcaacgcggcctttgtacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgcactgatagctcctgcagcattgattgctcaaaatgctggaatagaaggtgaagttgttgtggagaaaataaagagtggtgaatgggaggtcggttacaatgccatggcagacaggtatgagaatttagtggaggctggagttatcgaccctgccaaggtaactaggtgtgctttgcagaatgctgcttcagttgctggagggatcctctag

SEQ ID NO: 15313 - DNA, 483 bp, Glycine max
  Peptide Sequence Number=SeqID_106998
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccttcattaatgaaagatttaccactctgggtaatgtgaccgttgtggagttcaggatccacaccactcgctactcttggtatcccccgccattgaccaccttggattggtccacgtcatccgcgtcaatgttggaccggtccgaggggatcctctag

SEQ ID NO: 15314 - DNA, 507 bp, Glycine max
  Peptide Sequence Number=SeqID_106999
atgattcaaagttttgaacaacaacaagaaatgtctgtcatagaattatgtgttgaagttgatgttacgggtgcttttgcaattaatttgacaaattcattgttatcatgcgaaaataatatgtctcacaatgaatcgggtagtgcaacagttggaacaaattcagaagaagattttgatgatgatgattatttaatatctaattcatacgttgaggactcattagatgaggatgaggatattgatgaaatgtttgacacagatgatgaagctgcctgtggaagtcagactccattttgggattctgcttctcactatagtaatattaattggagtcatcctgaccaagaagaaatttgcggtttagatatgggatcaaattttaatatgggtcaagaattatatgttggtatggaatttgataccaaaagcgcagtaaaaaatgcattacaacaatatgtaatgaaagtgcctcaaagtttcaaagttgttgaatctaaatcatag

SEQ ID NO: 15315 - DNA, 288 bp, Glycine max
  Peptide Sequence Number=SeqID_107000
atttttcagaagaagatagatctcctccagcatcaaggagttgcagcccagaatcgtacacggctatataatcatggaggctgcacgagtgctgtaccaagtccgggattgaagagttattttggtacatcctttgtggtaaaagtagagtgtacatctacttgggttgtaatactgagaacaagagagggtgcatctcttgtggatcaattcaagtggaggggttactggaaatctgaagaaccggtggttgcttggggattggatgtaggcacgggttgttgttga

SEQ ID NO: 15316 - DNA, 576 bp, Glycine max
  Peptide Sequence Number=SeqID_107001
atggctaagagttcatacacaagggaaaatgtggctaccgcaagagccctcgaacgagaaaccaagagggctcgcaaggaagagcatggccgagataaattccaaggagctttgtggggcaacaacaatgagctcaagctccgaagagaggaaagagaccagtcacaagtacatggcatggtcttaaaggaggagttagctgcttgctcaagatccaagaggagtttggcccaacatttagaagccacggagcgaagcatgctagctataatagggcagtacaaagaagatttaaaccagtctttgacccatgaacaaaaactagtagaggacttcgcacaagcgtacgccgagaaggaagcaagagggagggtgattgatgaattgcatcaagaagcgaccatgtggatggataggttcgccttgaccttaaatggaagtcaagacctcccgcgactactagccaaagcaaaggccatcgctgaagcgtgttcagccccagaggaaattcacaggctaatcaattactgtcaacacatgatagatttgatggcccatataattagaaaccgttag

SEQ ID NO: 15317 - DNA, 168 bp, Glycine max
  Peptide Sequence Number=SeqID_107002
gggcagagtcatcttaggcagtggtcagatgtcggggcgaagctgaaggcagaaaacaatcaaggtacattgggacggacacaagtagaggctagggtcacgaccgatagatcgtcgtcccttgcccagctctggacaaacggaaagcgccgctgcaaggcaacctag

SEQ ID NO: 15318 - DNA, 414 bp, Glycine max
  Peptide Sequence Number=SeqID_107003
atggggatcgcaaccacagagacacccagtggacctgaagaagtcaaacagggccctggggtttctagctctggttacgggcctctgtcgaccctacagggcgcccgttccccccagcaaggattgtgcccgcaagacacctattctagggagtgcctgtcgcccgcagcaagatcatcaggcccccctaccaatcgagctttcatcaagaagtactgcgcccccaggcaggcgcaaggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaaggtaagcaaagtactaggtcagtga

SEQ ID NO: 15319 - DNA, 405 bp, Glycine max
  Peptide Sequence Number=SeqID_107004
atggagtttggtgatataaatgttcattttaatattcttgatgctatgaaacacccatctgaagatctttctgtattttgtgttgaaataattgaccatattattgatgaatacatgactgatcttcattctaatctgcatgcctgtctctcttcatgtgttgaatctgaatttgtacttgatcatatgtctgaatttgatgctgagagtgaatctgaatttgatattgattacatgtctgctgatgttttacctcttgagattgattttatagagtcagatagaactaaccatgtttcaggaagtacacatacctctgactttctttatgaggtacaggctgagaaaccatctctttctaccactatccagccatccacaccagaattgaagcctctgccatga

SEQ ID NO: 15320 - DNA, 378 bp, Glycine max
  Peptide Sequence Number=SeqID_107005
atgggggaagttcgactatgtcgcccctgccagcacaagcaacagaagatccgggccgactggggcaaagaggaaagaaggggatgctcacgccgtaacctcggctcttgcttggccaacaccccaatcaacccctcacaatactcattagtatgtctagcaccatccgagcttttcggcccgggccgaaaaattctccaactcgacacctgtccagcaaaggacatctgccccaccataaagagcccccgttcaagccccgactcctgcaaggcctcatcctgccggcaatttcaatcctggcacaagttccaatttggagaggaaccctccagtgaagaagcttctggagttcaccctgattccgatgttatatag

SEQ ID NO: 15321 - DNA, 429 bp, Glycine max
  Peptide Sequence Number=SeqID_107006
atggagagcgaatcctcagttggttcttcctacggggtacttgatgacggggctagtttatcgtattttcatgagggatcagggtacgataacctagttgttgtattttgtatgcatagatctcccacaggcaacctagttcctctggactttgaaattgaagctaccttaagaaggaacagagccgagaggagaaggaagttgttgcaagatagggcaatagcttatattctagaagaagaagctcaatcttctgactcaacatcatctgattcactatcatcaagggaatcagctatatacttaccagaagcctctgtcatggctgatgaagaccagcaaagggttaccttgaggattattctagtagctcagtgccgcaattctttacaagtattgcgcatcctaaagtccaagctcacaacataa

SEQ ID NO: 15322 - DNA, 471 bp, Glycine max
  Peptide Sequence Number=SeqID_107007
atgtgggctttccttatcgttcatcagattgactgggctcacttggttcggtaccgaatgcataaggcattacgggccaatgcacctctcccttaccctcaattggtcactctatttctccatcattttcaaattccgcttgatgatgaaccatttgttcaagtcaagcgttcctttgctattggtgctggtgcagtgacttcttttagataccgtaaggattggaatggtcaatggctgaagaaagatgaacttcctcctcaagatgagcgtactccttctcctcctcctcaacgagatgattcagccctcatgactgaagttctttctgagttacagtgtcttcgtacttatgttggagaatgttttgattctctggatactcgctttgccggcatggatatccgtctcacacagcttgaagaagatgtgggttatattcgccagagcttcgatcttccaccttcttag

SEQ ID NO: 15323 - DNA, 690 bp, Glycine max
  Peptide Sequence Number=SeqID_107008
atgctctcgccttcagagggctacacgccctcgccttcagaggactactggtcctcgccttcagagggctacacgtcctcccctttagaggactacacgtcctttccttcagagggctacacgccctcgccttcagaggattacacgtcttcgccttcaaagggctacacgtcctcctctttagaggactacacgtcctctccttcagagggctacacgccctcgccttcagaggactacacgtcctcgccttctgagggttgcacgttctcaccttgggtactagtaccctcaccttcagagggctacactaccctcgccttcagaagactacacgtcctcgccttcagagggctggacgttctcaccttgggtactagtaccctcaccttaagagggctacacgccctcgccttccgaggactacacgtccttgcctttagagggctgcatgccctcgcctttaaagaactacacgccctcgccttcagagggctacacatcctcaccttcagagggctacaagccctcgtctttagaggactacattcctcgccttcagagaactacacgccctcgccttcagaggactacacgtcctcgccttcaaagggctgcacgtcttcactttcagagggctccacatctgcccctttagagaactcaaggtcttctgcccttaatgcttaa

SEQ ID NO: 15324 - DNA, 282 bp, Glycine max
  Peptide Sequence Number=SeqID_107009
atggttattcgcacctttgtcaaccagagtcaagcgagcccgttgatcgagactactttagtctcaccttcgtcatccaaagacagcaaaagtccaatgacacacggagacaacatatggtcgtccgcacccttcctatccaaagactatcgaagtcccgtttatcatccagagacaggcaagtctgatgatatccgggatgaggatggtcgtccgcttctaatcattttgaagatttttgcagatttactgttatcatccagagacaggcaagtccgatga

SEQ ID NO: 15325 - DNA, 687 bp, Glycine max
  Peptide Sequence Number=SeqID_107010
atgacgcatcgtaccgtcgcaggtgcgccagatgatggcaaaaactatgtgcagacccaattgggtgtcattgatacaggctaccgtaaagatgcagcagaaaataaaaacaatgccgggcaagagtttgatgctgatctggatgccgagttgctacgccgtatgatggtgaagctgggcctggatgaacaaaaagccgatcaggtcatgacgcaagcagcctctgataagcgtgcagatgttgtcaaagaatcagatcagagtgtgaccttaaaactcaatgagccatttgatcgcgcctggcgccgtgtcggtctggcattggatcgtatcggttttgtgacggaagataaaaaccgttcagaaggtattttctatgtgcgttatgcggatacagatgcagaagatccaatcaagcagaagaaaggcttgctggagcgcctgaagttctggggcagcgacgatgacgataagagcacgacacctaaggatgtgaagccgggggataaaaccaaattctggaagggaacatctgacggtgataaatccagcaagcaataccatatccaggtgctggaaaatgccgatgacaccaccgatgtttatgtgttgacgccggacaataaacgtaatacttccaccacggccaaccgtattatttcactgctgtatgatcagttgaaataa

SEQ ID NO: 15326 - DNA, 339 bp, Glycine max
  Peptide Sequence Number=SeqID_107011
atgtcgccgggctacgccgcggcgtatcacattgatcaggcctgtctgcgccagcaggcggcagagacagcggtgtcgcaggataatctgttccacacgaccgactggtctaatactctgcctgccatgaacaagacagtgcaacgcaacgaaacccgtgaacatttgctcgccaccggcgagcaggtctgcctgcagcgcggtttcaccggcatgggattgagcgaaatgctggcgctggcggaagtgccgaaaggctcgttttaccactacttccgctcgaaagaagcgttcggtgtggcgctgctcgagcgctatttcgtcaactatcagcagcag

SEQ ID NO: 15327 - DNA, 432 bp, Glycine max
  Peptide Sequence Number=SeqID_107012
atgtggggtttcattttgttgtggctgtggattgtgctttacttggttttcaagcttgacgagagttacacgccgagcaaagtttccatccatgccggtgatggttttcacaacttgaaggagattaagaccatggaactcgtgaagccaactgggtgggtttatgtatccttgtatggagctgatcctagctgctatccaccaaatcttccactttctattagaatccctcgaaccagccaaggagaagtgctgagagaagttgtccccaggcctacaatgcataactctgtcttccttgaccaaagagttaaactcccaccacattggcataacgtttttgcaagtgaaaaagagatgagaggcagattcaacttggctttggcagaaggtgcaaagatcattttcaattacaacttgccttctaattaa

SEQ ID NO: 15328 - DNA, 311 bp, Glycine max
  Peptide Sequence Number=SeqID_107013
atggtcattcctcaaagagaggaggagataggccacatgcactgggcgtcactcgtgacatccatggctaaattcgacccggagatagtcatggagttttacgccaatgcctggcctaccgaggagggagctcgggatatgcgctcctgggtgaggggccagtggatccttttcaacatagattccctcagccagttcttgggccacccgctgattttggaagagggtcaacattgtgaatttagcaagaggaggagtcaggtctcgggttttgacgaggaggccattgctcagcttttgtgcatatcggg

SEQ ID NO: 15329 - DNA, 141 bp, Glycine max
  Peptide Sequence Number=SeqID_107014
atggagaagattcatctcttctttcgaagatttggaaagacattcaatgaaatggagtcaagaatgacaaaggttgaagaagatgtatcttacattcggtcaagcttcgatcttccaccaccgccgccaccatcatcttag

SEQ ID NO: 15330 - DNA, 644 bp, Glycine max
  Peptide Sequence Number=SeqID_107015
tctgcctctggtcatgggcccttccagtgcttcatggtccttgcccttagttgtgtcctcatcaattactatggtagatacacaaagaatggacaagcatctggtctatttgtgaagtttcttcaagaacatgtgattgttgctcaatgcactatgcctagttctctggatcagaatggtgtagcaaaaagaagaacccaaactttaatggacaagatgaggagtgttggaaaccgagtgataatttataacccacaagagaagaaactagacccaaggattattagtgggtatttcattggatatgccaaaaattccaaaggtgggagcggtcaatttcaggacattgcttctgaaaaggatcactatgaagctcaactctcttgctcaagtgacaaattgattatcattcacacccctcaagtacaaatgggtgttagacaatcagtgattgaaattccacaaactgttgaaaatgatcctgtagatcaagctgttgatgaggaacaacaagttcctcaagaagatcacgaagcaacattaagaaggtctactagagtcaaaaggtttgcaattcctaatgattatgtggtatatctgcaagaatcagactacaacattggagttgcaaatgatcctaaatc

SEQ ID NO: 15331 - DNA, 232 bp, Glycine max
  misc_feature (81)..(81): n is a, c, g, or t
  Peptide Sequence Number=SeqID_107016
ctctccgaaaaggagtttagcaatcgatgttaactctaactccagaactagatctcgttacaacgaaattggaagcatggncggtggtcggatgaacagaatgtccgatgagaagctcagttccgctttaagcccgacaagcgaagcgggcaagagaactaggcttggtgtggctagctctaaagcaggccctagtattcctactgatctacttctttccgtcccttgctaa

SEQ ID NO: 15332 - DNA, 928 bp, Glycine max
  Peptide Sequence Number=SeqID_107017
atgacggcgggcaccggcgtctggaccacctcagcgctcggcctgtgcctcgcggtttacgcagcctacagcctgcttgccagaccgatctcgataccggcaaggctggaaccaaaactctcccccatcatggggttggtgacgggccttctgaccggcggcaccggaattttcgtcgtacccgctgtgccctatatccagtcgctgggttttagccgagacgatctggtgcaggcactcggcctttccttcaccatttccacccttgcacttgccgccggtcttgcttctcagaatgcttttcatgtcgagcatctgtcgctttccgcactcgccgtcctgccagcgcttctcggcatgtggcttggccagaaaatccgccatatcgttagcccggcgacatttcggcgctgccatcattcaaatgtgaaggctttatccatgggcaaaatcctgaccatagctgacctgaaaaaccaggcgcagcgccgtgtgccgaaaatgttctttgactatgccgatagcggcgcgtggacggaaagcacctaccgcgccaatgaggatgattttgccaagataaagctgcgccagcgcgtgctggtggatatgaccgaccgatcgctcgccaccgaaatggtcggcgagaaagtctctatgccggtagcgctttcccctacgggccttacgggcatgcagcatgccgatggcgaaatgctggctgccaaggcggcggaggaattcggcgtgcctttcacgctctccaccatgagcatctgctccatcgaggatgtggcctccgtcacttcgaaacccttctggttccagctttatgtgatgaaggaccgtgacttcgtcaacaacctcattgaccgcgccaaggccgccgggtgctcggcgctggtgctgacgctcgacctgcagatccttg

SEQ ID NO: 15333 - DNA, 129 bp, Glycine max
  Peptide Sequence Number=SeqID_107018
atgcatcttgaaaatacaggggggcaggcttgtcttcaacaaacaaatcaaaatcaattttttgatcttcaaagcccgactccagcttctttctccccatatcaactatgcagctcgcaattaacatga

SEQ ID NO: 15334 - DNA, 324 bp, Glycine max
  Peptide Sequence Number=SeqID_107019
atgttgggtactggcttgaacttcgggcgcgctcgcggcgactgcgaggatcgattctattctccggcgaaggctcgccgagcgcttcacaccatggagaatgacaagcttcgtagggtccacagtgatgtcaccgcgtctcgctccgtcggagacaaatcgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15335 - DNA, 357 bp, Glycine max
  Peptide Sequence Number=SeqID_107020
atggggtttgctagtggtagtggtagcaaacccactactttcccaacccaaatcatttgtttcaggtgtggtaagccaagccacatctcctcaaactataccaataaggataggatctgcttcaactataggaagaacgggcatattcagagaaattgcccatatcccaagaaggagcagaatggtggggttctaaatgaccaaactgaacattcaaaggccacgggaagggtctttactcttaacggtgtcgaagcttcgaaatccaaagatctaatccaaggtatggactcgttatcttccaaccatgtcttgttaaactgttttgataaaactcttgtgtttgatgattctaga

SEQ ID NO: 15336 - DNA, 186 bp, Glycine max
  Peptide Sequence Number=SeqID_107021
atggaggattgggggaattttctccaccgaatccttgaggaggatcctgaggatttcgctccgattaaagtgttcctgttgcgtgactccctttgcactagggctcgcttagcgggccaaaactcgctcagcgcaattcccttttgggttggaattgcgtttagcactcccttctcgcttacctag

SEQ ID NO: 15337 - DNA, 522 bp, Glycine max
  Peptide Sequence Number=SeqID_107022
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcccctttgacatcaatttgagggagaattcttcccaagagaaagggaatgataaaggaatatccaaggaggaagagtttggcttgggtaagctcaacatggatggaccaatcactagagcaaggagtaagagatttcacgaagaacttgtcgggaaacctgtcgtgccagctgcattaatgaatcggccaacgcgcggggagaggcggtttgcgtattgggcgctcttccgcttcctcgctcactga

SEQ ID NO: 15338 - DNA, 369 bp, Glycine max
  Peptide Sequence Number=SeqID_107023
atgggacacaatcggacatccgagttaaaagttattgttgttcgattttgctacaagctttcgttttcaatttcgagcgtctcgatatatttcgggacacaatcggacatccgagtaaaaagttattgtcgtttgaatttgcttagagcttctgttttcaattacgagcgtctcgctatatattacaggactcaatcggacattcgagtaaaagagctttcgttttcaatttacgagcgtctcgatatattcggggctcaatcggatatccgagtaaaaagttattgtcgtttgaatttgctcagagcttctgtttctcaattacgagcgtctcgatatattacgggactcaatcggacatccgagtaa

SEQ ID NO: 15339 - DNA, 171 bp, Glycine max
  Peptide Sequence Number=SeqID_107024
atgtcatcacgcgctcagcacgtcatcagctcgttcaacgaaaagattgtctcttctgcgcttagcacgagttcacctagtcatctgctcccccgaacacaaagttcaagatcatcacaggatccaaacacaaacaacaaaccgggagtgagttatcacattcctaactaa

SEQ ID NO: 15340 - DNA, 771 bp, Glycine max
  Peptide Sequence Number=SeqID_107025
atgctatttgcccgattttccccgactatccgcgcggcgctcggcgcgctggcgttgatagccggcctgttcgcgccgcaggcgcatgccgacaaactgtatggcggcattgcgacggatggcaagcacgccaagatctattgggcgctgccggaggactcggaaaaggcggccgaagcggcggcgttggcggcctgccgcaagggcggcggcaaggactgcaaatcgctgagctggttttcggacagttgcatgacttatgcccgcaatacctcgaacgacctgttccccggcaacagcgtgtcgccggaaatggcggcaaagaaggcgatccgacgctgcaccgcaggcagccccaacggcaaatgctggttgaccacgatgccgctgtgcgtcgggccgggctacagcgcgcaggacatggaggcggccagaagggccacgcccgctgagttggaagccctgtccgccaagctcaacgaccgcgaatactggggcgccgtcgccgagaaagactcgggcgacctgacgtactcggacggctaccccaatgagaaggacgccatcaaccaactgctggagtgggatgaatgcaccggctgcaccaaggtgctgacctaccgcgacacctgcgtcggcatggcctgggccaagggcgtgaaggggcgcggcaccagctacaccgcgctcgatccggatccgaagacggcgcgcgatgcggcgcgcaacacctgcagcgccaagagcggcctgcccaattgcgtggcgatg

SEQ ID NO: 15341 - DNA, 276 bp, Glycine max
  Peptide Sequence Number=SeqID_107026
atgggttctccacctgcctccactcctcctcctcctcctcctcctcctccttctcctccttcggacgcatcggcttcgctgtctgccgtgaaacggacacgcaaagcctcacgtctacgatcattgtccactagaccacctagtgctgagagaccagtggtgcatgttgatcctactaccgggaaggctgacggtccccacaagaagaaattaagaacatatttggggattgtggcgcgtgataaggtggacgtcacctacgagaactggaaggag

SEQ ID NO: 15342 - DNA, 417 bp, Glycine max
  Peptide Sequence Number=SeqID_107027
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatcccctcatcctcggcttcttcctgtggaagggggcgattcctctgaaggaaacgccgaccggccgcaagatcgagcgcttcacgccgaccgagcgctatgtgcactggaccatggcggttccttcggggtaccgagctcgaattcgtaa

SEQ ID NO: 15343 - DNA, 296 bp, Glycine max
  Peptide Sequence Number=SeqID_107028
atgggtgaccaagaggagacacaggaacagatgaaagccgacatgtcagctttgaaagagaaaatggcttccatgatggaggccatgttatggacgaggcaactcatggagaataacgtggccaccgctgccgttgttagttcggctaccgatgcagacccaactctcccagttaccgcacaccatcctctcccaaacacagtaggacgagaaaggagcacactgggccacatccgttcgcggacatggcggatctttgcttggtaccagacgtcgtcacccccccaaaattcaag

SEQ ID NO: 15344 - DNA, 174 bp, Glycine max
  Peptide Sequence Number=SeqID_107029
atgttgagcttgctaagcgcatctgtgcgcaaatggcttctaggaaaagaaaggcaccggcctcaacatcccaggccggctatgaccgctctagattcacatctcaggaggcctgggatcgctactctgatattgttattggaaagaagatcctgcttgagagaaatgtcatga

SEQ ID NO: 15345 - DNA, 402 bp, Glycine max
  Peptide Sequence Number=SeqID_107030
atgaccaatttcatggacggaagcattgatgttgcaatcgttaaggatttctatgctaacctctatgatctagaggataactcacctaagctgttgagggtcagaggtcagttgatcaagtttgatgcagatgctttgaatacttttctgaagacccctgtgatcatagaggagggggaagagctaccttcatactctagattctgtcgtctgaggccagatccacatgaactggcagcccgattatgtatccctgggaggggatttgagctaaatgtagatgggctgcccttgaagatcctgaggaagaatctgaccacttgttcgcttccggcaagtgcaccggatcacgtgtgtaaactaactattagaagggaaaatcacgtgagaaatgatgcgtaa

SEQ ID NO: 15346 - DNA, 255 bp, Glycine max
  Peptide Sequence Number=SeqID_107031
atgaagatcatctatttctcaaccctgtcttctggtaatcgattacacttcctgcattatcgaaggcttgatctttttgacatcatcaaaatcttcatgatttacaccaaagcgatgcgcttagcggtatggcccttcgctcagcaaacaagcatagctcatccttcttccagattcttcctcacgcttagccgaggaatgttgcgctcaatggatagctcactaagccagcagattggcttagtgagagggtga

SEQ ID NO: 15347 - DNA, 129 bp, Glycine max
  Peptide Sequence Number=SeqID_107032
gagataatgatgcaatcctaccccgcaagggaattggatagaagactccaagaagattgggatagagatgcaagagaaggccttagggttctcatgagccttagggtagattttgggcccagaggctaa

SEQ ID NO: 15348 - DNA, 216 bp, Glycine max
  Peptide Sequence Number=SeqID_107033
atgattatgatgggccaagacatttatagtatccaattcgccaagcaagctaaactcgcccaggcgagtttcttgcttagtgctgaaggcactcactcactcaaattaatggcagcggaatggagaaggaagaaagatgattggagacaccacttcaaggagaagatgagtcaagaacaagctcaccaccataggaagccatggataagagcttga

SEQ ID NO: 15349 - DNA, 333 bp, Glycine max
  Peptide Sequence Number=SeqID_107034
atgtttcaagattcaatcaagtttcaagaatcaagattcaagaacaatcaagatcaagattcaagactcaagattcaagaatcaagagaagactcaatcaagataaggtacatcctttgtggcacaagtagagggtacatctacttgggttgttatactgagaacaagagagggtacatctcttgtggatcagttcaggtggagggtacatccacttggttgttcaaagagaacaagggagggaacatcccttatggatcattggcttttaaaggtttttacaaggttgaaagaaatctcaagaaccattggttgcttggggactggatgtag

SEQ ID NO: 15350 - DNA, 267 bp, Glycine max
  Peptide Sequence Number=SeqID_107035
atgtgtaagtgccccacatgtggggtatcacggtacaaagtcaaggatgatgaaagttgtgatgatgcaaccacaaaaaacaatcgtccagcaaagatggcctgttttgatgatcatttacaacctccctcattggttgtgcatcaagcgaaagtaatgatgatagcagttccaaggcagccagggaatgatattgacatgtatttgacttcattgattgaagacttgagaaaattgtgggaagtgtgggatgagaatttgcagtag

SEQ ID NO: 15351 - DNA, 264 bp, Glycine max
  Peptide Sequence Number=SeqID_107036
atgtcatttaggacttatgagaaagcttggactgtgctagagagaaaaataaatgaccaaagtgaacaaagagccatttctagggcaaatttgggtgttgaagagtcaaattttgattcggaattgatttgggcaagattggatgagaggaagtgtgaatttcgaaatctgcactttgtgcagatttttgctgtgaaattgtgcaacaggattttgcacaagtgcagaaaaatgctatgttttcgctggttgtggaaagagtag

SEQ ID NO: 15352 - DNA, 201 bp, Glycine max
  Peptide Sequence Number=SeqID_107037
atggatgatgctttatttcttgcttggtcttggttaaaagctagtgagaaaggtggcaccttgggtgtcttgtatgtgatgtccacagtacctctgatcatgggttctacacctgcctccactcctcctcctcctcctccttcggatgcatcggcttcgccgtctatcgtgaagcggacacgcaaagcctcatgtctatga

SEQ ID NO: 15353 - DNA, 495 bp, Glycine max
  Peptide Sequence Number=SeqID_107038
atgtccaaatcttgtggatttgggatgaccggccctctcgatgagtcgatctcttgctttctcataaggatggacccttgggtactagttaccctcaccttcagaggaccacacgtcctcgccttgagaggactacacgtcctcaccatcagaggggtgcacgccttcacctccagaggactacacgtcctcaccttcagaggggtacacgccctcacctttagaggaccacacgtcctcaccttcagagggctacatgccctcgccatcagaggactgcatatcctcaccttcgtagggctacacgccctcacctttagaggactacacgtccttcgccaacagagggctgcacgccctcaccttgagaggactacacgtcctcgccttgagaggactacacgtcctcgccttgagaggactacacgtcctcaccatcagaggggtgcacgccttcacctccagaggactacacgtcctcgccttgggtactag

SEQ ID NO: 15354 - DNA, 921 bp, Glycine max
  Peptide Sequence Number=SeqID_107039
cagaggactacacgccctcaccttcaaaggactacacgtcctcgccttcagaggactacacgtcctcgcctttagacggcgacacgccctcaccatcagagacctacaggtcctcgccttcagaggactacacatcctcaccttcgaagggctacatgccctagcctttagaggcccacacgtcctcgccatcagagggctgcacgccctcacctctagaggacttcacgtccttgtcatcagagggctgcacaccctcaccttcaaaggactacacgtcctcaccatcagagagctgcatgccctcaccttcagagggctgcatgccctcacctatagaggactacacatcctcgccaccagagggcttcacgccctcagcttcagaggactagacatcatcgcatttagaggaccacacatcctcgccatcagagggcagcacgccctcacctttagaggacaacacgtcctcaccttcagagagctgcacgccctcaccttcagaagactacacgtcctcaccttcagagagctgcacgtcctcaccatcagagggctgcacgtcctcaccatcagagggctccacgccctcacctttacaggactacacatcctcaccatgaaagggctgcacgtcctgaccttcagaggaatacacgtcctagccatcagagggctgcacgcctacacctttagaggactacacgtcctcgccatcagagggttgcacgccgtcaccttcagaggtctacacgtccttgccatcagagggctacacgccctaacctttaaaggactacacttcctacccatcaaagggctgcaggccctcaccttcagaggactacatgtccttgccatcagaaggttgcacgccctcacctttagaagacaacacttcctcgcaatcagagggct

SEQ ID NO: 15355 - DNA, 115 bp, Glycine max
  Peptide Sequence Number=SeqID_107040
atgggtgagggtaatctcattagaaattaccacggccttcctaaaagaatatgtcctgcctccatgggaactatatcacaattaaattcatccttatatgtcccaatgaagaaag

SEQ ID NO: 15356 - DNA, 309 bp, Glycine max
  Peptide Sequence Number=SeqID_107041
atgaagaaaagagatacaaaccaccaaagtgtgtcattggagaataagacaggagattcaactgtgctgaagataggagattcggctaaagttgtgataaaacaagacatgaagggaagaaagcataaatatgggtttaacaacaataaacgtgagaagccagagaagaaaattacgttagacgatgttaatcaatttgccttcatcatgatcattacgattagcatgaacatcgtcagcttcttcttctccgacaacgttaggagtgatttgtgcggtcaaaggactaacataggtgtccatgtatga

SEQ ID NO: 15357 - DNA, 255 bp, Glycine max
  Peptide Sequence Number=SeqID_107042
atggcttcttcacctagctcgcctcctcctcctcctccttcagacgcatcagctttgtcgtctgccgtgaagtggacacgcaaagccacacgtctacgatcgttgtctactagaccacctggtgctgagagaccagtggtccatgttgatcctgctaccggcaaggccgacggtccctataggaagaaattaagaacatatttgggggttatggcgcgtgataaggtggatgtcacgtacaagaattggaaggag

SEQ ID NO: 15358 - DNA, 168 bp, Glycine max
  Peptide Sequence Number=SeqID_107043
atgtatgtagatgagaaagaacaagagagtgggatcacaattagaaatttgactgatgtaatcctccctaggaagggaccagtcactagagccatgagcaagaggctccaagaggattgggctagagttgctgaagaaggccctagggttcttttgaacctcaggtag

SEQ ID NO: 15359 - DNA, 138 bp, Glycine max
  Peptide Sequence Number=SeqID_107044
atgaccacagattcacctccactccttatgctcccatggacccagcaacctacccttccgtgggagggcggcgcggggctcacgggtgtgtcttccaagggaggaaggcgcgcggagtcgccacaaatgtttatttga

SEQ ID NO: 15360 - DNA, 375 bp, Glycine max
  Peptide Sequence Number=SeqID_107045
atggcttttcaagtaagatgcgtttaccttgtggttgctttagatgttattggcgtggttgatgaagtggtattccgatatgtgtcatcgaaaaatacgagggttgttttgaaattaaagtatttaagtggacaggtgctatcctgcacactctgggaaaattactgcttacagtttttgtcttatttgaatgacgttcaagatgaaaggccgatcgttattcttttgacacatgccagcattaaggaagcgcagggatcatattcgtcgtcggtcagtaattctttcaaggcgtctaaactcatgatcaacgaccttgtgctggaaattcaagaatttagagagagccttttagatttagggatcgagggttag

SEQ ID NO: 15361 - DNA, 389 bp, Glycine max
  Peptide Sequence Number=SeqID_107046
atgagctagtggatctagcggcgatcaatgtttttcttgcttattaccacagcaaggaaagcccgatcgttgctgttttggccgatgcctatgacacattcgaccaaagatgcgagaagagcagtgcaagaattgtctgttgcacgcccgctctttatgtatggctggtctcccacatttttcgtcatgaaagggcgtccgttaattggttcccccgatggaaggaagaaggtgtcggggttttgtgctcgtgtgaagggttcccaaatgtccccttgatggaaacaaggggttgtatcaattataatccaatgctggccataagacaactaggctaccctgtgagaggggcaccatcggaagagattatcgcgcctttcatcgcatga

SEQ ID NO: 15362 - DNA, 806 bp, Glycine max
  Peptide Sequence Number=SeqID_107047
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggttattacttggttaatgaaacacaacgtagcgatcgctggtgtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15363 - DNA, 462 bp, Glycine max
  Peptide Sequence Number=SeqID_107048
atgaccatgattacgccaagctcgaaattaaccctcactaaagggaacaaaagctggtaccgggccccccctcgaggtcgacgaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15364 - DNA, 474 bp, Glycine max
  Peptide Sequence Number=SeqID_107049
atggaaatcaatgttaatggccgggtggttccactcggcgatatctcgcccgaaaccccgctgctgtatgttttacgcaacgatctgcaattgaacggccccaaatacggctgcggcctgggggagtgtggcgcctgcacggtgctgatcgacggcgtcgccgcacgttcctgctcaatgccgctgtccgccgtaggaaacaaatccgtcaccacgctggaaggcctgggcaccgcggaagcgccgcatccggtacagcaaggatttattgatgagcaggcggcgcagtgcggttactgcgccaacggcatgatcatgacgctggtcgcgctgttcgaacgggagccgcaggccgacgaacaaaccatcaagaaagaattggcctacaacctgtgccgctgcggcacgcatatcgagatcttgcacgctgccgagcgcgcccgcgatctgctggccgcgcggaggcaagcatga

SEQ ID NO: 15365 - DNA, 663 bp, Glycine max
  Peptide Sequence Number=SeqID_107050
atggtgaaagtggaacctccttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggtccggtggtggtggattcaattcactttgcttagatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagattttcctgggagatgccaggaagatacttaacagggaa

SEQ ID NO: 15366 - DNA, 600 bp, Glycine max
  Peptide Sequence Number=SeqID_107051
atggataatgaagagggcgtgcaggaacagatgaaggccgatctatcggccttaaaagatcaaatggcttccatctcggaggtcatgctaaaactccagaaaactatagaggataaagccacgacaaccgcctccagtacagctaggggaagcggagccggtgctacagtctgccttaaatctaggccgagacagaaacacgacagtgcttgccaagcccctaccttcgaggggcaacttcctccttatgccgattatcccgtgcaagacgatgaggaaggagatacctatctcggccccctgctccacttcaaagatccatccccccatgaactaccccaaccaaacatagtccgccatgtcccatcttcacccgcacccgtaatcaaatccgttcccttcgcagaggataagggaaagattgatgcacttgaggagaggctgagagcggtagagggcctcggcaattacccattctcggatctagcggacctatgtctcgtgcccaacatcgtcatccctcccaagttcaaagtatcggactttgataagtacaaagggacgacatatccgaaagggcatcttcggatgtattgttga

SEQ ID NO: 15367 - DNA, 309 bp, Glycine max
  Peptide Sequence Number=SeqID_107052
atggaaacatgtttgggagtagaggaattgttacagcaaatgatagatcaaggtcgactggaagttggcagtgaaggaagagaagagcagcatatatgcatgcagtccacggatgggagcagtgttgcgaggcccaaacccttggtgatatacttcaccaagggcacagcttcgcaaaagcccggacaccccttagcagctagacctgttcctttcccataccaaaatagccacgcagtaccatggagatatacacctctcgagggagaaggaagaagaagccaccgacgtcagctcgttgtcggctaa

SEQ ID NO: 15368 - DNA, 1743 bp, Glycine max
  Peptide Sequence Number=SeqID_107053
atgggtaactgctgcgttgtgccttccggtcaaacaagaaaagaaaaaaaacaaaagaagaagtggaatccctacgaggacgggtgggggaagaagctggtggtgctgacggagcccacgggccgggacatcgggctgcgttacgacctgggccgggagctgggccgaggtgagttcggggtaacatatctgtgccaagacagggagacgaaggaggagttagcatgcaagagcatttcaaagaagaagcttcgaaccgcgatagatatcgaggacgtgaggagggaggtggagatcatgcggctcttgcctaaacacccgaacgtcgtgtcgttgaaggacacatacgaagatgacaatgccgttcacctcgtcatggagctctgcgagggcggcgagctcttcgaccgtatcgtggcgcgtggccactacaccgagcgcgccgccgccaccgtcaccagaaccattgtcgaagtcgtgcagtttgccattttgtctggatggttcagcatgagtgtgggatatatatttaaaatggcatttactttgatttctgttgaagaagaactgtttttgtgtatctcactcatcaaacctgcaaataagttatatattgggcgaggtataatttgtttcttgatgtgccacaaacatggcgtgatgcatcgtgatctcaaacctgagaactttttgtttggaaacaagaaggaaacagcacctttgaaagctattgactttggattgtcggttttattcaaaccaggtgaaagatttaacgagatagttggaagtccatattacatggctcctgaggtattaaagcgtaattatggccctgaagtagatatctggagtgctggagtaattctctacatcttactttgtggcgtcccaccgttttgggcagaaactgaaaagggagttgctcaagctattattcgatctgttgttgattttaaaagggagccatggccgaaggtttctgataatgcaaaagaccttgtgaagaagatgcttgatcctgacccaaagtgccgtcttactgcacaagaagtgttagatcatccgtggttacagaatgaaaagaaagcccctaatgtttcattgggagaaactgttagatcaaggctcatgcaattttctgtaatgaacaagcttaagaaaagagctttgagggtgattggagagtttttgtctttagaagaagctgctggaataaaagagggattccagctaatggatacaagcaataaaggcaagattaacatggatgagctgcgagtagggttgcataaactaggtcaccaaattcctgatggggatgtccaaatacttatggatgctggtgatgtagacaacgatgggtacctagattatggcgagtttgtagccatttctattcatctgagaaagatagacaaggatgagcaccttcacaaagccttccaatttttcgataagaaccaaagtggatatattgaaattgaggagttacataatgccttagttgatgagattgaaacaaacagtgaagaagtcattaatgcaattatgcatgatgtggacacagataaggatggaaaaataagttatgaggaatttgctgcaatgatgaaagcaggcacagattggaggaaagcatcgaggcagtattcaagagagaggttctctagcttaagtcagaaattgatcaaggacggatctttgcaattgaacaatgatgacggtagtagactttattag

SEQ ID NO: 15369 - DNA, 218 bp, Glycine max
  Peptide Sequence Number=SeqID_107054
ttgagtcggttcaagtgatagaggtgtcatcctctgaagaggacccagaggagttacctcctgaacctgctatggacgcccttgacttacctgaggatgatgaagacccactccctgatgttgattctccagaggatattatgtcagcatctgaggcagactctacagaggagagtggccctggagggacagcgattagtgacgactcttcatcgtag

SEQ ID NO: 15370 - DNA, 447 bp, Glycine max
  Peptide Sequence Number=SeqID_107055
atggagacaatcgtgatggcagcgcagttcatccatgaccgagtggagatggagtgcctagagggagtttgggagaccctcgaaggcaatgcgaggtgccgatttcgtggcacaatccaactcacggctactttgttggtacatccagaggaaccaacacgcacgcttcagcgcacagtggagtggatattacctacacctactccatatctaccagtgaagccagtccaagtgattgaggtgacgtcatctgaggaagaccccgaggaggacccagagaagctacctcctgagcctgctgtggatgctcttgactttcttgagggtgatgaggacccactccctgaggtggattctcccgaggacgtcatgtcggcatctgaggcagactctatggaggagagcggtcccagacgaatagcgactagtggaggttcttcatcatag

SEQ ID NO: 15371 - DNA, 87 bp, Glycine max
  Peptide Sequence Number=SeqID_107056
acctacgtagttcttgccgattttggaaaagagagaaacgttaaggcgttgtaccttgaacaatctcttttgggtgagaaacgttaa

SEQ ID NO: 15372 - DNA, 363 bp, Glycine max
  Peptide Sequence Number=SeqID_107057
atggattctgctgcctcaaaacacatttgcagagatcgagagatgtttgatactttgaaaaccgatggagaattcaacaatttcaagttagggaatggtggaaaaatgaaggttgaaggcataaggagtgtgaggatgaagctccatgatggtgctattcgaactttctcaaatgtgaggtttgtaccttctgctattgtcaatatgatttctatgggggagatgacatcacaagggtacatatatgttgccttgaagaggaactatgaaagcaaagtgaagaagaaagtgaagttttctaatgttgtagaagtatttagagatacttccgttggagggggagtttgttcactctcaaattaa

SEQ ID NO: 15373 - DNA, 171 bp, Glycine max
  Peptide Sequence Number=SeqID_107058
atgaggacacgtagccctctaaaggtgagggcgtgcagccctctcaaggcgaggatgtgtagtcctctggagattgactgtccttttgaaagaggtgatagtccatgcaaccttatcctatcttttgcaaatctcttcgagaactccctcagagtgtgtgtttctgtttga

SEQ ID NO: 15374 - DNA, 255 bp, Glycine max
  Peptide Sequence Number=SeqID_107059
atgccgatcaaacgtctccattttcgcccaaaagttggccccagggcttcccggtatcaacagggacaccaggatttattctttctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 15375 - DNA, 636 bp, Glycine max
  Peptide Sequence Number=SeqID_107060
atgaaagataagagggatgaggaagaaaaactagaaaatcaaaagaaaaagaaggatagtaaggccttgtctttaaaggccaaggggaaggaaaacgaggaaaaagattcctccaagaagactgttaagaatgaaaatcattttgcaataaaaggtgatatcaaaagagcactccttcttaaacaatctttctaccttctcgtatcaagggaaacatcccttagcactgccatacctcttgggcttgaggttattccacaagtaaaggagttgttagataagggtttggttcataagagcttaaatccttgtgctttgttggtgtcccaaataggtattattaggcaccaaatccctaaaataggtggtatgatgaatgtgttaagtggtgcaaccctcttttgtaaaatcactcatgcacccaacatcttcatgatttgtgtacatagggactctttaggtagtgatcaaagggttctcatggatccaaagagaataaaggtcattactgagtggcccactccaccaagtattgagggaaaaagcccagagtttaaagaacctctggatttgaggtcaaatccttttgaagggggagggaatgatacaatcctaccacccaagggcattagatag

SEQ ID NO: 15376 - DNA, 501 bp, Glycine max
  Peptide Sequence Number=SeqID_107061
atgaagggcaccgtgcatgagcctcaagtgaacataggggccgatcaaaagttcacacccgtcgatgtttttaaacaagaaaaaaaagggggagacaagccctgggatttcaatggattgatcaaacatcaaacagctctattgccatcactccaaaatggtcaagtgactaaatcaaacagaacatacactttgagggggttcccggagagatttgcaaaagataggataagaggactacacgtcctcgccttgagaggactacacgtcctcaccatcagagggctgcatgccctcacctccagaggactacatgtccttgccttgagagggctacacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactag

SEQ ID NO: 15377 - DNA, 264 bp, Glycine max
  Peptide Sequence Number=SeqID_107062
agggtacatgccctcgccttcagaggactacacggagtcgcactagaggactacacgtcctcccctttagagggactacacgtccttgcctttaaagggctacacgccctcgcctttagaggaatacacgtcctccccttcagaggactacacgtcctccccttcagaggactacatgtcctcacctttagaggactacacgtcctcaccttccgaggactacatgtcctcgccgtcggagggctgcacgccctccccttctga

SEQ ID NO: 15378 - DNA, 201 bp, Glycine max
  Peptide Sequence Number=SeqID_107063
atgaaaggcctttttgttgcaaaatttgaaagcaatgaagtgcttcttagtccaatagctcttaaggtggttggccccttgcttcttgactcaaattcttcaagggatggcaccaatcctcctttccaatttcctatatggcaactcacaaacaaggaaacaaagagacaagcaataaccacataccaaaaaattaaatga

SEQ ID NO: 15379 - DNA, 174 bp, Glycine max
  Peptide Sequence Number=SeqID_107064
atgtcgcaacgtgcccttcgcgggcgagcgagggcgaggctcacgggtgcgctttccaaaggaggaaaggtcgacaaaagcggggctcttgctcctacgtaccctctatcagagaggatatcagaccaacgtagttcttccttatgcgtgaatcaagtgattctttttacttga

SEQ ID NO: 15380 - DNA, 132 bp, Glycine max
  Peptide Sequence Number=SeqID_107065
atgacgtctattaggaaatgttcgatcggcgtcatccggctaaaggcccaagtggagaaggacgaagacccaagtggagaaggacaaagcccccaagtggagaaggatgaaggcccaagtggagaaggatga

SEQ ID NO: 15381 - DNA, 359 bp, Glycine max
  Peptide Sequence Number=SeqID_107066
accagtttccactgttgaatgaccctaacaaagcatgcatctacgtgatcaagggaagatccaatagaggatttagctttccatggtccggaaacctcctttacaacacagagaagaacaagatgatcttcacacagcaaaatctctcagaactctttggaacttgtacctttctctctctagaacttcctaaacatgcaaaagcttcaagccaaggccagactcttgtgcatgcagaggcttcttcaagaaaaatgccaaactccctaaaaaatcagatttcaagcttaaatagcggtgcactcagcgaacctgacaactcatcttcttctggattcttccttgtgcttagccactga

SEQ ID NO: 15382 - DNA, 162 bp, Glycine max
  Peptide Sequence Number=SeqID_107067
atggatcaagctggtgaggaaattgagatcaaaagcgactccacaaacaagagcttcaaggtcaacggacatcgacttaagtcattcctcacaaacccttctttagtggacatagtggtggaagagacttccttactccaccctactcttcctccaccataa

SEQ ID NO: 15383 - DNA, 267 bp, Glycine max
  Peptide Sequence Number=SeqID_107068
atggcacgcagcgtgtttgctccgtgcccctattttagggacctacatgggagggagctaaaagggcttttagtgataattcccaaggtggtcatatctctcttgatggtctctagagtccccagcggagtcgccaactgtcgcaacctacccttcggcgggagggcgacgcgagactcgtgggtgcgtcttccaagaaaggaatacgcgcggagtcgccaccaacgtttatttgaggaaaacgtcggaaaaccggaaaaggcgtga

SEQ ID NO: 15384 - DNA, 303 bp, Glycine max
  Peptide Sequence Number=SeqID_107069
atgatattgcacgagattacaaggcctaactctctaacaacagttccagtggagtcgccaactgtcgtaacctacccttcggcgagagggcgacgcgagggctcacaggtgcgtcttccatgggaggaaaatgcgcggagtcgccacaaacatttattcgaggaaaatgttgaaaaaaccggaaaggtgtggtctacgaactttaagtgtgaaaggttcgggagttgtttttacgcacagggaagggtgtttccctcgctcctacgtatcctcaattgcaatgaggaaatcagatctacgtag

SEQ ID NO: 15385 - DNA, 306 bp, Glycine max
  Peptide Sequence Number=SeqID_107070
atggctaccatagatattactggctcgaacaggaatgacctcaacaaaccttttaggtttgaagggtatcatttcaaacattggaaacaaaagatgatgttttctatgaaaaaagttgcctatgttttgaacactgacattccagtgatgcctaaagatgctgagaaggaagtgaaggataaaatgactatggaattagctctttggaatgaaaatgattacctatgcaataatttcattctgaatgggttagctgatgatctttatgattattatagcctatataagtctgccaaattaatatga

SEQ ID NO: 15386 - DNA, 381 bp, Glycine max
  Peptide Sequence Number=SeqID_107071
atgtaccctcccttgttctctttgaacaacctagtggatgtaccctccactagaactgatccacaagagatgtaccctctcttgttctcagtcacaataaaccaagtagatgtatcatctacttgtaccacaaaggatataccctccaatgtgttaagacaaagttctcaggcgattagtcctttgaaactttgtgaatggggaaacaaaagaattctcaggcgggagaagggagacacaaaagaatttaggcagttaatccttcgttcttttggaaaaggtagaagagagatacaaaaagaattcaggcggttagtccttgacgaattctttttggcaaaggaagaagagaatgaaaagatgaatagcacaagtttttaa

SEQ ID NO: 15387 - DNA, 368 bp, Glycine max
  Peptide Sequence Number=SeqID_107072
ttcgaagtttctggagatttggctggctattgcactggagaagaattcattgagggattgttctaaattggcattgccctggggcgaatccagtgtcgacttgcgccttaagaatgagaacaaaacatttgaagtgattgcgatgcaagcgggcaaggtttggggtgcgccgtctgtgttgaaaagaaggaggaagatgagtgtgtgtatgactcacgtcagttacaaggtcactcatgaagaacatatcctctaccatgatggaactagcacggaagatatactgcgtttcgacgaagaactcggtatgggcactacgaatagtcatggcatttggagtggtcctgcattttcaggactaatgaacc

SEQ ID NO: 15388 - DNA, 318 bp, Glycine max
  Peptide Sequence Number=SeqID_107073
atggtccttgtattgacaattgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15389 - DNA, 134 bp, Glycine max
  Peptide Sequence Number=SeqID_107074
gttgtttcccagaaagacacaaaagccaggagtggatcttctggtatcaacacagctggcccaatcagcatcagcaaaggcagtgagggactttcatatactgacttaagcgttcacagcaaaggtgatatcag

SEQ ID NO: 15390 - DNA, 162 bp, Glycine max
  Peptide Sequence Number=SeqID_107075
attgggaaggacaatatagaggctaacattaacctcccatacttccatgggaaggacaatgtagaggcttacttagattgggaaataagggtagagcaaaaacttaaaagaaagttgatgaaggaagataagtcagggcagatgccacaaggattaccttga

SEQ ID NO: 15391 - DNA, 801 bp, Glycine max
  Peptide Sequence Number=SeqID_107076
caagattgcagctgtggttggtgattcagcaaaagagttggatcgcacgaagcaaactcggaacggcgtcgtgggcctgcctcggaaatacttggagggtaaggcaagggatatggcaagccaagagaagtggggcccgtttgcagatattttagctttgctgatttttggggttgtcctcttcccgaacgtcgacggtttggtagacttagccgccattgatgctttcctcgcatatcaccacagcaaggaaagtccagtggtggctatcttggcagatttgtttgacacctttgaccggagcgcgatcaattggtttcctcgttggaaggaaggcaaggaaggagttcttttctcgtgtggggactaccctaatattccatatatagggactagggggtgtattaattataatcccgtactcgccataagacaactagggtaccccatgaggggagcgccaaccgaagaaagtatctcgcctttccttgtgaggaatttaggcgcgcaaaatctcaaggcgatacaaagagtccacaaggcgtggagaagtccccccccgaaagacaaggagcttaggcgcatccgtaatggcgtcatcggaggttatcatggatggctaagaattcacacgcgggggttagattggctctccaagttgaaagttatcgacgaggagaacttcgaagcttcggaagaagatgaagaagtccaagctctaaaattggagctagggaaagcaaggctcgccaaggagaagtttaaatcagctgctacacacatccggaaggagtgcaccga

SEQ ID NO: 15392 - DNA, 330 bp, Glycine max
  Peptide Sequence Number=SeqID_107077
atggcccaccaaatagatttaggagttcccaagagcaagccttcctatagggttccagttcctattagctattgctcacctctcaggagactaagggaagaagaagtctttcacgctagaagatgcctggagtgggcatggagtatatgtgtacagattgtgggcaccctatgcttattttataaatcacttcataaagtcactagctaccccattcctagacttgatgatttgcctgtaatgagttgcaaatggtgcaattaccttttcaaaaattgtcattcaaaagtggtctcaatcaccaaacttaaacaggatgaaaaatggtga

SEQ ID NO: 15393 - DNA, 306 bp, Glycine max
  Peptide Sequence Number=SeqID_107078
atgacttggggagagtctgacttatcaaatggggcgaacaactcagaagggaggaaggatggaagtctgaaaaatagcagtgtgaagatgaggaagaatagtgcaacacaagaagcaaggaatatagtggatatggggattggtttaggggtgtctttgattgggaaggaggaaattatggctaagggtgaaggaggtgcaagagttgatacaaaaagaggaggtgcaattattattttacaagaaactaaaaagaagtgctacataaggaattatgttacactttatggggtgactttgaagtag

SEQ ID NO: 15394 - DNA, 381 bp, Glycine max
  Peptide Sequence Number=SeqID_107079
atgaaagatagaagaaatacaactagtggggatgtctcctccacctctagaaacctcacaatctctcaaaatctcctccaaagctcagcaagatggcttccttgtcaagctcagctctctcccagtctctccacagtcaaaaactctcaaaaaactcaactcaccctcagaaatcgtgatttcagcttaaataggcaatcttcgccagtcacactcgctcaacctaaaggtgaggacggtgcgcttagcgagttggctttcgctcagcgcctctatacagctcatccttcttccataattgttcatgcacttagccatcagttggggcgcttagcggatgatgcgcttagccagaagatgagtggcttagcgagttcatga

SEQ ID NO: 15395 - DNA, 229 bp, Glycine max
  Peptide Sequence Number=SeqID_107080
atggagatgggtgagagtgcattattgacaactgcttatgggatgaacaaagcagttaagtctcaagctaatcagaagggaaatgataaaataccacctcaagctgatattaagaaggtgaaaaagtgtttcttttgtaagaagaagggacacatgaagaagaattgctcgagattccagaaatggcttgagaagaaagggtatgcaaacctaaggaaaccagtggaaa

SEQ ID NO: 15396 - DNA, 138 bp, Glycine max
  Peptide Sequence Number=SeqID_107081
atgtgggagatgccttattctgaagagagccttgttccatttgacttccttaccaaatcaattggagttagcaacttctcttgcaagaaacttgaaaatcttctctcttttgctacaattcctccttctgtcaatcaa

SEQ ID NO: 15397 - DNA, 781 bp, Glycine max
  Peptide Sequence Number=SeqID_107082
caaacagagaaggagcatctgtcaactggttccctcgatggaaagaaggaagaaccagagttcttatctagtgcggaggatttccgaatgcaacttggctacccgatgagaggggcaccactagaggaagagctcccacctgtccgcaaggcatgggaggtggtacaaaaggaggacaaagagttcagaggcagtaacaatgggcccattggtggctaccatgagtggttgaaagcccacgtgcaagctttggattggctcccaagtctgagaaccgctaaaagggaggaagttgaggcaccgaaggaagacgaagaggtggctcgtagggaagaacatggctggaacaagttccgaggggctctgtggggcagtaacagcgagcttaagctctggaaggaggaaagggaccaatcgcgagaagacaatttgatcttgaaggatgagttgaaggcttgctttaggtccaagaaaagtttgtctcagcggttatgcgagacaaagaccaacatgttagccatcatcagcaagtaccaagaagaactaaatctagccacgacccacgagcatagagtggcagacgagtatgcccaagtgtacgcggaaaaggaggctagaggaagggtgatcgactcgctacatcaagaggcaacgatgtggatggaccgattcgctcttaccttgaatgggagtcaagagattccccaattactagccaaggctaaagcgatggcagacacctactccgcccccgtggagatccacggacttctcagctatt

SEQ ID NO: 15398 - DNA, 384 bp, Glycine max
  Peptide Sequence Number=SeqID_107083
ttagttgagaagtcatccaatagctttggggcatatactgagaagaatcccaaagaagaatgtaatgttgtgatgacaagaaacaagaagcctgtggcagttgaggatgagggtattgtggccttgaaagaacaaactgttgtaaaggacagtactgggaaaacgaacgaggaggaaactggaaataactatgcctttcagagaagctttgcagcagatgccactctactcaaagtttttgaaagatatgttgacaaggaagaacaaatacattcactaggaaaatatcgttgtggagggcaactgcagtgctgtgatacagaagatccttccaccaaaacacaaggaccctggaagtgtgactattccttgttcaataggtga

SEQ ID NO: 15399 - DNA, 842 bp, Glycine max
  Peptide Sequence Number=SeqID_107084
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgttatccagtgcaaacctatgtcttagaaaagaatgatagtgtgattcgtgatgctgtcttgcgtgaaatggagcgtggaggtcaggtttactatctttacaataaagttgacacgattgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15400 - DNA, 333 bp, Glycine max
  Peptide Sequence Number=SeqID_107085
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcattccgttaacccgggggataccactagttctagagcggccgcatcaccagcggtggagctcaacaattcgcggcctatacacatccgccctttagcgccagctggcgtaatagcgcaaaggcccgcctaccgatcgcgttggccgattcattaa

SEQ ID NO: 15401 - DNA, 108 bp, Glycine max
  Peptide Sequence Number=SeqID_107086
atgaaggttgattcactcaatttggagtacttctttcaatacttcctagtaaggtggttgactcctcttgttttgaccaaattttcaaggagttcaatattcacttga

SEQ ID NO: 15402 - DNA, 234 bp, Glycine max
  Peptide Sequence Number=SeqID_107087
atgctggaaaatgtgaaggacaatgttcctgatttttgcacaggaatgggaatgcttgcgataagcaaggaagagtttcctttcttgaatgatttctacaagaacaacataaacttgaatgatttctacaagcctgaacaatctactagcttgaagagaaggaaggtgggaaatctgaagctccaaaccacattctcattcaaacatctaacatgtgtgaatggagaaacttaa

SEQ ID NO: 15403 - DNA, 198 bp, Glycine max
  Peptide Sequence Number=SeqID_107088
atgacaccggtaaaccgaaaggcaggaacaggagagcgcacgagggagccgccagggggaaacgcctggggggcggagcctatggaaaaacggctttgccgcggccacatcttcacttccctggttaagagtgcttcctttggcatccgaattcctgccccgtggggtaagccactagttctgagcgtcgccgcatga

SEQ ID NO: 15404 - DNA, 664 bp, Glycine max
  Peptide Sequence Number=SeqID_107089
atggcggttctcctgcgcatgccggcactgagtcgccatcttaccggatcggcggcagcgtttcatatggcctgcgaggccggtatgaactccctctttgacgccattgtttctgcccatcaacagctgcgccctcagctgggctgcgagctgtatctgaaatgcgaccatctgcagcacaccggctcctttaaatttcgcggcgccagcaacaagttgcggttactggatagcgagcaacgccggcgcggcgtgatcgccgcctctaccggcaaccacggccaggcggtcgctttggcggggcagctgatgggcgttggcgtcacggtttatgcgccagagacggcggcgagcatcaagctagacaccatccgcgcgctgggcggcaccgtggaacgggtgccgggcgatgcgctgaacgccgaactggccggagaacaggccgcccgcgaacagggaaaaacctatatctcgccgtataacgacgagcaggtgatcgccggccagggcacctgcggcatggagctggttgaacagctcaccggtctggacgccgtgttcgtggcggtgggcggcggtggctatatcgccggtatcggcaccgttctgcggcaattgtcgccgaacacgcagcttatcgcctgctggccggaaaacgccacca

SEQ ID NO: 15405 - DNA, 228 bp, Glycine max
  Peptide Sequence Number=SeqID_107090
atgaccaaagatgatagtataatatctccttcaacctcaaatccattgttgatcctatctgaaaataattacgtagaggtgtttcttgcaccgactgatcaagaaaagagaaagaaggtcaaattgggggagtccgaccacggtggtaccaccaaggtcgaagagaaacaaggcgacattgattcgattgttgagaatgaacgatgttatgtacattctgtattgtaa

SEQ ID NO: 15406 - DNA, 811 bp, Glycine max
  Peptide Sequence Number=SeqID_107091
ctgtccctcctgttcagctactgacggggtggtgtgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtgctccagtgcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaaa

SEQ ID NO: 15407 - DNA, 312 bp, Glycine max
  Peptide Sequence Number=SeqID_107092
atgattatgaggggtcaagatatttatagtagtcaagagaagactacttctttcccttcctctagtggaagtgaagatgaagtaaggggtgaagagtctactgaggaagtctacccccatgaagaagaagttgtcatcatcaaaaagggggagattgtagaagcaaagcttcatgatgatgacaaaggtgatgacaaaaagctcaaaggtcaatcaaagaatgaattcaagatgttcaagaaggaatcaagaacaattcaaggctcaagaggaaaatttgaagaacgcttcaagattcaagaggaaagttga

SEQ ID NO: 15408 - DNA, 108 bp, Glycine max
  Peptide Sequence Number=SeqID_107093
gtcatgaaaagacaacaatagataccccagagccctacactggagcaatgagaggcaccatgcgtgagcctcaagagaacctaggggcagatcaaaagttctcacccg

SEQ ID NO: 15409 - DNA, 777 bp, Glycine max
  Peptide Sequence Number=SeqID_107094
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgctggcacaaagaagagagaatgggccttgtgtcaacaggacaaagaattgacagtggacagtgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 15410 - DNA, 183 bp, Glycine max
  Peptide Sequence Number=SeqID_107095
atggagataacaatttcaaagcttaaggttcaatttgacaattacaattcagctcaaagatgggtgcaactgatatcatcattgataaattggaaaaagcggtgtgagcttatcaaattttgggggtgcatcaggaaacttccgaaggaagccacctgctcgcttggacgagctgtgatgtaa

SEQ ID NO: 15411 - DNA, 993 bp, Glycine max
  Peptide Sequence Number=SeqID_107096
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtgaggctgcagaagtgacttcgccccacaccctcccccagcccttcccccaaccccagagaggggaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 15412 - DNA, 234 bp, Glycine max
  Peptide Sequence Number=SeqID_107097
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccg

SEQ ID NO: 15413 - DNA, 273 bp, Glycine max
  Peptide Sequence Number=SeqID_107098
atggcttctcctgagctaatcaccatgaaagacaagactgagtatcaagcttatcgataccgtcgacctcgagggggggcccggatatattccgcttcctcgctcactgactcgctacgctcggtcgttcgactgcggcgagcggaaatggcttacgaacggggcggagatttcctggaagatgccagaagatacttaacaggaagtgagagggccgcggcaaagccgtttttccataggctccgcccccctgacaagcatcacgaaatctga

SEQ ID NO: 15414 - DNA, 213 bp, Glycine max
  Peptide Sequence Number=SeqID_107099
atggcatgcagcgtgtttgccccgtgcccctatctacgggacctatatgggagggagctaaaagggcttttagtgataattcccaaggcgatcatatctctcttgatggtctctagaggtatcatcccctttgaagaacatattgcagcagtagggactactagcaacaatatgttatcaaagaaaaaaactctagatgagggttcactgtaa

SEQ ID NO: 15415 - DNA, 725 bp, Glycine max
  Peptide Sequence Number=SeqID_107100
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtcgactctggatttcctaacatgccaggctatctcgtccctttcagaaggaacaaatatcatttacacgattttcatgaaggatatggacgtccactcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15416 - DNA, 303 bp, Glycine max
  Peptide Sequence Number=SeqID_107101
atggatgtggccgttgtgggtgatccgttcgacgttcacctcatagaccttcgagagcagatcgggctgcaggacgtctttgcaggagccgcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15417 - DNA, 495 bp, Glycine max
  Peptide Sequence Number=SeqID_107102
atgaccatgattacgccaagctcgaaattaaccctcactaaagggaacaaaagctggtaccgggccccccctcgaggaataacgaattctgaaggactagccctgcatgcaaaggaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15418 - DNA, 149 bp, Glycine max
  Peptide Sequence Number=SeqID_107103
tgtcgattctaattctggtggctgtggcggcatcgatggtggtgctgccgctgatgttgccgcccctgcctccaccgccgctgattctcctcttcttccccgtcggcataatgacggcgcttatgttgctggcgtttgtgccatcagag

SEQ ID NO: 15419 - DNA, 432 bp, Glycine max
  Peptide Sequence Number=SeqID_107104
atggaatccccaagctttagggaaaattctgtccaaggctggctcccccattgcacagaccaccttactacatcaaagggatctatctcatttgctcgagctctggtggaagttgatgcttccttggagcttattgaagaggtttgctttagacttcattctggtaagacattcatccagaagatcgaatatgagaataggccatccttttgcacccattgcaaaatgatcgggcatcgattaacaaaatgtaaagttgtgcctgtagccaagcacgaccacaaaataaccaccacaaaaggtcccttcactgctcaatctcaagtaactgaggtggcatctctcatagaaaccaacgcttccaatccctctggaaaacaaaaggaggaccaggctcagctgtccactccaccttgcatacaacagtcatag

SEQ ID NO: 15420 - DNA, 1005 bp, Glycine max
  Peptide Sequence Number=SeqID_107105
atgggagttgttgaacaagaaatggaagaggaagagaaagaaaaacatacaaacaaccataaccacccttcttctctccacccaattaaggaagagtgtgttagtgtgagaaaaccctttagtggtgatagagtgaagagagatgaatggagtgaaggggcagtgtcaaccctccttgaggcttatgaggccaaatgggtgctaagaaacagagccaaactcaagggccatgattgggaggatgtggcacggcacgtgtcggcacgtgccaactgcaccaaatcaccaaagacttcaacgcagtgtaagaacaaggttgagtccatgaagaagagatacagatcagaatcagcagcaacagcagatcatgcatcatcatcatggcctctttattcacggcttgatcttcttcttaggggaactggacccgtgttgtcgtcgccgccgccgccaccggcgatgatgccggcggcgatgccggttctgtctccggtggagccgtcgcaaccgccgcagctgtcgccgcctccggcggctccttcagggccacttgctaatgcacaaaactcgcatggatccaacggaattgatgagaagcttgctaaggaagatgggttaggaactaagtcatctgatcaagtatctagcaagaatccattggacacagatagcagcacgccagcactttatagcaagaaggacgggttaagatgcaacaagaggaagaagaaaacaattgacaacacagggcgaagaaggaaagagtgtgtggagatagcagaaagcttaagatggcttacagaagctatgataaggtctgagcaagcaagaatggacacaatgaaggagatagagaggatgagagttgaagctgaggccaaaagaggggaaatggaccttaagagaactgaaataattgccaatacacagttagagattgctaggatctttgcaagtgtcaacaataaaggtgttgattcatctctaagaattggaagaagttaa

SEQ ID NO: 15421 - DNA, 154 bp, Glycine max
  Peptide Sequence Number=SeqID_107106
tcgagctttcatcaagaagtactgcacccccaagcaggcccagggcaaaacaccacagcagcattgggatggccggtaccaggcaatcgacacaccgccaccacctctagagttcacctcagctcatccacaaaaaggtagcaagataccttag

SEQ ID NO: 15422 - DNA, 547 bp, Glycine max
  Peptide Sequence Number=SeqID_107107
atgagcttgacggcgagcggcgccgcgctgcgtgagcagggcgctcaggtggaaacgcagaccatcgatctggcgtcaccggattcgatccgttcggcgttcgagaagatcgccgcaggcggcggaatcgacggcctggtgaacaacgcggcgttggcgaccggcgtcggcggcaaaaccatgatggaatacgatatcgatctgtgggatcgggtgatgcaggtcaacgtgcgcggcacctggctggtgagccaggcggcggtgccgctgctggcgcgcagcccgcacgccaagatcgtcaacgtggcgtcggacactgcgctgtggggcgcgccgcgtctgatggcctatgtcgccagcaaaggcgcactgatcgcgatgacccgatcgatggcgcgcgagctgggcccgcaggggatctgcgtcaacgccatcgcgccgggcctgacgcgggtggaagccaccgagtatgtgcccgccgagcgtcaccagctgtacgagcaggggcgcgcgctggccggggcgcagcacccggacgatgtgaacg

SEQ ID NO: 15423 - DNA, 751 bp, Glycine max
  Peptide Sequence Number=SeqID_107108
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatctatgccaagcacgccaaaactggataccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 15424 - DNA, 468 bp, Glycine max
  Peptide Sequence Number=SeqID_107109
atgaccggaaggctgcttgccggttcattggctcttgaaagccgcatccttcactatcttactcccaagatcttcaaaccttgcacagtcacttttttccttcaacattttaacatcccttttgattctgaaccttatgttctaatcaagagatctttcttgatcgatgctgctgtggttgcgtcctttggttaccgcaaagagcgtgacggctcttgggtaaaaaatggtgctcaaccaaatgatgatgaaggacaattactggttgaagtggactcttctcttcttcagagtattttggacagatttaatggacttcaaacctatgttggtgagaggtttgatgctttggaacgacaagtggacacgcgattcgacgaaatggactcaaggatcacaaaggttgaaaaagatgtcaccatcattcgcggctgccttgatttacctccaccatcaccatcagtttag

SEQ ID NO: 15425 - DNA, 828 bp, Glycine max
  Peptide Sequence Number=SeqID_107110
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 15426 - DNA, 447 bp, Glycine max
  Peptide Sequence Number=SeqID_107111
atgcagctaccgcaagagtccttgaacaagaaaccaagagggctcgcaaggaagagcatggccgtgacaaatttcgtggagctttgtggggcagcgacagagttagctgcttgctcaaggtccaaaagaaacttgtctcagcgtttatgcgagatagagaccaacatgttagccatcgacagcaagtaccaagaagaactaaatctagccacgacccatgagcacaaagtggcggacgagtatgcccaagtgtacgcagaaaagaaggctagaggaagggtgatcgacgcgttacatcaagaggcaacaatgttgatggaccaatttgctcttaccttgaatgggagtcaagagcttccccgattgctagccaaggccaaagcaatggcggacacctactctgccccgaggagatccacggacttctcagctattgtcagcatatga

SEQ ID NO: 15427 - DNA, 381 bp, Glycine max
  Peptide Sequence Number=SeqID_107112
atgaccgatccaggttcacttctcctgaggcctgagaaaggcagcattgatgttgccattgtgaaagagttttatgctaacctctatgatcccgaggataaatcacctaagcaggtgagggtgagaggtcatttggtgaagtttgatgcagacactttgaacactttcttgaagacccctatgataattaaggagggggaagagctgcctacctactctagatttgtactcttgaggcctgatcctcaagagttggttgctaagctctgcatcccagggatgggatttgagcttaatgctgatggcttgccactgaagatccttaggaagaacatgaccacacttgctcagacttggagtgttctttcttactccatcttg

SEQ ID NO: 15428 - DNA, 777 bp, Glycine max
  Peptide Sequence Number=SeqID_107113
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgagaggaagaactgaggctcagagtgcctatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15429 - DNA, 291 bp, Glycine max
  Peptide Sequence Number=SeqID_107114
atggtgaaagttggaacctcttacgtgccgatcaacgttcattttcgccaaaagttggcccagggcttcccggctccagtggcttctgtttctatcagctgtccttcctgttcagctactgaggggaatggtgttatccgtaacgcaaaagcaaccgccggaacatcagcgcgcaagtgtaaagccggggtgcctaagacgctgacgctaactcaccacttaacctcgttgcgcttcactgcccgctttccagtcgggaaacctgtcgtgccattcgctgcattcaagtga

SEQ ID NO: 15430 - DNA, 708 bp, Glycine max
  Peptide Sequence Number=SeqID_107115
atgcagtcccaaatgcaatctcaaggacttgcattgcctccagagcctctggctggttccttagctcctcgagtaagcacaaaggagagttatgttgatccctcaggaaacgatcctgagacgggtgactcagacaggtgcagcttgtacatcgaagcaaatcctgcccgcttggttgccctacgaagagtttataagggatccactgttgttcataacactcctttattccctggccaagtaaagctgggtgtggaagaggttaaagatttagatgctcctgttcctgtagccactgatgaggtttccttagtggggcagacaattcacacattccttgcttggctgatacatctggtcaagcctttatcacaacaggcagttgtgtctctggcaaaaccacctcaaacgccggatcctggggtcgatgatctgctttatctgatgacattgatcatcccagagtttttcttgaggccttaccaagttacatgggatgccaccatgtttggggtctttaatccagacttcccgctctacataaagcacaaagatctctccgaaatcgcacacaatggtcaatgtctcagcatatcagtgttacagttgtggattttgcatctgactgaaacaagtatgcgagcgggaaattctgatctgtatggattcctcaatgcacaatccattcagaggtctgggctatcatag

SEQ ID NO: 15431 - DNA, 450 bp, Glycine max
  Peptide Sequence Number=SeqID_107116
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatgctgtgtgtctcccaaggccaactcaaaatgtcaggccggctgggtgctgatgtggagactgtggaataa

SEQ ID NO: 15432 - DNA, 273 bp, Glycine max
  Peptide Sequence Number=SeqID_107117
atgaaaagagaaaaacatgtctcatatagtagtcatgactcttgcaagagtttaagtgaagaacttagaaactattatggaaggcagcataggtcacatactaaacatcactcccaaagaagagaaaaggatagaaggcctcaagaggttgaacaactctttgcttgccatcatattagtgaagagagaaaatttccattggctacccttagctttcaagggtatgtccaaaggcttagacaagggagtataagtgttgaagaatatagatga

SEQ ID NO: 15433 - DNA, 867 bp, Glycine max
  Peptide Sequence Number=SeqID_107118
atggggtcgagtcagacgccttcgcttaaaaagaggttctatcaagtcaagatcaagagcctaggagtcgtcggtctgaaagagttaggacagttgatgggtcagctccagcgacaagcctttcgcaaagcttacagtaagatctgggacctaaccatggcagaggtctccacggaggccattgcctccctcgcccaatattatgaccagcctttgaggaaaccatacctcttctcgggattctatccctccttagctagaatttctaagatagtcaaaatctcgacacagatattagaccgcgaaaagcaagtcgaaaatggggtggttggggtaccaaggaaatgtttggaagcaaaggcgagagtcttggcgagtcaaggcgaatgggccccgttcatggacatcctggaacttttgatcttcggggtagtcctctttccaaatatggatgggttagtggaccgggcagcgattgatgctttctcgccttttacgaccgtaaggaaagcccgcgcgggggtgcttcagagggtccacaaggcatgggaaatgtcacaaagaaaggacaaggaacttagagggagtagcaatgggcccatcggtggttaccataggtggttgaaagcctacgcacaagacctggattggctcccgagtttgaggaccactaaggggatggagattgaaactccggaaaaagatgaagaggagaacgccaaactgagagacaatatagccaccaccaaggccttggagcaaaagaccaagagggcccgtaaggaagaacatggccggaacaaatttcgaggggctctgtggggcagtaacagcgagcttaagctccaaagaaaggggagggactaa

SEQ ID NO: 15434 - DNA, 1377 bp, Glycine max
  Peptide Sequence Number=SeqID_107119
atgtatagcaatttcaaagagcaagcaatagagtacgtgaaacaagcggtagatgaagacaataagggaaactacgcgaaagcgtttcaactttacatgaacgcgttggagtatttcaaaacgcacctcaagtacgagaagaaccctaagatcaaggaggccatcactcagaaattcaccgagtatctccgccgggccgaggagatccgggccgtcctcgacgatgggcccagcggcccggcctccagcggggacgccgcggtcgccacaaggcccaagacgaagcccaaggacggaggcaaagatggagacggcgaggatcccgagcaggccaagctacgggccgggctcaactccgctatcgttagggaaaagcccaacgtgaagtggaacgacgtcgcggggcttgagagcgccaagcaggctttgcaggaagcggttatcttgcccgtgaagtttccgcagttcttcactggtaaacgacgaccttggagagcgtttttgttgtacggaccgccggggacgggtaaatcgtatttggccaaggccgttgccacagaagctgattctacgtttttcagtgtttcttcgtcagacctggtttcaaagtggatgggagaaagtgaaaagctggtctcaaatcttttccaaatggcacgcgaaagtgcaccttctatcatattcgttgatgaaatagactctctatgtggtcagcgtggagaagggaatgagagtgaagcttcaaggcgtattaaaactgagcttctggtgcagatgcagggtgttggacacaatgatcagaaagttcttgttctagcagctacaaatacaccttatgctctagaccaggcaataaggcggcgtttcgataagcgtatatacatacccctacctgatttaaaggctcgccaacacatgttcaaggcatgggcaatatacatgatgatgttcattggtcttattgtgtattgtgaacctagcaaatggccttacaatgtgcacctaggagatactccccataacttggctgaaagtgatttcgaacatttggctcgcaagacagaggggttttcaggttcagatatatctgtctgtgtgaaggatgttttatttgaacctgttcgcaaaacccaagatgccatgtttttctttaggaatcctgaggatatgtggatcccatgtggaccaaagcaacagagtgcagtacaaactacaatgcaggatcttgctgcgaaaggacttgcttctaagatcctgccaccacctatatcgagaacagattttgacaaagtacttgctagacaaagacccactgtaagcaagtctgaccttgatgttcacgagcgattcacaaaggaattcggagaggaaggataa

SEQ ID NO: 15435 - DNA, 235 bp, Glycine max
  Peptide Sequence Number=SeqID_107120
aggcggaggtgttggcggtggcggtggccgtggtggtggtggagggattgggattggcattggagtaggagttggggttggagccggcgccggtcatggttccggtgttggtggaggagttggagtggcaggggagcttataaaggcctacgagggacaacctccccctcaacccattattcttgttaaaaacgtttattgtgcattgtacatttgtaccttaaagttaaattaa

SEQ ID NO: 15436 - DNA, 720 bp, Glycine max
  Peptide Sequence Number=SeqID_107121
atggggtggataaaggcagcaattggagatgcaattttgacatcaatgtgggttttcataatctcaacattaaggattgtcacaactgagataacagttttccttggcctccaaccatttttccttgcaggtctcataatcagcaccatcctaaactccatctatgtcctcaccataagcttcattggaagaatcttaggtggtgtcagcttcaacccttcaacaagtctttctttctacactgcagggttgaggcctgactcatccctttcatcaatggcagtgaggttccctgcacaggcatatggtggtgctgttggcatcaaaacccttcttctagtgatgccatctcactacaaggacatgctgaagggacctttcttgaaggtggacttgcattctggtgctgttgctgaagggctgttgactttcattcacaacatggctatcttctttgtcatgtttaagggtcctaggaacccttttgtgaaggtgtatttgctctctgtgactactgctgctttggctattcttggaggtggcttcactgggccttccatgaaccctgccaatgcctttggatgggcctttgtcaacaacaagcacaacacttgggagcaattttatgtctattggattggtcccttcataggggcttcctcagctgctttgattttcaggtctatgtttatgccaccaatcaagcagaagaaagcttga

SEQ ID NO: 15437 - DNA, 1143 bp, Glycine max
  Peptide Sequence Number=SeqID_107122
atgggaaaacgagagaagcagaagcagaggcacgagaagggacaccgtggaagagggtctttcaactatcttcaagaggaccatgattttgatgacactccaagaccctcaccatctgaagaagaatgtgctgatgacagcaatgaggaaaaagaagaagaagaagaagaagaagaagaaggtcatgaaaaccaatctcatgatatgccttccaagttcctcctttaccaacaatctgtgcagtcacccaaaggagatataagttatttgcaaaagttctttctcatgtacgtgggtggaaggatgcccctccatcttcaagaagatttctgtggcacggcgcttcttagtacagaatggctccgcagtgattcaagaagaacagtagtaggattagatttggatcttgaggcactcaattggtgcatggaaagcaacatacctaaagttggggctgatggattttcaagaatgtctctctttcatgggaatgtcctacaacctcttcagtctaaacttaatgaagaaaatcttcagactgatgtgccagaatctgatgctccaacaggctctgttgctcaagatgacaagtatactaagagaaacataatactgcctggaagagatatcgtgtgtgcttttaactacagctgctgttgtctacataaacgagcagaactggttctgtatttcaagcatgctcgtgaggccttgtcaactaaaggtggaatttttgtgatggatttatatgggggtacgtcatcagagcacaagttgaggcttcagagaagatttcccaattttacggtatgtcagagcttcacgtatgtatgggagcaagctgaatttgatattattcaacggaagacaaggattagcctccattttcatatgaagaaggaacaaagaaaacttcgccatgcattttcatacagctggcggttgtggacattgcctgaaattagggattgcctagaagaggctggatttcggtctgttcacttttgggttcgagagatgccagacaccacagaaattatgagaacagaggggtttggtgcgggaaagaatgtaaaatatgaagaggctacaagttttcagcaacaagattcttggaatgcttacatagttggtgttgcgtaa

SEQ ID NO: 15438 - DNA, 2688 bp, Glycine max
  Peptide Sequence Number=SeqID_107123
ttcagggctgttgttgttgtctcagctgttcagagaatcaaagcttatttagtgcacatcatatgcgagtcctcagactctgaactacatgcttttgttcatcatagtagtagtggagaggtctttcattattcagttggatttagcaccaccaagatgaaggttcaagaaacgaggtcgcatgttcatgcacttggggaagaagagaaggtgatgacaaggaagcagaaggctgagtccaaggcacatgaagtggaacattctccaaagaaggccaaggtggaaaaagaagatggccacatcaacgggaaatctgaaactggcgttgcagaagaatatgatgagttctgcaaagccacaaccgagcaccttcctttggaacaaatgagagacattctggaggccaatggccttgattcttctggctctgatcttgaaattacaagaagatgccaagacttgctgttttatggtgcattggacaaatgctcggtttgcaatgggagtttggagtttgatggcagacgttatgtttgcagagggttctacagtgagtgggctagttgcactttcagcaccagaaaccctccaaggaaacaggaacccattaagttacctgattctgttcagaactctctggcttcagacgtgacaattctccctactttttattttgtttttccttcgttgtttgctaaagaaatatcaggacccgagtcacaggcctcacagggatctaggcttagcagaaaaaccctttactggaatgatgatctctctgatgggtcgtcttactcggacacacggtcaacttgtttggtagcttcacctgctgagcgagaacgtggtggcacatccaaacttgcagaagccatcttctatcctggaaggagaggttacgaagtagctcgaacaacgggagaggtcaaaaaacggctttttcttaggcgcaggccagctttaatcgaactcagggagaggagtataccagtggttagggaggcttggttgattgacagcattgaaaagcaagaaccacaacctttggaagcttatgatcttgtctctgatctttctgtggatggcaagggtatcccctgggacaaacaagatcctggggaagaggctatcgaatcactctcagcagaactcaagctttatgggaagagaggagtctataaagataccaagttgcaggaacaaggtggaaagatatttgaaagagatgggatactatacaactgtgccttctctgtttgtgaccaagggcgaggactgaatgactactgtgtcatgcaactgattgttgtcccagagaatcgtttgcatctgtactttaagaaagggagagttggggatgatccaaatgcagaggagcgattagaagagtgggacaatgtagatggtgctctgaaagagtttgtgaggctctttgaggaaataacaggaaatgagtttgaaccttgggaaagagagaagaagttccaaaagaaacctttgaagttttaccccattgacatggatgatggaattgaagttagacatggggcactaggtcttcggcagctggggatagcagcaacacactgcaaacttgagcctttggttgcaaattttatgaaggtcttgtgcagccaggagatatataagtatgcattgatggagatgggttacgactgtccggaccttccaataggaatggttacaaatcttcatctgaaaaaatgtgaggacgttctcttagaattcatagacaaggtgaaatcattgaaagagactgggcccaaggctgaggctgtgtggactgattttagccaaagatggttcactctgatgcactccacaaggcctttcaattttagagattaccaagagattgcagatcacgctgctgctgcgttagagggggtgagagacataacccaggcttctcacctcataggagatatgactggctcaaccattgatgacccgttatcagagacatacaagaaattgggttgctcaatttctgccttggacaaaagttcagatgattacgagatgattgtgaaataccttgaaaaaacttatgagccggtcaaagttggtgacattgaatatggggtgtcagtggaaaacatttttgcggttcaaacaggtggttgcccttcctatgaagacattataaaactaccaaataaggttcttctatggtgtggatcacgaagctcaaacctcttgaggcacttgcaaaagggattcttgccagcaatatgctcattacctattccgggttatatgtttggcaaagctattgtctgttctgatgctgcagcagaggctgcaagatatggttttactgctgtggacaggccagaaggattcttggttttggccattgcttctctaggaaatgagattaccgagttgaaaaccccacctgaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggcacgcataagctacttggtgggagtgaagtatgaagagaaggaagagaagggtgcggtgattgacacagctgaatga

SEQ ID NO: 15439 - DNA, 1722 bp, Glycine max
  Peptide Sequence Number=SeqID_107124
atggctaaaccccaccatctctttctccttcttcttcttctctgcgccactcttgagttttcttcatcttcaccctccgatcacctctacaatgttggagaacttgtcccattgtttgtcaacaaagtgggacccttcaacaaccccagtgagacatatgagtactatgatttgcctttctgcaccccagacccaattgtcagaaagaaagagtcccttggggaagttctcaatggtgaccgtttgagcaatgctttgtatgagtttaagttccgggtggacaagattgatgagaccttgtgccaaaagaatcttacaattgatcaaattgcaacctttaaacgagctataaaccgcgacttttacttccagttttatctggacgatcttccactatgggggttcattggtaaacttgaagaggatgggtggacacctggtggaggaggacctaactattacctttttacacatgttcaatttgatgttctttacaatgggaaccggatcatacaagtcaatgcatttggtgatccaaatcgcgctgcagatattactaaagatgttggtgttgatgttaagttcacttattctgttatctggaatgccactaaagtacgttttgagaacaggatggacagatacttgagagcttcgttgatgcctgtccaccagcaagttcattggttctcgtttgttaactcaattgtcatcattttgcttttgattggtttgcttgccctgctttatatgcggcatctgaggagtgatttgaaaaagtattctaatgcaaatgaagaagataatgaggttggttggaagtccctccaacatggcgatgtattcagacctcctccaaactcatccttactttttgctgttgtgggaactggtacccaattgctaatcttgctttgtgtcttgctgtttctagcacttattggcaccctctatccctacaatcgtggaggactgttaaattggcttgtcttgctgtatgctctttcatctgtttttgctgggtacactgcagcatccttccatggcctgtttgctgagaatggatgggaaaggagtgctagtctagcagcaattctttacactggaccagtgtttgttgtagcctctatcctcaacattgtcgcaatatcttacagggctacaattggactcccattcggctctattattgtgattcttgttttattaacatttctcgccatcccattgcttgcatttggtggagtgattggataccgttttagatctaaatttcaaagctcctctgccacaaagagacatccgagagatattcaacagcttgcttggtacaggagaacaccatttctaatgtttattgggggtcttgtgccttttagtgcaatagtcctgcaactacaccaggcatatgctagtatgtggggctacaaaatatacactcttcctagcattttatttgccacattcattcctgtcattttgatcattgcacttgtcagtattggcttgacatacattcaactatctgcggaagaccatgaatgcttgcttccgtttaatgtttttcttctcccctattctcctccctcgcttgtttgtgtgcctgggatcagtgctgtgtggtggctcaacagccattttcatgtttgggtattgcgtctacttctatgtgagatcaaatatgagtggattcttgcagctatccttctttattggctataa

SEQ ID NO: 15440 - DNA, 849 bp, Glycine max
  Peptide Sequence Number=SeqID_107125
atggtttcaagagcagcaatagtgttactcataggtcttgtgggaatgttttaccagggcactcaactcccccctccaaacaacagtgattcatcagatgatggtgttccagtttcaccaccaagagtcagactcagagatgggaggtacttggcttatagagaaaagggtgtccccaaggaccaagcaaaacacagcatcatcattgtacatggctttggaagctccaaagatatgaattttctggcaccccaaaaaccattagacattgaagttctgattagatacttggatacaaagaaggaactaatagatgaattgggtatatatattctgcaatatgatcgagctgggtatggagagagtgatccaaaccccaaacgctcactgaaaagtgaagcacttgacattgaagagcttgctgatctgttacagatagggctagcaggtgtggctatgatagctccagtgataaattatctatggccttccttccctgagagtctgataaaagaggactataggaggaaacttatcaagtggtccatgtggggtgactggatggtggcctttggcaactgggaatttgaccctctgaagctaagtaatccattccctgataatagaagttcagctcacatttggcagggctatgaagataaggtagtgccctctcaaatccaaaggtttgttacacagaagctgccttggatacaatatcatgaagttccagatggtggccatttgattgtgcactatagtggcttatgtgaggccattctgaaggcacttttacttggagaggaaaatctttcatatagacctagaccagaagtatttgtatcttga

SEQ ID NO: 15441 - DNA, 96 bp, Glycine max
  Peptide Sequence Number=SeqID_107126
atgtcgttgttgttgttggaggttgctgtgattaacggcgtcgacgatcctccgtgcatgccctcgactggttgggcatataggatgcgatattaa

SEQ ID NO: 15442 - DNA, 1227 bp, Glycine max
  Peptide Sequence Number=SeqID_107127
atggccataatgatcagatcagtaatgacaggcttttccttcttcatatcaatgcttttgtttcttctcaccatttcagatttgtttgcgcgaatccatggccttggttttggaatcaactacggacagataggcaacaatttgcctcttccctctcaagtggctgttcttataaaatctatgaatgtgagtaggatcaagctctatgatgctgatccagatgttctacaagccttctctcagtacaatgtggaattcattataggacttggaaatgagtacctagagaacatgacaaacccttataaagctcaaacttggattcagcagcatgttcaaccttacctttcacagactaaaatcacttgcatcactgtgggaaatgaggtgttcaatagcaatgatactcagcaaatgttgaaccttctcccagcaatgcaaactgtgcatgatgcccttgttaatcttggactagaccaacaagtaaccgtcacaaccgcgcattccttcaacatattatccaattcctaccctccttcgtccggagcttttagggaagatcttgtgcaatatatccaagcccttcttgactttcatgctcaaatcaactcaccttttcttatcaatgcataccctttctttgcatacaaagacaacccggatgaggtttccttaaactatgtgctttttcagccgaatgaaggcatggctgatccaaacaccaatttccattatgacaacatgttgtatgctcaaattgatgctgtctatgctgccatcaaacaaatggggcatgatgatgttcaagtaaggatttctgagaccggttggccttctaatggtgatcctgaagaggttggagctacaccgcagaacgccgcattgtataatggtaacttgatcaaaaggatagagcagaaacaaggcactcctgcaaaaccatcggttccaattgacatatatgtctttgcactttttaatgagaatttgaagcctggtccagcatcagagagaaactatggactttactatcctaatggttctccagtttataacattggattgaagggttatctcccagagatgcctttggcagctaaatccaatagtgtagcaccgcctccgctttcgtctttgccacaaccttcctacacaaccggaattgccacctcacctaatgacaacaaccgtctcatcaccgtcatcgataacaatgcgttgatgaag

SEQ ID NO: 15443 - DNA, 456 bp, Glycine max
  Peptide Sequence Number=SeqID_107128
atgcctgttgctgcgtttggttgcaagaaaattattgtggtttacaaccgcaattgtggctgcaatatcaaggttttggtggcttccacaaccacattgccgcatttatttgcaatatcaaggattgcaggtgatgtcggtagtgtttactttggggcgaagcatccgatgaagccccaccggctttgcatgactcatcatcttgttctctcatacgatcttcataagaagatggagatttatcgtccacacaaggcttatcctgttgagcttgcccagtttcattcagctgattatgttgagtttttgaacaggattacacctgacactcagcacttgttcttgaatgaactgacaaaatggataagggaagatcttaaaattcaaaatatgatacaacctagatacattgacatgaatttaaaagaaaaaatattttacataaatgcacaataa

SEQ ID NO: 15444 - DNA, 669 bp, Glycine max
  Peptide Sequence Number=SeqID_107129
atgcgtgctgctgcaaaagttcttgtgaaaaaatttgaggatgaaggattacctacggtgaaggttgctattgttctcaacaatggtgactcatctttctctaatagagatagttggaatcatataaaaaatcttcgaaggaagaatctagatgttggagtcattgaagctgttttcaattattatttgacctcaaagattgctaaatgtggctgccaactgtatgagtttataggaatattgtgcaaacacatactaatgatttttaaagcaaaaggaattgttgaaattcctaatcattttgttttgcagcgctggactaaagacgctaacaaaggtcttgaagccggttatactgaagataaatttgttggtgcctccataacacctaggattttaagaatgatgcttgcacaacaacaagcaaacatattagttgatcatgctgaagattcagaagatatgtataagttcattattttacaatttgccaagactcataagttaacaattataatgcaaacaaattttaatgatgctgacaacatgcctcttttggaatcagatcgcacaaatgggaaccaacattgcacattggagcaaatgagcaaagcaccacatttgattcttggagacccagcatatcacaaaggggagaaaaaaggatga

SEQ ID NO: 15445 - DNA, 1595 bp, Glycine max
  Peptide Sequence Number=SeqID_107130
atgactgaagaccaggataatggagaactgaagattgcagctccagcagaggggaacacactcactaatgttggttggattgtaactgcagttggggggaggggggcatgctggagattgcagccacaggtgaaggcggtttatgtgaagaacctgccaaagaatgtaactcaagagcagttgaagaagctttttgaacgccatggaaagatcacaaaggtggttcttccaccagcaaagtctggtcaggaaaagaacagaattggctttgtacattttgcagagaggtcaaatgctatgaaagcacttaaaaacactgaaagatatgaattagaaggtcaacttttagaatgctctctggcaaagccacaggctgatcaaaagtctggaggatcaaacacacagaagccaggaccaggattgcttcctagctatccaccacatgttggctatggtttggttgggggtgcctatggtgcacttggtgcaggatatgctgctccaggtcttgcacagcccttgttatatggaggaggtcaaactcccgctggaatggccatgatgcctatgcttttggctgatggacggattggatatgtcttgcaacaaccaggaatgcagccacaagccccaccctcacatcatagaggtggcaggggcggtggtggcagtgggagtggcaacaggaatgccggaagttcaaccttaccacgtcctcagcttcctctcaccccccaaaccttctccttcttccttctcacgttttcctcctcctccccaacccaaccagcgaacccaacccttcgcttcccttctctcattctttgtgaatccaatccttcccttctccacttctttgcgccttgcaacacaaaggcaaaggcagaggcatgtctagctgacaagatcattggacctccatttggaggaggtctgattgatttatcattgattcgatcttacagagaccactctgttggtcatgtatggatccaacaggttatcagccctagttacgacacggtaccctggcgtaaacaagggtttcatgagtgcccttgtggagaggtggcactaagagacatcatccttacacctgccatgaagcttctgctaatgactcgccttggcatttctacagaggaggaggctagagcaatgactaccacatgttctagggttaggttgacgtggctgacagctgtatcaccggagtcactacaatggcatacctatatgaccatctctcctatgcgagctagtacaccaacaagtaggttggagtcatgggcgtttgcgcatctgcccaatgttggctatttcgagcctaagatcgatgatctgaatgacttgattgccaacaaatggaagccaacacaagtaggtcttttctcttacttcatcaaatgcgagatagatgtgtggtcttatctttcagagagggcttatgatacgacatggttgaagtggcaacatgtcattcctttaggtgatgttgtaccacctagggggcttcaaagttgggtgcaacttagagaggcaaaggaagaggacggccaaggccaaggacaaggatggtggcaagggcaacaagg

SEQ ID NO: 15446 - DNA, 184 bp, Glycine max
  Peptide Sequence Number=SeqID_107131
ggataatggaaggtttgtccttaaggaagtaaggacacccattcaggagtttctgcatgctcacagggaagatgggaggttgaagcttcactttgtgcagccagaggatgaagaaaaagaagaagatggtgacgacgaggattatgatgaggtagaaagtgtagtggaagaagaacatgtgtga

SEQ ID NO: 15447 - DNA, 507 bp, Glycine max
  Peptide Sequence Number=SeqID_107132
atggtgaatggtacacttgttattttatacgactctacatacatctatgctgctctggtgaaccatatcaggaatctgttcaccagggattggaacttcagtatccaacacatttacaaagagggtaattgttgtgcggatttgctaactagaaaaggttcttcatctgataagttagttattgtggatcagtgcccgccattcctcattctggctttactgtcagatgcatgctgcactctccatctcggaggtgttttcctgatcaatgacgtcgaggaacacggaatcaacggtaacatggctgtccacgtggaccataaagttatggttcaaccacatgagcctggcggtgccggcgatgccaacggctggaataatgggtccttgggtttcgcggatattggggctgatgctgctccgattaatgctcatctccattttgacttcttgttctccatcgcgattcactcaaccagctgtgtctcatcaacggagaaaggatga

SEQ ID NO: 15448 - DNA, 1319 bp, Glycine max
  Peptide Sequence Number=SeqID_107133
acaatggaaatcttccggaagaagctttttccgggaacaatccggatgacgttcttccggaagttgtctgtgagtacttccggaagacacaaattattcttccggaagaagctggttttcctattttgcgttacgcgttcgatatcgagtccatgagacgaattcagcttccggagccgccgagccccaccggccggagtggcactccggacatcttcgaatccggagttcacacgtttgtgcggcgcgccgtcgtaatcggcaacggtttcgccgcatcggagaatcagagcgtcggattggtccgcgcccttggcctctccgataagcaccttatgttgaaatctcaggaaaagaagcttatgccttcaccttcagaaaatggtgtcagtgcaggcttgttagctgtcttagaagctgatgtaaaggagatagttagttttgctcatgaaacttatgagaaggagggaccgttgttggttgtcgcatgtggaagagataccatttctactgcaagttccataaaacgtttagcatctgagaatgtttttgttgttcagatacaacatccaagattgcatttgaaaggatttgacatggtgattacacctaagcatgattattatcctttaactccagaaggacaggaacaggttcctcggtttcttcaaagttggataactccacgtgatcctccagattgtcatgtggtcctcaccatgggggcgctacatcaaatagatttcagttcaatacgtagtgttgctgcttcttggcatgatgagtttgcacatgttcccaggcccttgcttgtggtcaacatcggaggaccaacgagaaactgtcgatatggtgtagaccttgccaaggagttagcagcttctttgctcaatgttcttgctagttgtgggagtgttaggatatccttttcggtgaggactccacagaaggtgtccaatattatagtgaaagaacttgggagtaatccaaaagtttatatttgggatgggcaaggacctaacctgcacatgggccatttagcttgggccgatgcatttgttgtcacagccgattcagttagcatgataagtgaggcatgcagcactgggaagcctgtttatgttctgggagctgagcgttgcagatggaagttcactgagttccacaaatcattgagagagcagggagttgttcggccttttacaggttctgaggatatatcagaaagttggagttatccaccccttacggatactgctgatgctgctaaaaaggttcatgaagcacttgctgcccgagggtggaaactgaaggtatag

SEQ ID NO: 15449 - DNA, 105 bp, Glycine max
  Peptide Sequence Number=SeqID_107134
tgtgaactacgagttgccatacctcattgatgtttttggctccatggattatcaagggattaatgtagaccccactttatcttataggctcctatgtggcacaac

SEQ ID NO: 15450 - DNA, 446 bp, Glycine max
  Peptide Sequence Number=SeqID_107135
ggtttgtgaaatcgccagtgagtgctaggaatcccttgaggaaagctgtggcaatgggaaatgggagggttacatgcttcgagaggaattggctgcgggcagattacagtgtcattgggtttggattgattggttggctagcaccctcaagcgtaccggctatcaacgagaaagaggaagaagatgatgatgagaggcatgaaaagaaaaatgaaattgaaatgagcgacttggatgagttggaccttgcccaaagagaaaacctagctagtgtgtgtttggattgctgtttagagtttgttatacggataatcacactttccaacgttaaaaacagcaaagaaagtcttttttatctcgttgagatgaaagttacgttcaacaaaactgatatacaaacataccttaagcttaatatgtttggatacggattatatccaagttga

SEQ ID NO: 15451 - DNA, 192 bp, Glycine max
  Peptide Sequence Number=SeqID_107136
atggcacccatgaaaccaaaaagaaaaaggagaagaaaagctagaaggaaatcaaagaaagcggaagaagtctttaatagaggccctttaagatcaatggaggcaagaggttggcaaagcttctcgacttcgtcaatgagggagaggatgtcaaaatctcattacagggttgccaacgaagttggggcttag

SEQ ID NO: 15452 - DNA, 1362 bp, Glycine max
  Peptide Sequence Number=SeqID_107137
atggccatgacaagttcaagagaaactatagcatcagttaataggcgaggtggtggaggtcatggaggtggtcacgcaagcagcatgggaatgcatggtggtgagaatggtgaacacggcaatttgccacgcccacttggcacaaaccctgtatatgcaggtgctgctgcaggatctgctcaccagagaaacaataatcaccaccatgtggacgcgcctgacaagctaccactagtggttgcgcctgggaccccaccactactggtagcgcctggtaggccactactagtggtcgcgcttggcagaccaccactttcacccctgtcccatcgtcctgtcaagtcacgtcacgtgtcgcgttcgggtgaaacgcacccctcagcacttccaagtcgaaagtcagcatcatatataccttacttctccatccgaaaactcagacatggcaagtgtctcactggtctcagctactggaagaaggggaaagtggctattatcactggtggtgcaagcggcataggtgaggccactgcaagactcttctctaagcacggagcacacgttgtcatagctgatattcaagacgatttgggtctctctatttgcaaacacttggaatccgcttcctatgttcactgcgacgtgacaaacgaaaccgacgttgaaaactgcgtgaacaccaccgtttccaaacacggcaaactagatatcatgttcaacaacgctggcataaccggtgtgaacaaaaccagcatcctcgacaacacaaagtcagagtttgaggaagtgatcaacgttaacctagttggtgtctttctgggaacaaagcacgccgcaagggtaatgatccctgctagaagaggaagcatagttaacactgcaagtgtttgtggaagcataggtggtgtagcatcacatgcatacacaagttccaaacacgccgtggtggggctcacaaagaacactgcggtggagcttggagcatttggtgttagggttaattgcgtgtcaccctacgtggttgccacgcccttggctaagaatttttttaagcttgatgatgacggagttcaggggatttattcaaaccttaagggtactgatcttgtgcctaatgatgtagccgaagctgctttgtacctggcaagtgatgagtccaagtatgttagtgggcacaatcttgtggttgatggaggcttcactgtggtcaatatggatgacttaaaggccaacaccgagtataccggttatacagtggcatcaaatgttgttcaatggttctgggaggtggtcaaagctttcaacaaggaagacatggcaagattactgcaatttgtgactggaacgtcaaaggtgatgtag

SEQ ID NO: 15453 - DNA, 228 bp, Glycine max
  Peptide Sequence Number=SeqID_107138
atggcggtgatagtctccggcggcgacgaagggaggcttcatggaggagaaggggagttggcgtttcatggagtgcatgatctggtccggcgggttagcggcggggggagcgcgcgaggccgacatccccgggcggcgatcggcggcggaggggttagggggcgggaattagggggaatcggaagagggaatgagagagatctgagcgtttggcgagtgagaaaatga

SEQ ID NO: 15454 - DNA, 6454 bp, Glycine max
  Peptide Sequence Number=SeqID_107139
cgtcactcctaaaaccttcgatctggttgcgacaatgagcggcgatggccggagacgtgaccggagagacaacagagcatccaagaagcggaagctgaaccgcactcccgaggaagagctcgaggcgaaattagggttcgatctcttctcagaaggtgaaaagcgtctaggatggttactcacttttgcatcctcttctgttgacgatgaagacagttacaaagtgtacagttgcgttgatctttactttgttgcacaggatggctcttcattcaagacaaaattcagatttcggccctatttctatgtagctacaaaggataaaatggagattgatgttgaagcatacctgaaaagacgttatgaaggtcagattgcagatgttgaaattatagaaaaagaagacctggatcttctttcatttgatactgtgcaacaattgatggatgtgaagagagacctgatgcctactgttgaaagaaataaggccaagtctgatgctgcagaagcttttttgtccgtgtcaacagaaagaagagaacatagacctcaagattttctagattgcataaccgatgttcgtgaatatgatgttccttatcatgttcgctttgctattgacaacgttatcctattttctgatgctgtgctattgtctatatttatcatgacacttgcaatcacacgtgaactagatatacggtgtggccagtggtatgatgttggagtgtccagtaataatggggttacacttgagaagaagacagatcttctgcagcgtgctgaagttcgtatttgcgcatttgacattgagaccacaaaacttccattaaaatttcctgatgctgattatgatttaattatgatgatttcatacatggtagatggtcaagggtatttaatcataaatagagagtgtgttggggatgatatagaggatatagagtacactccaaaaccagagtttgaagggtgttttaaggtgacaaatgctcaaaatgagattgagcttcttagattatggttttctcatatgcaagaggtgaaacctggtatctatgtgacgtataacggtgatttctttgattggccattcctggaacgaagggcaacccatcatgggttcaaaatgagtgatgaattggggttcaaatgcgatatgaatcaaggggaatgtcgtgctagatatgcttgccatttagattgttttgcttgggttaaacgtgatagttatctccctcaggggagccaaggcctgaaggcagttacaaaagcaaagttgggatatgatccattggaggtgaatcctgaggacatggttcgctttgcaaaggaaaagccacagatgatggcctcctattctgtttctgatgcagtggcaacttattacttatatacaacttatgttcatccctttattttctctcttgcaaccattatacccatgtcaccagatgaggttttgcgcaaaggtagtggaaccctgtgtgaaatgttgcttatggtgcaggcatacaaggctaatgttatatgtcctaacaaacatcaatctgacccagagaagttttataataatcatcttcttgagagtgagacgtacattggtggtcatgtggaatgtcttgaaagtggtgtattcagatctgatattccatctagttttacacttgagccatctgcctatcagcaacttatcaacaaccttgatcgagatctacagtatgccataacagtggagggtaagatggatttggaatttgtttctaattatgatgaagtaaagaatgcaatcatggaaaagccaccgtcaattgttacggaggaagtttgcactgcatgtgattttaatcgtcccggaaagacttgcctacgcaaacttgagtgggtttggcgtggagaaacattcatggctaagaaaagtgactattatgctttaaagacacaaattgaatcagagtttgttgatgattctgagaagaacaacaaagccttgacccactattctgagaagtcatcaaaatcttttcttgaccttcccaaggcagagcaacaatcaagactgaaagagcgtttaaagaaatactgccagaaggcatataagcgggtacttgacaaacctgttactgaacttcgagaagcaggaatctgcatgcgtgaaaatccattttatgttgatactgttcgcagttttgtgctatctggttcaagtttccgggatagaagatatgaatataaaggtctcaataaggtttggaagggaaagttgtcagaggccaaggctagtggaaattctatgaagatccaggaagcacaggatatggttgtgctttatgattcattgcaacttgctcacaagtgtatacttaattccttttatggatacgtcatgcgcaagggtgcaagatggtactccatggaaatggctggagtagtgacatatactggtgcaaaaatcattcagaatgcccgcttactagtagagaaaataggaaaaccacttgaactagacactgatgacccaaagaagaagtttacaatctcatacccatgtgttatgcttaatgttgatgtggcaataaataacacaaatgatcaataccagacactcacagatccaatcaggaaaacttatacaactcacagtgaatgctctattgaatttgaggtggatggaccatacaaggcaatgatccttcccgcttccaaggaagaaggaattttaattaagaagcgatatgctgtttttaatgatgatggaaccctcgcagagcttaaaggttttgagatcaagcgcagaggtgaactgaagctaataaaagttttccaggctgaactttttgacaagtttctccatggttcaactttagaggaatgctattcagctgttgcttcagtggcaaatggctggcttgatcttcttgatggaaaggatattgcagacagtgagttgcttgattatatatcagaatcaagtaccatgagcaaatctttagctgattatggtcagcaaaaatcttgtgctgttaccactgctagacgtctggctgactttcttggcgatacaatggtcaaagataaaggtcttcgatgtcagtacatagtagcaagtgaacccaagggcacaccagtaagtgagcgtgctgttcctgtagcaatatttgaaactgatgctgaggtaatgaagttctatgtccgaaaatggtgcaaggtctcatcagatgttggcattcgatccatagttgactggtcctattacaagcagcggcttagttctgcaattcaaaaaattatcactattcctgctgcaatgcaaaaggttgcaaatcccgtccctagggtggttcatcctgattggttgcataagaaggtccgtgagaaggaggacaagtttcgccaacggaaattagttgatgcctttaaatcaatgaataggaatgaacactcaaaaaggcatgatgactcaactcgtgtccctcttgtcatggatggtgatattgttaatgagttggaggactttggaaataaggacaggagttctacatgcagacctagaccaattatacggcattatgaagctaacaatgaacaacattcaaggaaggtcaatgatcaagaagatgtggagcagcagcataataaaccattacaacaaaatgtttacagaagtgtagattatcaaggatggcttcaaataaagaagcgaacgtggaaggatattctggaaaggagaaagaagcaaagattggagaattcaaagaaatctgaccgtgttagtagtgttcttgaacaaatgaatggtaaggggaatcagggcagaagtcatgtcagttcatatcttaaaaggcttgaggtagacttaacaaagcgtcactggcagataatacaactagtccccagttcactgataggccaattttttgcttgggttgttgttgatgggagtatgcataagattcatgtttctgttcctagagtcttttacctcaattcaagatcagcaattactgaaggatttatgggtaaacgtgttaacaagactcttcctcatggaaggcatagttataacttgtatgaggtctcaattaatgaaattcaatatggggaagcaagccaaaaacttgcagctcttctagcagatcctgatgttgagggacgggctatatacattggatattttcctgcatcaaaaacaatgactgttgtggtggttaatccctatcaaaacaaagatttatccccggtttttcttgaaagacattttcatgatgcttgccagtctttgtctattgagccacctccgaggaatggcattaattttaaggtggactatgttgcacatgtcaaggatgctgaagcagtgatgcaaagagcaataaatggccacagggaaaatcacatgcctatggttgctgtcattgaatgcccaaatgttcaattagtaaaattgggcatccgagctctggataattttccatgcctgagtgttccttataatgcacgtgatagtcagtaccagattcttggatggcaacaagttgctgctaaaactggaatgcaacgttgtgctgcatcagtccaatggctaaatcaaagaattgctctctcaagatatgcccatgtaccgctggggaactttgaacttgactggcttatatttattgcggatatcttcttttcaagagcattgcatgataatcaacaggtactttggatatctgatgatggccttccagatttaggtggaattaacagtgaacagaactgttttgtcgacgaggtccaacaacctgctcttacatatcctggagcttatagaaacgtaactgtggagctaaagatacaccacctggctgtaaatgctcttctcaaatacaacctagttaatgaaatggaaggaggcactctattaagatttggtcatgaacttgattctggagcattttccacaaatgatcaaaatggttttgacgagtctacctcatgtgtacaagcctttcgagtccttaaacagttgatccagcggtgcctagctgatgcagttacatccggaaatgtttatgctgattcaattttgcaacatctgtatagatggctttgcagccctaaatcaaaacttcatgatcctgctctccaccagttactccacaaggtcatgcagaaggtctttgcattgttgttggcagagttccgcaagttaggtgctacaattgtatttgcaaacttttcaaagattattatagacactgggaaatatgatctgtctagagccaaagcttactgtgacagtttgttaagaactatacaatcaagagatctatttgaatggattgagcttgaaccactgcagttctggtgctcgttgctattcatggatcaggtgagttcaatagagaatttagttgtgaagaaacaattgttgatcgattcagttggggatctcggtgatgaagatggtgaagcacccaaacgtcgtggcactgcacaaagtcatggccagcaagtccaaaatctacatcaccatggaactcgtccatggtggggagcttttcaacaaggtctccaagggacggttaaaggacactggccagactctacttccagcagtttatctctgccgtggacttctggcacagctctgctgaaagttggcgggggaaaactcgtcgccatgggtggtgggggacgttgtggcgctggggaagagggttggtgtgccacattttctatttggtttgggattagggttgggtataactatggtggaataccaacaaaatctgatgaagctgtaaataatgaatctcaagtagacattatatcaagctggaatattgctgaatacttgccgaaaaaaatccaaaatggtgactcctgtacaccatcaattaacattggagccgcagaggcttttgaatcagaaataacggaatttaccaaagagcagatcggctcgtacttcacacacaaactgctaggaattgttcacgatattggtcttcatatgaagggtatgaacagattagaaaacaaccagagtacatcgggccttcctccacttacgggtgatgtccatagaggggatgcttccttggaatttatcaagcatgtttgtgctgtcctggcccttgaccaaagtgtgcagcatgaagttttggtcttgagaaaaaatttgctcaaatatgttgatgttaaggagtttgctcctgaagctaagtttcatggtccttgtcattccttcatcttatccaatgtcatatgcagctattgtaatgactgcagagacttggatttgtgccgtgattcggctttgttaactgaggagtggcgttgtgcggttccacagtgtgcccagccttatgaccgtgaggtgatggagaatgctcttcttcaaactgctcatttaggtgcaaggaagatgcaagtgaatttcgtgaaaaaatgcaaattttcttga

SEQ ID NO: 15455 - DNA, 120 bp, Glycine max
  Peptide Sequence Number=SeqID_107140
atggagaccaacaccaatgttagtctgcggaaaaaggagttgccacagcaccttgttgtcgggttttggctcggtgctgttgtgaatgaaggtgaagctgttgttgtgatcatgaaatag

SEQ ID NO: 15456 - DNA, 1464 bp, Glycine max
  Peptide Sequence Number=SeqID_107141
atggcggagaagaaagtggtcatcctaggaggtggtgttgccggagccaaccttgcaaaaactatacaacatcaagccaacgtcacccttattgatccagttgttgaacacaggaaagaatattttgagattccatgggcaagtttgaggggattggttgagccaacttttgctgaaaggatagtgatcaaccatagagagtacttcaaaaagggtgaccttgttgtatccagtgctgtcaacataactgaaaccgcagtggtgactgcagatggccagcagatagcctatgactatcttgttattgccactggacacacagaacctatccccaaaaccaggagagaaagacttgaccaatacaaaggaggtccaactggtgttgagcttgcagcagagattgctgttgattttcctgataagaaggtcaccatagtgcataaaggaacaaggttgcttgaatacattgggacaaaagcttcaagtaaggctttaaagtggctcaaatcaaagaaagttgatgtgaaactagagcaatcagtagacttgagctcctcctcggaagcaagtaagacatatcaaacttcaaatggagagactatagaagcagatcttcattttctatgcatagggaaaccacttggctcaacatggattagggaaactcttctaaacaatgacttggatgctgatggaaggatcaaggtcgataaacacttgagagtgaagggcaagagcaatatttttgcaattggagatattacagatgttcaagaaatcaaacaagggatgtatgcaagtgctcatgctcaagtggttgctaagaacctgaagctattgatagagggaggaggcaaagagcataagttgggaacatacaaggcacaaccaccaatatctatggtttcactaggaaggaaaatagcggttgcacagttcccattcatgactgtgcttggaaggcttcctggcatgatcaagtcaggagatttgtttgtagggaaaaccagaaaggaattaggagtcgaacctaatgctcgggtttatggatcttctcttcacttatatggtgttcaactttttcacttctacttgatgtggggcttcacctcacacttgtactccaacaatctcccccttaagtacttgtggtacttgcaccgctgctccatccatgggacacgccgcctggacccaccgctaggaagactttcgatacaagggatccccaaggttaaggatccatcgccgccatcttactcgtctgagctgttcaccaagtcaaaccatctgatggcactggtagctcattatgatttagagctacatcagatggttcgacttggtaaccggctcagacgagcagcgtgtcctgtggatggagtggcggtgcaagttaccaaaagaagagaaggtcaagcaattggtgtctcactaagcgatgcatatgcgcttagcgagtga

SEQ ID NO: 15457 - DNA, 380 bp, Glycine max
  Peptide Sequence Number=SeqID_107142
atggctaattcttcggatgagaggtgcttcaacatggctttggtggccggaaatgaagcaactgagaagaaagggtggagtaaggcccattgtacaattggccagtcgctcaaactcggtgagcatcatcggccacgaattaagaaagccattgcgggacatccattggtaccaggaaagcgcaataccttccatatagaaggagacgacaatgaggcgttcattatccggtatgccttgtgccacaagacgctccaaaatggagtcgatcttagtgttcatggtgaactgagcttgcgagagggaagcatggttctgagtaaggcgatggacagccccctcaagacattccgtggtaaactgcatggtattgtgctcag

SEQ ID NO: 15458 - DNA, 2787 bp, Glycine max
  Peptide Sequence Number=SeqID_107143
atgatgctgttgttaatctgggaagattactactacgaacccttgccctctcctttccctccacgaactgttgggaggtctaattttccttaccaagatggggaaggatgttggttttcttctgagtctcagctagggattcaggaggaggacagagtccgtgtattgatcaacaaaatgatggtgaataattcagtcagtattgctggagaagggatagttggacgggcagcatttacaggaaactatcagtggattcttttgaacaatttcactagagatgcttatccaccagaggtatatcctgagttgcattaccaattttcagctggaatgcagacggtggcagttattcctgtgcttccccatggggttgttcaactaggttctttctcgccgataatggaagatataggatttgtgaatgatgtaaagaactttatcttgcaattgggatgtgtacctggtgcccttctatctgaagactattcagcaaaagtttctaatgaaaaattcgctggacctgtgaccgttgatccacctgtcattacttcaaactgcactccctcggtagctaatggttccaaccaacttactaattctcctcttgcttcaaggcctgttgctcagccacctcatcctctaaggggaggaataaataattaccagggttctttattgacacctcaagcctataacccgaaccaggtatttgatggcatttgccaaccaaaggctcattcaatgatcaaaacaaatgtctgtggccaaccaaagaagaccattgttgaggctgaagctaaggtgatacctacaaattttgattcatgtctgcaacaacattctgtttataatgctagatctgcattcaatgagttatctagtttcaatcaatcaaatctgagtgacggcagccttaaatatatggaacaacaaacatcaggtgttgggagacagagtcaagttattcctaacgtgaatccatcaagtgccttaaatatgcctcggctgaaaatcgatggaggtaaaattcttgaacagaatcagagttctagtgacagttcactactcggaggaatcccaatatgtagtgggagtaatcttttgaggacaaatatgattaactgctcactttcaaatcctcccaaagtatccactaacacttctgatttttctggaatgtacaaggttgggtttggactccaaagtaacaatacaacaactaatgctgtgctttgttctgtgcctaatttcactaatcaatcagttagcaatcacatgaatctagaaggctctggtcagaaaagtctttccattgatttaaagcaagtgtgggatgcctttgcgtcaactgatcaaaggatagatgatgatttgcttcaggccgcccttaagattccatctcttcatctggaggagcatgtgcctatgggtgatcacatctctggttttgttcaagattgcctcagtaaagatcttactagtcaacatatgatgaaaatgaatgttaagcatgcagaagccgatgctcaacttccatcaggtgatgacctcttcgatgttttgggcgtggatttgaaaaggagactactcaatggaaaccggaatgagttgcttgccactgattcagatgccatcacagaacatctagataaaaaggcaacacacatgaatttgcaaggtgtaggtcctaataatagttattcagttaatgaagctatatcagaaagtggcatcttctctggaacggacacagaccaccttttagatgctgtggttttaaaagctcaatctgctgcaaaacagaattctgatgaaatgtcatgcaggacaacattgacaaggattagtaccgcctcaattccttctcctgtctgcaagcaagttatgcctgatcatgttgccccgaggggattgtttgattttcctaagaccggagttaaaacagcttctgcagaaacaagttctcttaggtctgggtgtagcaaggatgatgctggaaactgctctcaaactacttccatatatgggtctaagcttagttcatgggttgagaatagtagtaattttaaacgtgaaagcagtgtttcaactggatactccaagcgaccagatgaagtttgcaaatcaaatcgtaaaagacttaaaccaggagagaaccctaggcctaggcctaaagatcgccaaatgattcaagatcgtgtgaaagagttgcgggaaattgtgccaaatggagcaaaatgtagcatagatgcacttctggaaaagaccatcaagcatatgcttttcctgcaaagtgtaacaaagcatgctgacaagctgaaacagacaggggaatctaagattgtcagtaaagaaggtggattgctattaaaagataactttgagggaggggctacatgggcatatgaggttggtgcacaatcaatggtttgtccaatcattgttgaggatctcaatcctcctcgtcagatgctagtagagatgctttgtgaggaatgcggtttctttctggaaatagctgacttaatcagaggattaggtttaaccatcttgaagggagtcatggaagctcgcaatgacaagatctgggcacgctttgctgttgaggcaaacagggatgtaaccaggatggaaatatttatgtcactggttcgtcttttggatcaaacgatgaagggtggtgcatcttcgtcgaatgcaattgataacaacatgatgctgtatcattctttcccacaagctacccagataccagcaactggcaggcctagtagtttgcaatga

SEQ ID NO: 15459 - DNA, 165 bp, Glycine max
  Peptide Sequence Number=SeqID_107144
atgaagagtcttctggaacaacattatggagagattgagtcacgtttctgggatgagttcgagccagaacttcgtaggaggtggtcattgtatgatgctaaaggaagtagacatagagtgattgtaaacctgattagagaacaaccttttatgacacaaggttga

SEQ ID NO: 15460 - DNA, 174 bp, Glycine max
  Peptide Sequence Number=SeqID_107145
atgtcgactctcacaggagttacaaagggcaccatttcagtggaggaaagtgataatggccatgttgcaagagagatagcggtgcaacacaagttttgtggtgacgagggagaaatggtgcattggaaattgctttccatggcggtacacaatggttggagggaaggagaatga

SEQ ID NO: 15461 - DNA, 282 bp, Glycine max
  Peptide Sequence Number=SeqID_107146
atgaagtcaaataaggatttggctttgaagcaacaggtggagttatacgtgaagagggttcaagatcctgaccatggattacagaaggttgcactcgagagcatgagaggtgccatggttgaaaagatagaacacatgaaactagaagcagagtctaaggataagaaaagtcttgaagaaattgagccgtcattatttgatcttgaggaaaagcacacacaagcaaatgcaacaattaaggaaaatgaatttataatatcgaatctacttaaatctggttag

SEQ ID NO: 15462 - DNA, 108 bp, Glycine max
  Peptide Sequence Number=SeqID_107147
atgacattaaagccactgtggcatgacagcatatcagttgatactagacacgtatccagtaattttatgaagggtggaaagaagaataagaaagcagaagccacctaa

SEQ ID NO: 15463 - DNA, 534 bp, Glycine max
  Peptide Sequence Number=SeqID_107148
atggacgttgattcctcgatggtgccggagcccgatcacgatccgccggtgcagaaccatgccgagagagaccagctaggagagtcaccgtcgccgccgccgtcggagggaggcggatctccggcgcaaccgcaccaacagccgctgcctccgacggcggctcaggtgcaacagcccaatccgctggttggtccgaggctcgcgccgacttactcagtggtgaatgcgattttggagaagaaggaggacgggccggggccgcggtgcggccacacgttgacggcggtggcggcggttggagaggaggggacgccggggtacattggcccgaggctgattttgttcggcggtgccactgcgcttgaagggaattccgcggtctcagggactccttcatctgctggaaatgctggcatactctttggtcatggaaactctggttctctaaaaccttgtttcgttggatacttcgtccttggaacacaatgcgaccaaacgagttgtgaaatttttaccaatcttgctgttttgtaa

SEQ ID NO: 15464 - DNA, 561 bp, Glycine max
  Peptide Sequence Number=SeqID_107149
atggcactcaaaagggcatcgtggttgctgctgctgccactgttatctgcagttgctgctgctgccaccaacaccaacagtgtgtaccatccttgttctgatgccaggattcagagatctgatggcttcacttttggcattgccttcagttccagggactctttcttctacaaccagaaccagtccctccagctctctccctgtgaccgacgcctctctctctcttcctccaacgctcagcttgctctcttccgtcccagagttgatgagatctctctcctcaccatcaacacctctagtttcttccctgataactacggtggatatatggtggcatttgcgggaaagaaatatgctgcacgttctccacttgcgtttgtcgcaaacagcacatacaccgtgacaagttttacactgagtttcagaggggtaggctgcataacttgtactggaagagagacggctgttcttcatgcaaggggaaatcgaacttggtatgcctcaacaaacaagattgtgcaatccgaacatcatcttgcaaaggcagaggaggtgcagtag

SEQ ID NO: 15465 - DNA, 834 bp, Glycine max
  Peptide Sequence Number=SeqID_107150
atgacaagtatggagatttttgtttctaaattagaagtgagttttcaaactcctaaacttaggggagccatttcatgttctagtgtaggtcagggggttgatgcttcaaagtcctattttcaagggccgagccggaacaacagtgattccagatctcaggctcatggagaagatatggatgttgggtatgaaggaaatcatttatcacaatcttttgaaggtcttgagcagaattttcatgatgacattattaaactcaccaaagaacagaatgacgctgaagatgcagaatatgccagacacagagagaaaggtgccaaaaggaagaaatgcatttatgctcaattctgtagtcttgtttcctctgtaagagtaaagcttgcttctcttcgtaagaattgggtttcactttggcacaagaccttatgggatttgttcaacagcttgtttgtttttgaagatgttaaagatacttttgaagcggtaaaactttttatagctgttacaaaaataaatgcaatcaatgctcagtatgaggaaaaactggcagcactccgagctcagcatagcagccgcagagctgaatttcttcaaagggaatcacatgctaggcaacagcagtaccagcaaatcataagggatccttaccccagtggtggcatggcacccggagaccctcatggtgaagtgcaacgaggctattctgccgatcaccttgatccttaccgagagagagctcgatttcttgggggtggtagagatcaaggatttgaacctagaggtccatatcctggtggccgtgtctatgacactggttcacgctattacaattga

SEQ ID NO: 15466 - DNA, 99 bp, Glycine max
  Peptide Sequence Number=SeqID_107151
atgtggtatttatggtgccaattctgcagaatggattatgagcatgcagaatggaaaaggctgagattatattcgttcagcagcctcgggagaatttga

SEQ ID NO: 15467 - DNA, 356 bp, Glycine max
  Peptide Sequence Number=SeqID_107152
atgagatatgtggctgtgcagttgtatgcagctcataatagtgatgcaggaaggatgggatattttttggtgcaagtagtattgtttcggaggaagccatatgtgattatttctgtggtggcattagaaaaagctgggacttcagagattttagccatcctacccggatatcctgacaatgtgagagtcaatgaagaaggtgatttttgggtagctcttcattgtagaagatatatgtttgcatactacaatggtatctacccagagataaggaaaatcatactcaagcttcctataccgataaagattcaatacctgatccaaataggaggtcaccaacatgcagcagttatcag

SEQ ID NO: 15468 - DNA, 903 bp, Glycine max
  Peptide Sequence Number=SeqID_107153
atgcgttcttcacgcccaagcttcaatgtacctgtaatcgacgacgcctctgttttgtggaaagatgtcgtttttgcccctgcccatgatcttcagcttcggctctataagccagccgactcaaccggctccaagcttcctgttttcttctactttcacggtggcggcttttgcatcggctcgcgcacttggcctaactgtcaaaactattgttttcagcttacttctcggcttcgagccgtagtcattgccccagattatcggcttgcccccgagaaccggctccccagtgcaattgaggatagcttattggctgttaagtggcttcaaactcaagccttgagcaatgagccggacccatggttgagctatgtggctgattttagccgggtcttcatttcgggtgactcggccggaggaaacatagctcaccacttggcggctcggcttgggtttgggtcgcctgagttgactccggttcgggtcaaaggttatgttctattggctcctttctttggtggaactatccgaactaagttagaagctgaaggcccaaaagatgcttttctcaatttagaacttattgataggttttggaggctttctgtacctgttggggaaactactgatcaccctgttgtgaatccgtttggcccttatagcgagagccttgaagcaattaatttcgacccaattttagtagttgctgggggaagtgatttgcttaaagacagggcagaggattatgcaaggaggcttaaggagtggggtaaagatatagagtatgtagaatttgaaggacaacaacatggtttcttcactattgatcccaactcggaaccatcaaacaagttgatgctgatcatcaaacaattcatagagaagcatttcgggaaagtttga

SEQ ID NO: 15469 - DNA, 168 bp, Glycine max
  Peptide Sequence Number=SeqID_107154
atggtgtggtttgcactttcgcatttggggcgttttgagagtgtgaacgacgacgctatggcggtcgaaaatcacagtggcaccgcatatggaggccgaaaatcacggcagcgtcgcatttggaggtcggaaatcgcggtggcaatgcttcacaggggaggttcctga

SEQ ID NO: 15470 - DNA, 579 bp, Glycine max
  Peptide Sequence Number=SeqID_107155
atggtgaaagcagtgatacaaggaaacatgtatcatagtcacaagtttggcaggcggcacctccaaatcggaccccttcttcctcttttctttccaacaattcccctgttcctcaatttcccaacacaacaccttctcctcaagtttcccaaaacacacataactaggaaactttccttaacctctgcaactttctccaattctattgaacaaaaacaaaagcatcccccttttccctctcatcattgggaatcgtctcaagcttcgtttttgacgtgctggggttgcttagatttcaattgggtatcgagaatgttcaacggtatgatggatcccgatttgatgaagatcgctcaggagcagatgagtcgcatgtcacccgctgagttggctcggatccaacaacaggcgtgtcttttctcttcctcttcttgcctctgcaattgtgtttgtgacttttgtcgcattttgttttgtgctttgaggtgcaatgtcaggatcaaggttttaaattgcggtcgcggtcgcagttttgtcgtgatccttgatattgcgggaaattgcagtcgcgatgagtaa

SEQ ID NO: 15471 - DNA, 258 bp, Glycine max
  Peptide Sequence Number=SeqID_107156
atggactcgggaaggttccaaattagtataccaggtgacggctgccccagtaatactttcctggaagaaatacatcaacaatttttcatctttcgcgtatgcccccatttttctgctgtacatcttcaggaggcaatctttccaatgcaaaatgctagagttgtggttgtgggcgatactgagggccctccaaagtgtttggtaggggtacatgtttcacctgtttacaactacgaaatttatcagcaagtgtactga

SEQ ID NO: 15472 - DNA, 619 bp, Glycine max
  Peptide Sequence Number=SeqID_107157
tgatgacaatgataatagtatcaatgatgaagacgatagagacattagtggtgatagtgatgccgatggtgtcgatgccaatattggtgataacagagatggtattggtgatagaagtggtgacaatgatggtggtgtcactgatgatggttgtgacaatattgatagtggtgacggaggtggtattgatagtgatgataatgactatgttggtgacgatgatagaggtgatggcattggtggtaacaaaaagtgcaattgtcaaatgggtgttcaccctaaacgggtcttaaggtcgcggtgggggagtgagcgacctatcgaacatggatgtgacaggcttgaaagggatgaggacccgatcgaggttggtgtcgcggttctgctagcggctgacgaaagaagaaaggagctcgttgccaccgctgctacagttgggcttggcgatgacgatggagaggtcgtcgtcggtgaggaggagtttggagggtgtctcacggtggtggtgtgcggtgtgctgtggtgggtgacaacattactagaggatgttggaggggagggtgaagggcgacatagagcaagtggagggttgacgtgtgatactagaggaggaagatag

SEQ ID NO: 15473 - DNA, 459 bp, Glycine max
  Peptide Sequence Number=SeqID_107158
atggcgcgcccagcgcgcgatctgaacgcgctaagcgctaggtgtggcgctgagcgcgactacgaaggcccgattgcatctggagacgtggtccttatcaacttggaaatcgaagccacttgtcggcgtaacaacgctgcaagaagaagaagggaacaggacaccgaaggaagcagtcacacatcacctcctctctctccacatcacgctgaaatggacggggaacaggcacgaagagtcaccttagaagacttctccaacaccgctactcctcagttcttcacaagtattgcaagaccggaggtgcaagcagcaaatatctcctacccgcattcccttatccagcttattcaagggaatctcttccatggtcttccaagcgaagatccatatgctcaccttgcctcatacattgaaatatgcaacactgtaaagatcgctggagtcccagaagatgcg

SEQ ID NO: 15474 - DNA, 231 bp, Glycine max
  Peptide Sequence Number=SeqID_107159
atgttggttaaggttttggaaaggtggggtacaaatggaagaacgagcattgtagttatgatggaaaatcttgatgttgggtggatgacaacgatggccattgcagcgaggtttgggaacggtagtagagatgtctgtagatggtggtggtggtggtgggtgcgggtggtgagtaagcggatgaaagcaacatttgttagagtgctaaaactactatacttctactcctag

SEQ ID NO: 15475 - DNA, 948 bp, Glycine max
  Peptide Sequence Number=SeqID_107160
atggttagaacacgaggtttaggtcatgctttagctagagttatagggcgaggtagacaggatgaacatattgcagttgatgagggtgttcctcaggtgactaaggatgttcctcatatggcggaggatgttcctcaaatgactgaggatgtccctcatatggttgacgatgttcctcaaatgagtgaagatgcacctcaaatgactgcggacgtagatgtgactattgcagaggacttaggtcgtgatggtgttgaagggtcacatgctgatgagggattccctggtgggccccgtgacccatcagttcttacttcatttgcgaagcatgtcgcacatgccatttggactggacaggagcatcctgagccgaatttggtgtcacacgggaggaaggtggcgttaattgggaggctagtgcctgagattaaagggctggttgccgccacaggattaagtccattgatcggatgtttagttgtaactggcgatcttggacttatatccacatttgtggagatgtggcacagggagaccaacaccttccaccttccagaggctagagccgagacagtacgagcgcgcagggcatatgtacgcctctcatgggttcgggagatctatgagatgagatgccaggcacgacgatggattgtagcagctcgtgcttatctcatgcacctggtcggttgcactattttttctaacaagagtgcaacatatgttcatgtggtgcatctagaggcttttcatgacctgggtcagagtgggggctatgtctggggagctgcaaccctggttcatatgtatgaccagttagatgaagcttctaggaccacgacagggcagattgggggtgctgaatctatgagcacttttcgagtgtgcatcaatgcgtcactgatgatgcgtatgaggagacgttctctcgtgcctcccggtggctga

SEQ ID NO: 15476 - DNA, 852 bp, Glycine max
  Peptide Sequence Number=SeqID_107161
atgaccgtcaaaacgcgaaacgtcaagcttgactggtggccgagggacctaaggaggtggtggcgtagtggaagacatgtgagagagacgctcgcacatggcctcaaacttgttggccaagtcagaatgtttctcggtgagggaagcaatggcctcctcgaggcgatctgtggtggtgcagcgggttccatgctctgccatggaaaagggcaggtcagaccagttgttgagagtaagaggaagaagatggaatgtcttggcaaaccctttatatacaattgtgctcgtactgctatggtatttgggttgtgtggtattcctctttggcctttctttatgtgtttcttctggtgccaacgcgatgtcttccatgttctctccactgttggtgctatcagaattgttgtgattcaggagtggtggggtgtggactttgaaattaaaaatcatgctgtgatgatttctcaacttggtcgtggatataaagctcttattccagatctctacaaaggaaaggttggtctggatgttgcagaagcacaacatttgtttgatggtcttgattggcaaggttgcaaacacatgttacccgtcatattgattttcccatacataggcattcaccatgaaaagttgaaaatccaacaattcctggttggtgttactggattttgtatggggggtgctctctctgttgcaagctcagtcttggttccaaatgttgatgctgctgtagctttttatggagctccttcttctgagcttgcagaccctgcccaagccaaggctcctattcaggcccactttggagagctggataattttgttggattttcagatgttacagtatga

SEQ ID NO: 15477 - DNA, 524 bp, Glycine max
  Peptide Sequence Number=SeqID_107162
atggctagaacacgaggtttaggtcgtgctataggtagacttataggcagagatagacaggatgaccgtgatgcagttgatgtttctgagaggcgtagacctactgcatcagcccgtaggcaacgggttcatcaaatgactgcggatgcacctgatatggctgaggatgttcctgacatgattgaggatgtccctgatatagctgaggatgcacctgagatgactgcgaacgtacagggtgctgatggtgctgaggggtcacatgctgatgatgctgagggattcccaggtgggccacgtgacccatcagtactgacatcatttgcggaccatgttgcacacgccgtttggagtggacaggaacgtcctgatttaaagttggtgtcgcatgggaggaaggtgacattgattgggaggcccgtgcctgagattgaaggactggttggtgccacaggattaagtccactgatcgattgttcaattgttactggcgatcctggacttgtatccgcatttgtggagag

SEQ ID NO: 15478 - DNA, 212 bp, Glycine max
  Peptide Sequence Number=SeqID_107163
gagagaaatctttctgtttatctcagaaactcagttgtaatcaagagactagttgtctcttggattatgagaattgtaatcaagagactggttgcctcttggagaatcttgaacacaagggtgagggatcccaaggggttgggacgatgaggacacatggtggcgacgaagaggtggttggagaggacgatgatggcgatggaagtacttag

SEQ ID NO: 15479 - DNA, 159 bp, Glycine max
  Peptide Sequence Number=SeqID_107164
atgacaataacaaaggtagtaagtagtggcactgatgacggtggtgatagaatgatgatgttgatggtagtagcagtgaaatgtgctgacggtgatagtggtaatagaaatggtggaatgatagtggtggtgatgacgacgacaatcatggtggggtga

SEQ ID NO: 15480 - DNA, 231 bp, Glycine max
  Peptide Sequence Number=SeqID_107165
atgaccgtcgtagtcttcctcgtgagtgagcttctaagtgaaccttcaaaaacttcctgcgctcgcagcaccttcacacctctgaacgcgaatctcccccctgagctccgcgtggcgtttcggtgcctttctgcgaacccaaaggtcgttgcactgacactgttcacaaaggaacttctaacttcatcacttcctccctcggttcataggctgggttcggaccctagctag

SEQ ID NO: 15481 - DNA, 264 bp, Glycine max
  Peptide Sequence Number=SeqID_107166
atggtttatgaagtttatgcccaattacctccacctgtgcctcatcaaacaaccatggtgttctacctgcaggacatagcaacagggcctaatgccacagttaccccagtggctggtatcaagggaggggattggacctacaccacatttggatccatatttgtggtggatgaccctgcattagccgtcagcgtgagttgtgtctgggactggcaagttccgctttgcaaggggctatgctgtgttgcaaactgcgttttatga

SEQ ID NO: 15482 - DNA, 195 bp, Glycine max
  Peptide Sequence Number=SeqID_107167
atgaagaaacaacaatggaagagaagcggaagacaaaggagaagaagtgagaggaggcgccatccactagggaataagccatggaagaaggagcttctccaccaagatgacccttggataagaagcttggagataatgcttcaatggaggaaaagaaagagggagagaaagagagaggggggagcacgaaattga

SEQ ID NO: 15483 - DNA, 210 bp, Glycine max
  Peptide Sequence Number=SeqID_107168
atggttagagagttggatctcatagaacagcttagagaccttagccttgtgtgtgaagttgcccctaaaagtgtgagactgggagctttgagaatttctactatctctagaatactttccattgaaattaatgataaaatttgtgcaacagagaatctggcacagcaacaatatcaaggccgcacaataagtgtgagatcaatgggctaa

SEQ ID NO: 15484 - DNA, 294 bp, Glycine max
  Peptide Sequence Number=SeqID_107169
atgcatgtatgtgcatcttgtcatcctgctaatcagagggtgagtaaagttgtcgcaacctacccttcggcgggagggcgacgcctgactcgcgggatgcgtgttccacgaaaggaatacgcgcggagtcgccaccaacatttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 15485 - DNA, 471 bp, Glycine max
  Peptide Sequence Number=SeqID_107170
cattcagaatcatttgctgtcaaattacccattgccttccctactgtattatgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 15486 - DNA, 240 bp, Glycine max
  Peptide Sequence Number=SeqID_107171
atgggggagatgcttgccaccgagctcgcccaggcgagcaagaaccttgcggattacataatcatcccctttttgacttacgaaatgttacagaaccgcacgaattgtgcaacgatgcttccttttgagttccggcatgtcacggaacttcacaatttgcctgacgatgggtgccaagtacctcaaaatggtcaaatgaaagttgcatgccaccaagcaaaggtccccggacgaaattag

SEQ ID NO: 15487 - DNA, 905 bp, Glycine max
  Peptide Sequence Number=SeqID_107172
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagttaacaagtggagaatgatctcttggatagacgtccagaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggagatgccagggaagatacttaacagggaa

SEQ ID NO: 15488 - DNA, 348 bp, Glycine max
  Peptide Sequence Number=SeqID_107173
atggtcattattgtcaatgcggaagcttgtggttacgtgaacctgaagtactaccaatatatagatgttgtttatacaaatgagcacatcttaaaagcttactccgcacaatggtggtctattgggaatgaagcggttattcctccttctaatgacgcatggacacttatccctgacccaactacaattcgtgcgaaaggtcggccaaaatcaacaaggataaggaatgagatggattgggttgaaccatctgagcaccgacaaaaatgcagtagatgtggagccgaagggcataacaggcgtcgctatccaatacaatctgagcatgggagttgttcaaatcattga

SEQ ID NO: 15489 - DNA, 117 bp, Glycine max
  Peptide Sequence Number=SeqID_107174
atgagcaaaatgaaaggcataggcaattatgtgtcaggatcatgcacgagtgaacataacatgcaaacaatgaaaatagaatgtatgcaattggcagaacaaaagcatgctaaatga

SEQ ID NO: 15490 - DNA, 752 bp, Glycine max
  Peptide Sequence Number=SeqID_107175
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggagatccctagtggagtcgccaactgtcacaacttacctttcggcgggagggcgtggcgagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15491 - DNA, 669 bp, Glycine max
  Peptide Sequence Number=SeqID_107176
atgtcctcacagtcagagagctacacgccctgccttgaggactacacgtcctcaccttcaaaggactacacagggctacacgccctccccttcaaaggaccacacatcctccccttcagaggactacacgtcctcgccatcagagggctacacgtcctcaccctcagagggctacacgcccttacctttagaggactacacgtcctcgtcttgagactacacgccctcactttcaaacagctacacgtcctcaccttcagaggactacactcctccccttcagaggactacacgtcctcgccttcagagggaactacatgtcctcaccttcagagggctacactccctcgccttcagaggactacacgtcctcaccttcaaactacacgtcctccccttcagaagaggctacacgttcctcgccatcagagggctacagtcctcaccatcggagggctacacgccctcgccttcagaggactacatgccctcgccttcagaggactacacgttctccccttcagaggactacacgtcctcgccatcagagggctacatgcccttaactttagaggactgcacgtccttggcttcagaggactacatgtgctaacctttagagggactgcacatcttcgctttcagagggctccacatctgcgcctttag

SEQ ID NO: 15492 - DNA, 474 bp, Glycine max
  Peptide Sequence Number=SeqID_107177
atggctgctagtgatcatgctatcttgtatgatagaactcatacccaccaagagaagcatgttggaactctcttcacaagatgcattgctgtagtatttatggaggagctcatgaatccggttgttgtataccctaagatgatgctgctaaagagttaccggcaaggagggagtttcaatcaaaatcaagggcaaggatggaggtcacatccaaggaatcagttcaacaaagatcaaggaggaccttccaacaaacctcctaatcaagggcctaacttgtatgagaggaccaccaagctggaagaaactttggctcagtttatgcaggtttcaatgtctaaccataaaagcactgagtcagccatcaagaacctggagatccaagtgggacagctagctaagcaaatagctgggaatttttctggaggttttggagctaacactgagaaaaatcccaaggaagaatgcaaggct

SEQ ID NO: 15493 - DNA, 201 bp, Glycine max
  Peptide Sequence Number=SeqID_107178
atgatcattaaagaatctatccatgttgcttttgatgaaattaacccaattaggccaagaaaggaaattcttgatgatatttcagattctttagaaggtatacatattcatggtgaagagctcaaaggcaaaggaaagggaaatgatgaagactttcaaattcatgaaacaaaaacaagtatagatcttccaagagaatga

SEQ ID NO: 15494 - DNA, 150 bp, Glycine max
  Peptide Sequence Number=SeqID_107179
atggttaccaaacctcagtgcgcacatcaaccggggcaacaccgttctcattgggctttctccggaggggccctagtgctcgccaacatggatgacaaggagctaccctcacccgtgaactccgacgttgtcatgcgctactacgcttaa

SEQ ID NO: 15495 - DNA, 797 bp, Glycine max
  Peptide Sequence Number=SeqID_107180
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccccaatatccgctgctaaaataccaccaaaaggaaacaactccaacttgaaaacatttcaagcatctagtctcatggtcagagatgccattggctcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15496 - DNA, 519 bp, Glycine max
  Peptide Sequence Number=SeqID_107181
atggaaggcaaagatttaggaagtacaggcggcccccattatgtgaaaattcaaaacaagcgcgccatcccgccatatgacttgcctcccaactatacaccacccaatgtggcatacactcctagtgagaatgtcaataactccattctcatactcattgagagtcaacaacctcaatcggatcatgcacatgtctctcaacccatgggggagacacatgaaattccccgccacaatctagccgacttcgagccttgcctcgaatatgccactgaagggaaagtagttggtggtatacccctgcaaaacactttggaagggcctcaatttcgcccccaaccacaacccttctatggaaaaatggtgggttacacaccttcaagctttgcggatttggtcttcgtcggtgaaaggatcaaagtgggtctggaaagaggtaaatctgatcatcctgctttgataaatgcaaaaattggggcaaatgaagaggatgagaatagggagaaacccttgctatga

SEQ ID NO: 15497 - DNA, 339 bp, Glycine max
  Peptide Sequence Number=SeqID_107182
atgactaagggcaatccaggtgatttacaaccctttgatcctgaaatagatagaacctttcatagattagttaggcatagtgtgaatcctgatcattatgtgcattttgagtattttgttgttggtgattttgaacattctgattttgagcattcaactactaattttcatactgagaacatggctcaacctctacctcgtgagaggactcttagggagatggctgcacctgatttcacttatgaaagcttgtgcattcaatatcctgatgaggatgttccatatgtgaagatcctcataagcatcttaaggagttccatattgtctgttccaccatga

SEQ ID NO: 15498 - DNA, 284 bp, Glycine max
  Peptide Sequence Number=SeqID_107183
atgggggaggaggttgctgcccagctcgcccaggcgagctggaatgttgcagaactttacggattgcgcgcaacaatgcttgttttgacttccagaatgttgcgagactttatggattacacaacggtgggtgtcgcaacctacccttcggcgggagggcgatgcgtgacttgcgggatgcgtgttccacgaaaggaatacgcgcggagtcgccaccaacgcttatttgaggaaaacgtcggaaaaaccggaaaagacgtgatctacgaacttttaagtgaaag

SEQ ID NO: 15499 - DNA, 255 bp, Glycine max
  Peptide Sequence Number=SeqID_107184
atggatcgttgtcccttgcccagctctgggcaaacggaaagcaccgctacaaggcaccccgtaaatattgggtgcctaatataccttgagtgggttcgagttagctcgcctgggcgagctgagctcgcctgggtgagcaacccctgcacgaaatgggttaaaaagggggaggaggaaggtttctgcaccaaaaactctcccccctcattcaaggaagcaagagctcacgggactcacggattttacagcccttag

SEQ ID NO: 15500 - DNA, 525 bp, Glycine max
  Peptide Sequence Number=SeqID_107185
atggcttcgagaaagctttccgcgaaaagatctaggagggacgccgcggttgaagggaccagtgccgcccccgagtttgatagccaccgtttcaggagcgccgagcaccagcagcctttcgaggccatcaaaggatggtcgttcccccgagagagacgcgtccagctcagggacgatgagtacaccgactttcaggaagagatagctcgccggcgttggacgtcgttggtcacccccatggctaagtttgacccagagatagtcctggaattttatgtcaatgcttggcccatagaagagggagtgcgggacatgcgatcatgggtgaggggtcagtggattccttttgatgcagatgccctcagccagttcctaggtgacccgctggtgttagaggaaggtcaggagtgcgagtttagtcaaagaaggaatcgggctgatggatttgacgaggaggccattgcccagctgttatgcataccggatgtggatgacgttgctgctcagcaatgtcctacccagtga

SEQ ID NO: 15501 - DNA, 471 bp, Glycine max
  Peptide Sequence Number=SeqID_107186
atgggtttcattggcttttggaaattagtggtagtgcaaaatctaccctatgatgatatgctgagagtgggcaaaattcctaagttattgccacatcgactttttccttttgcaaggttgtggtggccaagactaggtaattttggtgcagtggtgcttgagagtgtaagtggacttaaggctgtggattttaggcaacctgaggtgctattagtaaagaaagttcatcaatttgaggtgacaaaaagcccacttgaggcattagcatatatgggactaaatggagagtacaatttgaaggagttaatgacattgcaatggtattttcacacctatgctttaaggcaatttctgatagtgctgagatcactgatggctttaataactacctattcaagtagttttgatgataacaaagatgatgttggaacaagtggcctcagaataattaagaagagggggttgaattaa

SEQ ID NO: 15502 - DNA, 288 bp, Glycine max
  Peptide Sequence Number=SeqID_107187
atggatgaacatctacagaacgggaaggaaatggctaacacaatgatgaagattaacaaaaaattagagaaaatgttcaacaatccttacggtaaagtgagtaggtcatttgctgtaagatggaaggatgaacctacttggcatctgctacactctagtggcagcatgcactctgtcacatataaccaagatctagtgagcccaactctacttgctggatggacaaaacttagacagctatatgggctcactgaaaatcatcaggtcaccttgacccagtatggatag

SEQ ID NO: 15503 - DNA, 279 bp, Glycine max
  Peptide Sequence Number=SeqID_107188
atcgcgtcttttccgtttttccgacgttttcctcaaataaacgttggtggcgactccgcgcgtattcctttcgtggaacacgcatcccgcgagtcacgcgtcgccctcccgccgaagggtaggttgcgacaggtggctaaggccttggtgactaggggtattgtggaattacgctctgtatctatagaagatcaactttctgatttagttacaaaactcgttactaaggacaaactaatctatgtaagagaagggctgggcatgttccctgtggaatga

SEQ ID NO: 15504 - DNA, 246 bp, Glycine max
  Peptide Sequence Number=SeqID_107189
atgaagcacttcactgacaccctcatcagtgccaacataggaacaaaagctggtaccgggccccccctcgaggtcgacggtatcgataagcttgatcaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 15505 - DNA, 297 bp, Glycine max
  Peptide Sequence Number=SeqID_107190
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagtttcgggtag

SEQ ID NO: 15506 - DNA, 318 bp, Glycine max
  Peptide Sequence Number=SeqID_107191
agatctttcttgttcggtgctgctgtggttgcatcctttggttaccgcaaagagcgtgatggctcttgggtaaaaaagtgtactcaaccaaatgatgatgaaggacaattaccggttgaaggagactcttctctccttcaaagtattttggacaggttcgatggactccaaacttatgttggtgaaaggtttgatgctttggaacaacaagtggacacgcgattcaacgagatggactcaaggatcacaaaggttgaagaagatgtcaccttcattcgcacatgctttgatctaccaccaccaccaccatcgtcttag

SEQ ID NO: 15507 - DNA, 561 bp, Glycine max
  Peptide Sequence Number=SeqID_107192
cagaagctcctagctgagaagaccaggaagaaactggaggaagctgcacagtcaggaagcgttgatggcgtcatcgaccctccatcccctgccagacgccacgtgaagtggaagatggcctgcaccaagaaaacaggggagatgacgactgaggccgcaaaggaaatcgctgagaagatcataagtcattttcaagatgttatcaccgctgctattggacgtccagagcaccctagacgtgcctgtgctactggagccggtgtcaccatcaagcaatacttcggatcggctccatggacaaaaagtgactcggtagctcatggcaacgttcaactagatgccgtcccagtttcagtcccagatgaaatctcagggacttgcattgcctccggagcctctgacaattcacaccttccttgcttgatcgacacatctggtcaagtctttatcatagcagttgtgtctccggcaaaaccacctcaaaagccatatccggaggtcgatgatccgctttatctgatgacattgaccatctgccgcaacatgcttgtcataccctaa

SEQ ID NO: 15508 - DNA, 159 bp, Glycine max
  Peptide Sequence Number=SeqID_107193
aacaactcaagtgaatcaagaacaagtcaagagttcaagaatcaagaagaattcaagactcaagaagaaagtctacaatcaagaatcaagattcaagattcaagatctcaagaatcaagatcaagattcaagaatgaagaaaagactcaatcaagataa

SEQ ID NO: 15509 - DNA, 366 bp, Glycine max
  Peptide Sequence Number=SeqID_107194
atgatgagaagggaggatttccatgatgctcctctattaggcaatcatgaaacacagctcctaactcaaaagtggaaaacacatgaacgacaaagcatttcattcatgtggctccggaaaaggatcagaatggaggattgccttgagggtcctttcttaggcaatcatggaacacagctccaaactcaaagtggaggacacatgaatgacaacaaaattcattcatggggctccggaaaaagggtgagaatggaggattgccttgagggtcctctcttaggcaatcatggaacacagctccaactcgaaagtggaggacacatgaaccctaagcaattcattcatgtgggctccggaaaaggatga

SEQ ID NO: 15510 - DNA, 759 bp, Glycine max
  Peptide Sequence Number=SeqID_107195
atggtcatttaccaatccctattctatgacttgacccaattatctagtgaaggtgtaccatttgaaggtgcattgaatgatgattggaaatttgatttctttgtgcatgatgcctgccggttggtttgcaccaaccaagtggatatgaccagaatgcttcttgccggatcattggctcttgaaagtcgcatccttcactatcttattgtgtgtattttacttccaagatcttcaaaccttgcacaagtttctgaagaagatcttattgtcatgtgggcttttcatactggccgacaaattgattgggcacacttagtccgatatcgcatgcataaggcattgcgattaaatgctcctttaccatatcctcatgtagtcactcttttccttcaacactttaacatccctcttgattctgaaccttatgttccaatcaagagatccttcttgatcggtgctgctgtgattgcatcttttggttaccgcaaagagcgtgatggctcttgggtaaaaaagggtgctcaaccccatgatgatgaaggacacttaccagtaggagaggattcctctctccttcagagtattttagacaggtttgatggtcttcaaacctatgttggtgaaaggtttgatgctttggaacaacaagtggacatgcgattcgatgagatggactcaaggatcaccaaggttgaaggagatgtcacttacatccgcacattctttgatctaccaccaccaccaccaccatcatcttag

SEQ ID NO: 15511 - DNA, 661 bp, Glycine max
  Peptide Sequence Number=SeqID_107196
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagtttatccatagaatcagtatggaatggccaatacaaggatgtcaaaccagagtgcaacatgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15512 - DNA, 141 bp, Glycine max
  Peptide Sequence Number=SeqID_107197
atggcgacagcgatgaagtctatttcgttgaagcctttgggaagagacggcaccgtgaggcgccatttggtggaggagattccgattgtggtgccaaggtacaccgtcaagcctctggcgacgggtgctaaggctggataa

SEQ ID NO: 15513 - DNA, 378 bp, Glycine max
  Peptide Sequence Number=SeqID_107198
atggttgaggagccaagaagacttactttggaagactactcaagctcaaaggctaaaaggtggattcattcgctcaaaggaaatagccttaagaattgcgatgaagtagttgagaaattcttaaacaaagaccaggatggtccatctaataggccaccacaacaagggcctagcctctatgatcaaacaatgaagttggaagagactcttgctcagttcatgcaagtatcaatgtcaaaccataacagcacagagtccgccatcaaaatctggaagtccaagtgggacagctggctaagcaattggcagaccgtccttctagcagctttggagctaatactgagaaaaatccaaaggaggaaagtgagaatggaatag

SEQ ID NO: 15514 - DNA, 405 bp, Glycine max
  Peptide Sequence Number=SeqID_107199
atgtcaggatttacacgtgattctcctcaaatttcagccagcccgcatcaattagaccttgcaccttacgcttcagagccctacaatgctcaatggaacgccccggggcttctccgtgacaagcacacattgcgttcgaatcatattctcggagaaatggaggttgatgaaccttggctagggttatggctaccattgaattatcaagtagatatgggagcaagtcagcataggacactagaattggggtggtgttcgtcagactttgtggttgatttaggggtgacctttgtggataactgggcggtgggtaaggagaaggtgccacttgagctgccaggtctctccaccttagggcgtattcttttgaaagattcgtgccccctttttgcacatgttctgtag

SEQ ID NO: 15515 - DNA, 249 bp, Glycine max
  Peptide Sequence Number=SeqID_107200
atggtgaaagttggaacctcttacgttgccgattcaacgtctcattttgaagcgccaaaagtagatgtctacgcccacttcccgggctccagtggcgttcatggtttctatcagctgttccctcctgttcagctactgaaacggggtggtgttatccgtaattcggcaaaagcataccgccggacatcagcgctggcaagtgtaaagcggtgcacaatgagtgagcgtaaccaccacacccgcggttaa

SEQ ID NO: 15516 - DNA, 505 bp, Glycine max
  Peptide Sequence Number=SeqID_107201
atggaattgggcttagcgagctcgctaagccaattctacagaaaaaattggatctgtgttcactcgctaagcgcgtggctatcacgcttagcgcatgagtcatttttcctaaggcatgctaagcgagtcacttgcgctaagtgcccaatggcttcccgtaagagaaaagccacggctttagtgtctcatgccgaattgattagaagaaactggcataaacagctaaccaacttgactaagggaagcattgatgtggcaattgtgaaggaattctatacaaatctttatgtcccagacgacaagtttcccaagcaagttagggttcgagggcacctgataaaatttgatgttgattccctcaacacctttttggagattccagtggtcatggagcaaagggagagcttgccttcttactccaggttttctagactgaggcctgatcctcaggagcttgcagcctggctgtgtatccctaggaggggatttgtttttaatgctgagg

SEQ ID NO: 15517 - DNA, 683 bp, Glycine max
  Peptide Sequence Number=SeqID_107202
gtgcaggattatgccgcgctggaggtcggctacgggctggtcgcctatatcgcgctgaccattatgagcctgctgacgctgattcatctcaacgtggaggagctgtgggaacattattacccgcagtcggtgccgcacgaaccgcccgagcagtggcaggtttgcctgaactgccaccataccgcctgcaaaaatcctgggcggcgctgatcgcctcgattgtgctgctgatcccggctaacctgctgccgatctcggtggtgtacgtcaacggtgcgcggcgcgaagacaccattttctccggtattctcggcctcgcctccggtaacgtgccggtggccgcggtggtgtttatcgccagtattctggtgccgtttaccaaggtgttagtgatgctgacgctgttgctcagcatccattttaagtgtgaacagggtttgaaaacccgcatccgtctgctgcgcgccgtcacctgggtgggccgctggtcgatgctggatctgttcgtcattgctttaaccatgtcgctggtcaatcgtgaccagctgctggcttttaccatgggacctgccgccttctactttggcgcggcagtcatcctgaccattatggccgttgagtggctcgatagccgcctgatctgggatgcacatgcaacaggaaacgccgactacaccgactag

SEQ ID NO: 15518 - DNA, 429 bp, Glycine max
  Peptide Sequence Number=SeqID_107203
atgcagatgagactcaattggcacaagatgaagattttgactctgataagtgttacttttgaagtgaaatctacaactcagaagaagacaatgttaatatgtggtatcttggcacaggctattaccaatcacatgactggacataaagagtggtttgtaaacattgatgataaggtgaagagcaagatcaagtttggctactcaatgcagatggaggacagtcaactgaagatgtttgatagcatcaagaggttgattctaagtccctttgtcaacgaaatagatctcattcaagatgtgaagttcagattagatttcaatgggccacttgaagaagaagtctacataactcaaccacctagttatgtagttgcaggacaagaggataaagtctacaagttgaataaggcactatatggcctcaagtag

SEQ ID NO: 15519 - DNA, 201 bp, Glycine max
  Peptide Sequence Number=SeqID_107204
atggccggtagcagggcaatagacacaccgccaccacctctagagttcacctcagctcatccgcaaagaaggctagaagcgttgccttcgacacatgaccgaccaataggcgacctaagtccaaaagccgaagctaaagacgttaaagaagcgctactaggaggcaacctagtaccttttgaatctatgcttgttatttga

SEQ ID NO: 15520 - DNA, 105 bp, Glycine max
  Peptide Sequence Number=SeqID_107205
atggcgaaggaaatgatccatgaaaaagccatttggttcaggggatgctcgcctaggcaagctggttacttaaagctggaggtatcagcttgcccagacgagtag

SEQ ID NO: 15521 - DNA, 240 bp, Glycine max
  Peptide Sequence Number=SeqID_107206
atgcccttttgcgggcgagagaaggcgaggctcacgggtgcgctttccaaaggaggaaagatgcgcggagtcgccaccaacgtcgagaaaagcggggctcttgctcctacgtaccctccatcgaagaggaaatcagacctacgtagtcctttcttaagggtgaatcacacgatttctttttacttgaaaggtgatcatttaaaggtgttggaccttaaaaatgatccattaacttggtaa

SEQ ID NO: 15522 - DNA, 231 bp, Glycine max
  Peptide Sequence Number=SeqID_107207
atgtggggccgcttagcggaagttgtagaaattcagcttctaaataatcggcttagctggcaagtgcccgctaagcctaaccgttaccgcaaggcctcgcttagccacaggcatctcagcaagaggatgagtgttcatcctcaaaagatgaactcgcttagcgcggtaggcacgcttagcgagttcttccgagaacgcatatattcaatgaatactgatgaactcgcttag

SEQ ID NO: 15523 - DNA, 438 bp, Glycine max
  Peptide Sequence Number=SeqID_107208
atggctgcaattgacattgctattcttagagatagagcccacataccaacaaagaaaagccttttggaacttacatcacaagatgcattgttggcacataacaagttgttgtccaagcaattggaagcattgaccgaaacactaaggtgtgccatctgtggtggagctcacaattctggctgctgtatccccaatgaagaaccaactcatgaggtcaattatatgaggaatcagccaagacaaaatttcaatgcaggtggatattccggatttcagcatggccaaccatataattcacagcagggacagtggaggaatcaccctggaaaccagttcaacaaagaccagggtggtccatctaacagaccaaaacaacaagggcctagtctctatgatcgaacaatgaagctggaagagactctagctcaatttatgtag

SEQ ID NO: 15524 - DNA, 165 bp, Glycine max
  Peptide Sequence Number=SeqID_107209
gtcgacggtatcgataagcttgatccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15525 - DNA, 411 bp, Glycine max
  Peptide Sequence Number=SeqID_107210
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctaccgaggggtggtgcgtaacggcaaaagcaccgccggacatcagcgctggcaggtgtagcggtcacgctgcgcgtaaccaccacacccgccgcgctaaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 15526 - DNA, 495 bp, Glycine max
  Peptide Sequence Number=SeqID_107211
atggctcaattgatttctgatgtcatctattgtttgcagggatcgcgcccacaagacgcccagtggacccgaagaagtccaatagggccctggggtttccagctctgggatcgcgcccacaagacacccaatggacccgaagaagtccaacaaggccttggggtttccaactctggttacgggcctctgacagtcctacagggtgcccgttcccccagcgaggaatcgcacccacaaagacacccagtggacccggagaagtccaacagggccctggggtttccagctctggttacgggcctctgtagtcctacagggtgcccgttccacccggcaaggtcacatcatcatgacatagggatcgcgcccgcaagacacccagtggacccgaagaagtccaacagggtcttggagttgccaagctctaattacgggcctctatcagttctacggagtgcttgtcgcccccagcaaggtcatcaggccccctactaa

SEQ ID NO: 15527 - DNA, 430 bp, Glycine max
  Peptide Sequence Number=SeqID_107212
attgagggcccaattggtggctagaaccacggtgttgctagcagagttctatgtcatcagtgacaacaccatcatcgtcacccaacgcatcatcaagaagcttccaatagaggccaacttcaggctcacaaattgcaagtccaccctcgcaaagcctccaccctacaccctcgcaaatctggttgtcgatgtagaggcatccatcggaggaagagacagtgatttggagggagagagaaagaggggaaggcgaaccacttgtcatcgaggttgtcatggaggtgagaggagggggcaagggcaagaagggttcggagtagaaatagagactgcgaagggtagagaaagagaaggaagagaggttaggatcattggattagagagagagagagaaagggaaagaaaaagtaggatagtgtctggtttttag

SEQ ID NO: 15528 - DNA, 381 bp, Glycine max
  Peptide Sequence Number=SeqID_107213
atggtgaaagttggaacctcttacgtgccgatcaacgtctcattttcgccaaaagttggcccagggcttcccgtcgggaaacctgtcgtgccattcgctgcattcaatgaatcggcgcaactgttgcgcgaagggcgatcgggcggcctttgcgtattacgccagggcgctaagcggagtgtgcatactggcttactatgttggcactgtaacgcagggtgtccagtgaatgcttcatgtggcaggagaaaaaaggctgcacgggcgtcagtcgaatatgtgaatacgactcactatagggcgaattggagctccaccgctggcggccgctcagaactgactcctcctcgggtgcggattcgactgcgcgacggtatatag

SEQ ID NO: 15529 - DNA, 300 bp, Glycine max
  Peptide Sequence Number=SeqID_107214
atgcgaacatgcattagtaaagagacaaaacttccaactgatcagagcaacatatgctttttggatgaaaaacaaggtgtctaccgaggaaggagagaaacactgggttcaacaaaaatagaagaaaatcactcaaagtgcattgatctcacacagggtaaggtttatggtgagttgggactttggctcaaggcttgtagaatggatggacatgatatatgtcaaggtgttggtctggccagtggttcagggataaaggggatgtcccacattatttccatgacacacatgcaacaatga

SEQ ID NO: 15530 - DNA, 549 bp, Glycine max
  Peptide Sequence Number=SeqID_107215
atggcgcctaccaggcaccctctggacccggataagtccaatagggccttgggatttccctccttgatcacagaactctgccagtcgttcggcgtccccgtcacacctagcaaggttattcggccgcccatcacccgagcttttgtcgagaagtactgcacgcagagacaggtccagggtgatgcaccacaggccgcggacgcgccgccacctcatcaggctggtccagccggattgtttgatacggagcagtatttgcggcatttggttcgccagcaggcggccaaccaccgggcacatgtacagacccatgattgtctttatcagatgagtctcagcctgcagagccagggctttacttcttttccgtgccctactccagaccagttcagggcagaggtcgcattgcctggagattggcctaaggcccaggcaggagaggcaccagcggaggcaccagcagaggctcccgacgaggcagatgaggcccgcgaggacgaggagatgaccgatttactagatttcttaggagggagtggggccacatga

SEQ ID NO: 15531 - DNA, 402 bp, Glycine max
  Peptide Sequence Number=SeqID_107216
atggttgcccgggtgatgttggggtacggctacgagcccggaatgggtttgggcaagaacaacggtggcagaaccagcctggtaagcaccagagaaaaccgcaggatgtttgggttaggttataaacccacgcaagtggacataaggaaatgtatcgcggaaaggaagaacagaggccaaggctcgcggttgggacaacaagccgaaggggccccgccgtgccacattagtagaagctttataagtgcgggtctaagacacaagggtcaagtcgctgcgatatgcgaggatgactccccgaggagatccgacgacgagtccctcgaaggtacaaatacccaagacccggccgtcgatttcgagcaagaagtgagacggatgcagagtgaagaggatgaggat

SEQ ID NO: 15532 - DNA, 297 bp, Glycine max
  Peptide Sequence Number=SeqID_107217
atgggcccgaaatctaccctaaggctcatgagaacccaagggccttctcttgcatctttggctcaatcttcttggagtcttctatccaatgtccttgagggagggttgcacgtcctcgccttcagagggttgcacgtcctcgccttcagagggttacacaccctcgtcttcagagggctacacgccctcgctttcaaagggctacacggcctcaccttcataaagctacacgccctcaccttaagaggactgttagacaagtggcctcagatatctaagaagggggggttgaattaa

SEQ ID NO: 15533 - DNA, 957 bp, Glycine max
  Peptide Sequence Number=SeqID_107218
atggccccgaggaagcttgcctcaaagagatctaggaaggataaagtggctgaaggaaccaattccgctcccgaatatgacagccaccgctttaggagcgctgaacaccagcagcgcttcaaggccatcaagggatggtcatttctccgggagcgacgcgtccagctcaggaacgacgagtataccgatttccaggaagagatagttcgccggcggtgggcatcgctgctcctgggatatcctttagtgctggaggagggtcaggagtgcgagtatggccagaggaggaaccggttcgatgggttcgacgaggaggccatcgcccagttgctatgtataccggggcaggattttgcccgaactgctgccgggagacaggtgcggatcatgtgcaccaacatgaccacccttactcagatctggatgactttgctgctcaacaacatccagcccagcgaccataattccgacctccccctgccaaagtgtcagctggtgtacgccatcctaacatggatgagcattcacgtggctcagctaatcgttgatgccatctatatatttgcaggtatggcgcctaccaggcaccttctggacccggataagtccaacagggccctgagatttcccgccttgatcacaggactctgccagtcattcggagtccctatcgcacctagcaaggtgattcggccgcccatcacccgagcttttattgagaagtattgcacgcagagacaggtccagggggatgctccgcaggccgcagacgcgccgccacctcatcaggccggtccagccggattgtttgataaggagcagtatttgtggcatttggttcgccagcaggtggccaaccaccgggcacatcctgcagagccagggttttacttcttttccgtgccctactccggaccagttcagggcagaggtcgcatggcctggagattggcctga

SEQ ID NO: 15534 - DNA, 261 bp, Glycine max
  Peptide Sequence Number=SeqID_107219
atggcaagagctggtgacaatggtggtatatatcatcaactggacgaatatcagcgcttatttctggacgcgtggactacacaaatgcaacgtttgttaaaccgtaacaaagaagagccctacagacgaatagccaaatcttcctcgtttgctcttaaacctctatcccctaaagaagaatttaaagatgtctttcccaaggagattcctcatggactgccaccttcaagaagcataaacatcaagttgatctccttctag

SEQ ID NO: 15535 - DNA, 144 bp, Glycine max
  Peptide Sequence Number=SeqID_107220
atgattggtacctcaaagccttacaccggggcaatgaggggcatcgtgcatgagcctcaagttcctagctacaaggtcatgatgaaagataacaattggtacctcaaagccttacgctggggcaatgaggggcatcgtgcatga

SEQ ID NO: 15536 - DNA, 675 bp, Glycine max
  Peptide Sequence Number=SeqID_107221
atgattatgaggggtcaagacatttatagtagtcaagaggagactatttcttccccttcctttagtggaagtgaagatgaagtaaggggtgaagattctagtgaggaagtctacccctgtgaagaaaaggaaaacaaggcaaagaattcctccaagaagattgttaagaaggaaaatcattttgcaacaaaaggtgatatcaaaagagcactccttcttaaacaatctttctaccttctcctatcaagggaaacatcccacaacactgccatacctgttgagcttgaggttattcctcaagtaaaggagttgttggatgggggtttggttcgtaagagcttaactctttgtgctttgttggtgcctaaaataggtattatgaggcatcgaatccctatgataggtggtatgatcaatgtgttgagtggtgcaaccctctttagtaaaatcacctatgcatccaacatcttcatgattcacatacatagggactcattaggtagtgatcaaagggttcccacgaaccctaagagaataaagatcattcctgagtggcccactccaccaagtgttgagggaagaagcccagagtttcaagaacctctagatttgaggtcaaatccttttcaagggggaaggaatgatgtaatcctaccctcaaagggcattggatag

SEQ ID NO: 15537 - DNA, 369 bp, Glycine max
  Peptide Sequence Number=SeqID_107222
gcacagggtgatgcaccgcaggccacagacgcaccgccaccacctcatcaagctgatccaactgggccatttggcatggagcggtatttacaacacttggttcaccaacaggcggccaaccacagggggcaggtgcagatacatgagtgtctctaccagctcagcctcaatcagcagagccagggtttcgctccttttgcgtgccctactctagatcagttcagggctaaggttgcatggcccggagattggcctgaggcccaggtaggggaggcgcccgcagaggctcccggcggtgcggaggaggcccgcatggatgaggagatgacagatttactcggtttcttgggagggagtggagccacatga

SEQ ID NO: 15538 - DNA, 351 bp, Glycine max
  Peptide Sequence Number=SeqID_107223
atgaaggatcaaataaatacaagtagtggggatgtctcctccacctctagaacctcacaatcactcacagactcatctcatgctctcaagatggcttcctcttcaagctcggttctctgccagtcttcacacagcttagctgatagatgcaagcgccgcaagagtggtgcgctcaacggatggctcgctaagccgacagattggcttagcgagcagatcaaaatcagcacttcacaaacttacctaattaacctaaaattgaaagaagaagttaggcacaagacagatattaaagaaagtagcttaaaccacagtctcatggctaatgtttactcaagcacaagtgtttaa

SEQ ID NO: 15539 - DNA, 435 bp, Glycine max
  Peptide Sequence Number=SeqID_107224
atgaggcttcactgtgatcaagctagtcgaagacccaacatgaccacagatcaacctccactccttatggctcacatagacccagttcccagtggggtcgtcaactatcgcaacctacccttcggtgagggcacgaaaaggcctctcagatgggccaagggtgcgtctcccattgaaggaaaacgcgtggagttgccaccaacgtttattcaaggaaaacatcgagaaaaccaaaatggaaaggtcgaaggtctgcgtattttgaaaatgaggggaaatttcaatgggggtttaccagaaagcgcaccggatcatcaacctaaattactaaaccctcgatccctcgtcaagcttaatatccaagcttcgtccacagatccctcatttaagactccacccgatttagacaaccctcttaggtttagaataacttaa

SEQ ID NO: 15540 - DNA, 294 bp, Glycine max
  Peptide Sequence Number=SeqID_107225
atgatgagatgttgcacactgattgattggcctgactctctaaaaacagtccccagtggagtcgccaattgtctcaacctacccttcatcgggagggcgatgcggggctcacgggtgcgtcttccaagggaggaaggcacgcgaagtcgccaccaacgtttattcaaggaaaacgtcggaaaaactggaatgtgtggtccacgaactttaatcgtgaaaggttcgagagttttttttacgcacggggaaggtattagcacccacgcatccgtcacaagggatgacaacctctaa

SEQ ID NO: 15541 - DNA, 540 bp, Glycine max
  Peptide Sequence Number=SeqID_107226
atggcgtcattggagggcttagattggctctccaaattgaaagttatcgatgaggagaactttgaagcttcggaggaagatgaagaagtccgagctctaaaattagagctagggaaggcgagactcgccaaggagaagttcaaatcagctgctacacacatccggaaggagtgcaccgatttacaagaggaaaacgcggccactacaaaagcccttgaacaagaaaccaaaagggcccgcaaggaggaatatggccgagagaaattccgaggagcattgtggggtagtaacaatgagctcaatctccgaagagaggagagagatcggtcacaggtgcatggcatgatattaaaagaagagttagttgcttgcgtgaggtccaaaaggagtttggctcaacacttggaagccacggagcaaagcatgctagctatcatagtgcaatacaaggaagaattgaaccagtccatggcccatgaacaaaagctagtggaggattttgcacaagtgtatgctgaaaagaagcaagagggagggtga

SEQ ID NO: 15542 - DNA, 633 bp, Glycine max
  Peptide Sequence Number=SeqID_107227
atgcatcctccacccaaagagtttggagctatgcttcatgattgcctaagtgtggaccctctagtgcaatcctccattctcccctttttttcggagccctatgaatgtcattgcctatcgttgtccatgcttcctccacccaaagagtttggagctatgcttcatgattgcctaagtgtggaccctctagtgcaatcctccattctccacttttttcggagccccacgaatgtcattgccaagcgctgttcatgcatcctccacccaaagagtttggagctatgcttcatgattgccaaagtgtggaccctctacccgggggatccactagttctagagcggccgccaccgcggtggagctccaattcgccctatagtgagtcgtattacaattcactggccgtcgttttacaacgtcgtgactggaaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcatttaagcgcggcgggtgtggtggttacgcgcagcgtgaccgctacacttgccagcgctga

SEQ ID NO: 15543 - DNA, 665 bp, Glycine max
  Peptide Sequence Number=SeqID_107228
atgggatcaaatcaagcaccctcttttaagaaaaggttttatcatgtcaaaatcaagagcctaaaagtatccaatttgcaagagttaggacagcggatggaccaactccaacgtcaagccttccgcaagacatatggaaaaatctgggatttggttatggtagaagtgtttgttgaagccattgcatccctcactcagtactatgaccaaccgctaaggtgcttcacgttatacccctccatggcaaaaatagccaaagtggtcaaggtctcagtgcaagaattggaccgagtaaaacaaaatagaaatggggtggttgggataccaaagaagaacttggaagagaaagcgaagtttttggtagatcaaggagaatgggcttcattcattgatgttttagcgctattggtgtttgaggtcgtcctatttccaaatgtggatgggctagtggatctagcggcgatcgacgctttccttgcttatcaccatagcaaggaaagtccggtcgttactgttttggtcgatgcctatgacacatttgaccaaagatgcgagaagagcagcacaaggattgtctgttgcacaaccgctctttgtgtatggatggtctctcacatttttagtcctgaaagtagacccatctgtcccctacaaggtcatggcat

SEQ ID NO: 15544 - DNA, 330 bp, Glycine max
  Peptide Sequence Number=SeqID_107229
atgatgcaatcctaccccacaagggcattggatagaagactccaagaagattgggccagagatgcaagagaaatccctagggttctcaaggccttggagcaagaaaccaagagggctcgtggggaggagcatgaccggaacaagttccgaggggctctgtggggtagtaacagtgcgcttaagctccagagagaggaaatggaccaatcacgagtagacagtttgatcttgaaagatgaattgaaggcttgctcgaggtccaagataagcttgcctcagcgtttatgcgagacagagaccaacatgttagccatcatcagcaagtactaa

SEQ ID NO: 15545 - DNA, 162 bp, Glycine max
  Peptide Sequence Number=SeqID_107230
atggcgccaaaaacttgttcgcggccgacaagtgtaccggatcgcacaagtagtataaaacggactttagaatcagaccagttttcactgttgaatgaccctaacaaagcatgcatctacgtgatcaaggtacctacagggaagatccaacagaggatttag

SEQ ID NO: 15546 - DNA, 300 bp, Glycine max
  Peptide Sequence Number=SeqID_107231
atgtcactacttgttgatgggttaaccaaggtgactatggataagtggatggatataaccgacatggtatatgtcattgcatcaaggtataatgtaattcttgtatccttgtctcaacaacaaagcattacgttctttcctcttagaagtcaaccacttgcagattcttcagtgcatcgcataatttgtatcggtcacatctatggcaatcattttgttcaggtttatttaaaagactgttgtcctttaccgcctttagcattgttatggtctagcaattgtcatcctcaggcaaagtag

SEQ ID NO: 15547 - DNA, 297 bp, Glycine max
  Peptide Sequence Number=SeqID_107232
atggcttgcacccacattccagtgaaagcaaagatctttcaaaattgccccatgtgtggtgtcgcttgtcaatgtcgggactcatatgcgattctcctcaaatttcagccagcccgcatcaattggactttgcaccttatgcttcaaggtcatacagtgctcaatggaatgccccagggctcctccatgatatgcacatgttgcgttcaagtcgtatcctcagaaaatggaggtggaggaaacctagcagaggtggtgtttgtcattggaagtgcgctaggtaggctctatggttga

SEQ ID NO: 15548 - DNA, 492 bp, Glycine max
  Peptide Sequence Number=SeqID_107233
atgactcaagagctggtagcccgcggagataccttatggttattcgcacccttttgtcatccagaggcggcgggcccggtgacaagcagagaccaagtttggtcattctgcacccatgatacgcggagataccttacggttatccgcacccctttgccattcagacacagtcgtgtccgatggcacgcagagaccaagtttggtcattctgcacccatgatacgcggagataccttacgtcgtgtccgatggcatgcagagaccaagtttggtcattctgcacccatgatacgcggagataccttacggttatcgcacccctttgtccattccagagcggcgggcccgatggcacaagcagagaccaagtttggtcattctgcacccatgatacgcggagataccttatggttattcgcaccccttttgtcattcagaggcggcgggcccgatgacaagcagagaccaagtttggtcattctgcacccatga

SEQ ID NO: 15549 - DNA, 522 bp, Glycine max
  Peptide Sequence Number=SeqID_107234
atggcatttccttacatgagcgcaacaatcgctttccatggtattgttggtaccactatcaaagaaaccagtagccatctccgtcaacggaatacacttttgtcatccgggtcagaaaggactgcccctggtgggtacttccttgtggtctcgacatactgcttgatgccccatcgaagcaaacaatccatgttgtcccatgtcctcgtggtccttctctattgcataacaatagcggccatgcctgagattgaatcttcgatgtctggcagatcccgtgtgggtgcaagtcgtgataatccatggagccagggttggcaaataatctgcatcagccatttgattccctcttacccgaggttttatgtggtgtacttggctacacctagcaagattcgtcccgtgaagtggtttttcaagatagggtattcacaggcctttcggaataacccagtggttgctgacatatacttctttactaagccgagtgatcaccatacgagcgaaacgtcctttccatag

SEQ ID NO: 15550 - DNA, 890 bp, Glycine max
  Peptide Sequence Number=SeqID_107235
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagccagaaaacgatttggatgtggatttcggatctgatgggtttggattcagatgttcaccttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 15551 - DNA, 845 bp, Glycine max
  Peptide Sequence Number=SeqID_107236
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgcgcccaggccccgccgctgcccctgcgccgcgacctctggccctggccggcggcgctctcgctcctctgcgcggcggcgctgctggcgacccggaggagcgcctcgtgagcctcgaggccttcgccctgctgcggccctgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15552 - DNA, 591 bp, Glycine max
  Peptide Sequence Number=SeqID_107237
atgaccatgattacgccaagctcgaaattaaccctcactaaagggaacaaaagctggtaccgggccccccctcgagggccgcagcagggcgaaggcctcgaggctcacgaggcgctcctccgggtcgccagcagcgccgccgcgcagaggagcgagagcgccgccggccagggccagaggtcgcggcgcaggggcagcggcggggcctgggcgcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15553 - DNA, 420 bp, Glycine max
  Peptide Sequence Number=SeqID_107238
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagagacgatgtttctggcagcccaaaagatgggcaaggcaaggataagtgcaggatcgaattacctgcagcccgggggatccactagttctagagcggccgccaccgcggtggagctccaattcgccctatag

SEQ ID NO: 15554 - DNA, 320 bp, Glycine max
  Peptide Sequence Number=SeqID_107239
agacaggcctaggggatgctccccaggccgcagacgcgctgccacctcatcaggctggcccagctggatcatttgatacggagcagtatttgcggcatttggttcgccagcaggcggccaaccaccgggcgcatggttttacttcttttccgtgccctactctagaccagttcagggcagaggtcgcatggcctggagattggcctgaggcccgggcaggagaggcaccagcagaggctcccgacgaggcagatgaggcccgcgaggacgaggagatggccgatttacttgatttcttaggagggagcggagccacatga

SEQ ID NO: 15555 - DNA, 917 bp, Glycine max
  Peptide Sequence Number=SeqID_107240
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttcctggtaagtcaagggtgtattaggcccttgtgtgatcttctcatatgtcctgatcctaggattgtgacagtttgtttggaagggcttgaaaacatcttgaaggtaggagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15556 - DNA, 249 bp, Glycine max
  Peptide Sequence Number=SeqID_107241
atggagcggtatctacaacacttggttcgccaacaggcggccaaccaccgggggcagggccagggtttcactccttttgcgtgccctactccagatcagtttagggctgaggtcgcatggcccgaagattggcccgaggcccaggcaagggaggcgcctgcaggagctcccagcgatgcagaggaggcccgcatggatgaagagatgacggacttgctcggtttcttgggaggaagcggagccacatga

SEQ ID NO: 15557 - DNA, 393 bp, Glycine max
  Peptide Sequence Number=SeqID_107242
atggagaggagtatgattgatgctgccagtggtggagcccttggtgatatgacccctactgaggctaggaatttgattaagaagatggcttccaactcccaacaattcagtgcaagaaatgatgctattgtccttagaggagtccatgagtttgccatgaatgagaaatctgcacatgttgcaagagtctgtggtctatgttcttttgcagatcaccatacagatctttgtccttctttgcatcaatttggagtcaatgagcaacctgaagcttatcctgcaaacatttataatagaccccctcagcagcaaaaccaacaacagcagaataattatgatctttcaagcaacagatacaatccaggacggagaaatcatccaaatctgagatag

SEQ ID NO: 15558 - DNA, 408 bp, Glycine max
  Peptide Sequence Number=SeqID_107243
atggcgaagccaagaaacattttgctaactctgaaggaacataatgctaatagttacaacacctattgccaaaacaaaacttgggtagtcagactcccactactcgattttgttggggtgacactcgactgggatgacattctcttgaccggttttgcatatgtggaggacgcgttaataatggttgggctttacaacgctttgaggccatgttttttaaagttgatgccctccctgggggttgaatttgctcactcgtctttaaaaagactgttacaaaatagcattggagacttatgcaatgtgtgggatgccatgaacaacatgattacgttgcagcacacagagattaaagcatcatttgaaacaagtacacatgtcgttggacatgtgttccaaaaaacctaa

SEQ ID NO: 15559 - DNA, 465 bp, Glycine max
  Peptide Sequence Number=SeqID_107244
atgggtgacatagaagaggtgcaggaacaaatgaaggccgatatggtggccttgattgatcaaatggcttccatgatggaagccatgttaaccatgaagagaatgatgaaaagcaacacagccacaattgtcgctgccagcgccgccactgaggtgttgggcagcatcagtggtccatacatcgggtataataggaatgcttatccctatggcttaccccccaattatacgccacctaccatgcacatgcccaacgagaaagctaatcatgccattcttgttgagggtcagcaaccccagcctatgggaggcacccgggggccgcctccgacagtggaagggagagagaaaattgatcgcatcaatgacagattaagggctatcgaagggtttggagattaccctttcaccgacatgacaaaattttgtttggtacctgatgttgtcatccctccaaagttcaag

SEQ ID NO: 15560 - DNA, 828 bp, Glycine max
  Peptide Sequence Number=SeqID_107245
atggggtggttaggaataccgagaaaatgtttggaggcaaaagcaagaatcttggcaggtaaaggcgagtgggccccgttcatagatattctcgcattgttgattttcgggggagtcctctttccgaatatggatgggttggtggacctggcagcgatcgacgcttttcttgcctatcataaccacaaggaaagcccggttgtcgctatgctagccgacctatatgacaccttcgaccgaagatgtgagaagagcagtacgaggattgtctgttgtactctcgctctttatgtatggttggtttcacactttttttgccaagtggtaaggcatgcttgcccgttagaaggtcaccgttcatgcacagagaaaggaggcgcaaattgggaccaaatcttatcaaacaaagaaggagcgtctgtcaactggttccctcgatggaaagaaggaagaactagagttcttgtctcgtgcggaggattttcgaatgttcccttgatggggacaaggggttgcatcagttacaatcccgttcttactataagacaacttggctaccctatgagaggggcaccacaagaggaagagctcgcacctatcatttcacgagcgttcagtgagaccaacatggagacacttcggaaggtccgcaaagcatgggaagtggtacaaaagaaggagaaagagctcagaggcagcaacaatgggcccattggtggctaccataagtggttgaaagcccacgtgcaaggtttggattggctcccaagtctgaggaccgctaaaagggaagaagttgaggcaccggaggaagacgaagaggtgcag

SEQ ID NO: 15561 - DNA, 242 bp, Glycine max
  Peptide Sequence Number=SeqID_107246
atttcatagctcttttagagcacaaaatttcatgctcttctcttcctctcccttcattcatctccttcttcctccaagctcttattcatggcctcctatggtgcggcgtctcctctctcgcttccttctcccttccgctaccattcatcttccaagaagcaaaggaatccattgatgaaggagatcctaggcctagaagctccaatggagcttacatcaatctcaagcggttagtcctttga

SEQ ID NO: 15562 - DNA, 111 bp, Glycine max
  Peptide Sequence Number=SeqID_107247
atgacatgcgggggtaccttatggttatctgcacctttcttcaaccaaggcgaacgagttagatggtgttactttcgtcatccaaagacattcaagtctgacgacgcataa

SEQ ID NO: 15563 - DNA, 492 bp, Glycine max
  Peptide Sequence Number=SeqID_107248
gcgctggcgccgctcggcgtgacgctggcgggcgaaggcgagccggcttacggcgcggagctagccggggcaaacgatgcctctttatgcctctatcaaagcgaagataaacccgcgccgctgcatatcgccttttgcgccgagagccgcgagcaggttgacgccttctggcacgcggcgctggccgccggaggcaaggataacggcgcgccgggattacgacctaattaccccgccaattactacgccgcctttgtcattgcgccagatggacacaatatcgaagcgggccgtgccgtaggcgcggatggcaaagtcatcgccctcggtgcggaacagatattcccaccgatcgccgaggtacatgctggtcagcagcggaagttccaggctgtaatcctgcggcgagcagtcaaggcgcagccgttcgacgcggatcaccgccgtcgccggctgaccgacgctgaccccctcgcccgcgcggccccatag

SEQ ID NO: 15564 - DNA, 114 bp, Glycine max
  Peptide Sequence Number=SeqID_107249
atggcagcttatggtggccaccggtggtcgtgggtgggggagaagaaggacatttgtctcactaagagagatgtcaaaggttttatttctcaaatcccaacggttaaagtgtga

SEQ ID NO: 15565 - DNA, 456 bp, Glycine max
  Peptide Sequence Number=SeqID_107250
atggttttttgggaggtgtcagaccctaattttgtccggggactaccattcactgatgttttgattcttgatagccgaattgcggtgttcgacaccaaccccagctcgcccaagctagcatctggctcgcctgggccatggaattacctcctggctaagcagccagctcgcctaggcgagcttaaaccaccccaaggtgactattttcctataaataggcatgatggggggtgttttaaggggttgggaggttcaacactaaagggaattgagagaattgagagaaaagaagaagaaaagagaaaaagaagaagaagaaagaagaggaaacgaagccaagatgctaccaaattgcaaccgcgatcagtccctacgtcgtttcttattctatgttcttcgtgcggggtcccccttgttattatgtgcacattcatctcctcgatctatcatcggtaa

SEQ ID NO: 15566 - DNA, 237 bp, Glycine max
  Peptide Sequence Number=SeqID_107251
atggtgagcaaagtttggagctttgatggaggcttcaatggtgaggaagaagaagggaatagcaacatgagatccctcgcgtttctctgcacccgtcggggcctgttttcaaaagtaagcaatatatatatcaaaacggaatggagaaggaagaaagatgattggagatgccacttcaaggagaagatgagtcaagaacaagctcaccaccataggaagtcatggataagagcttga

SEQ ID NO: 15567 - DNA, 195 bp, Glycine max
  Peptide Sequence Number=SeqID_107252
atggtcacatattatagccatttgatggctcttgaagaaatcatgttaaaagttttgtcgcaacgtgcccttttgcgggcgagcgaaggcgaggctcacgggtgcgctttccaaagaaggaaagatgcgcggagtcgccaccaacgtttatttgtggaaaacgtcgggaaaaccgaaggaaaccggtcaaaataa

SEQ ID NO: 15568 - DNA, 556 bp, Glycine max
  Peptide Sequence Number=SeqID_107253
tgccgcctcagagtttgatagtcaccgttttcggtgtgtcgagcaccagcagcgcttcgagaccatcaagggatggtctttccacagggagaggcgtgtccagctcagggaagacgagtatcctaactttcagggagagatctctcgcaggcattgggcacgaccagtgactcctatggctaaatttgacccggagatagtcatagaatttaatgccaatgcctggcctactgaggagggggttcgggacattgctcatggccagttcttgggcgacccactgattttgaaggaagaccagcagtgtgaattcagccagaggaggagccaggcagacagtttcggtgaggaagtcatcgcccaactgctgtgcataccggggcaggattttgcccggaccgctgcaggcaggcgggtacggatcatgcgcaccagcatgactaccttgacccagatatggatgacactgctgcatagcaatgtcttgcctagcgaccacaactctgacctccctctgcctaagtgtcagttggagtatgcatcctcacacagatga

SEQ ID NO: 15569 - DNA, 354 bp, Glycine max
  Peptide Sequence Number=SeqID_107254
gaactggttggcgaagttggcggcctgcgtggtggtttcttcgtggtgtttttccgtcatggcaacccctctgtgggtagtctgatagaaccgggggcccgccgcactggcgtggcccgtcgggagcgcggggtggacatggcctcccctcgttgcaagccttggcggaatacgtcggcgctgcggatcagatttccatcagttcgaagtcctctttgcgggcgccgcattcaggacagacccagttcggcggcacgtcttcccagcgggtgccgggcgcgatggcttcgtcgggcaggcctgcctcttcgtcgtagacccagccacaaatcagacacatccaagtacgcatag

SEQ ID NO: 15570 - DNA, 186 bp, Glycine max
  Peptide Sequence Number=SeqID_107255
atgtcggtacaggcgatcaaggtgggcggactatacaccgccgaaacggcaagcgtggccgcccaggtagcggccgattacagccaggtgccgctggtgctgcacctgggccagcgcgcccaggtgccggccgacgccgccgacgaggacgaggccgacgatctgctggcggccgttcttgagctg

SEQ ID NO: 15571 - DNA, 1039 bp, Glycine max
  Peptide Sequence Number=SeqID_107256
agggcaccacgccctcagctacagaggactacacgtcctcgccatcggagggctgcaaacactaaccttcagaggactacacgtcctcgtcagtagacggctgcacaccctcatcattagaggactacacgtcctcgccatcagagggctgcacaccctcgcctttagaggacttcacgtcctcgccctcaccttcaaaggacaacacgtcctcaccatcagagggctgcacgccctcagcttcagaggactacacgtcctcgatatcggagggctgcaagacctcacatttagaggactacacgtcctcgccatcagagggctgcacaccctcccctttagaggacttcacgtcctcgccatcagagggctgcactccctcgcctttagaggacttcaagtcctcgccatcagagggctgcacgccctcaccttcaaaggacaacacgtcctcaccatcagagggctgcacgccctcagcttcagaggactacacgtcctcgccatcggagggctgcaagacctcacctttagaggactacgcgtcctcgccatcagagggctgcacaccctcccctttagaggacttcacgtcctcgccatcagagggctgcacgccctcaccttcaaaagacaacacgtccttgccatcagagggctacacgccatcaccttcagaggactacacgtcctcgccatcagaggcctgcacaccctcccctttagaggacttcatgtcctcgccatcagagggctgcacgccctcaccttcaaaagacaacacgtcctcaccatcagagggctacacgccctcagcttcagaggactacacgtcctcgccatcgaagggctgcatgccctcaccttccaaggactacacctcttcgcaatcagaggactacacgtcctcgcctgtagaggactacacgtcctcgccatcagagggctacacgccctcaccagcagaggactacacgtcaacgccatcagaggcctgcacgccttcgccttaagaggactacacgtcctcgccatcaga

SEQ ID NO: 15572 - DNA, 336 bp, Glycine max
  Peptide Sequence Number=SeqID_107257
atgcatctgactaagacaagtatgcgagcggggaattccaatgtgtatggattcctcgagccacagtccattcagagatttgggcaatcgcagtttgaatcggaaagttacatgaagagttggatgcagagttcacaacgcgatgtctaccttggagcctacctgaatggcggacactggcagatggtcgtcattctgcctgaggaaaaccttgttgtctggttttgttccttgcataacaggctagacaactaccttaagggaataattaacagtgtaatagacaaaaaggaagcactgagtgcggctattacgtcaagcactggatgtccatga

SEQ ID NO: 15573 - DNA, 175 bp, Glycine max
  Peptide Sequence Number=SeqID_107258
aaaatttcgtgctcttctctccctctcccttcattcatctccttcttccttcaagctcttatccatggcctcctatggtgaagcaaaggaatccattgatgaagaagatcctaggcctacaagctccaatggagcttgcatcagccctttttcaactcaccgtgcgtgcaaatag

SEQ ID NO: 15574 - DNA, 270 bp, Glycine max
  Peptide Sequence Number=SeqID_107259
atggctgctagtgaccaagcaatcttgcgtgatggagcacacatcccaaccaaaagaaacctgttggagctttcatcacaggacgctttgttggccaaaaacaagttgttatctgtgaaaaagagactaagttttgaattttcaaaaagtagcagttgggctaagcgcatatccaccgctaagtgcagcttcaacgcgcttagcgcaagggagaatctggcagagcatcagcatcaaagctgcgcactaagtgtgagatcagtgtgctaa

SEQ ID NO: 15575 - DNA, 411 bp, Glycine max
  Peptide Sequence Number=SeqID_107260
atgctcgaaagttttcaacaacaagaacaaatgtcagttctggaattatacataaaaaaggatgtggctggtggttctatgtttcattttgcaaattctcttacatcatgtgaaaataatttatctaatattgagacacaaccaccaacaaatgtgagcaatttacatggtgacaaagataatgattatgatgatgattattattttgtgtctaactcatacgttgaagagtctttagacgaagatgacagtgttgacggtatatctgatacagacgatgaagtcaccgacatgattcaaccagtgtataaggaattcaaaatccattttggaatgatgctttgcattataacaatatcaattggagtcatcctgatgaggaggacatttgcggtttggagatgccgttga

SEQ ID NO: 15576 - DNA, 377 bp, Glycine max
  Peptide Sequence Number=SeqID_107261
atgaaggctgacatggaggccatgaaagagcaaatgaccacaatgatggaagccatgatgagtatgagaaggatgatggaggtcaatgcagctacaattgttgcctcaagtaccgccacagaagtggacccgacccacccacctagcttcaatcaagtaaatcatccagccttggatgtggtaggtcagggaggcaaaacgttaggaagtgcaggcgacccccattttgtacaggttcagaacaagcattccttcccactatatggcttgcctcctaactatacaccacccaatgttgcacacactcctgatgagaatgttgacaacccgcacccatacccattgagagccaacaaccccaatctgatcatgcacat

SEQ ID NO: 15577 - DNA, 234 bp, Glycine max
  Peptide Sequence Number=SeqID_107262
gaacatgagatggaacttcaacggctaaatcaaaatgaagaaactgacaagaggaaacgaagtatagcactaaaagcctcctcatcaatgcaagaggaatatgaagatgaagaatcggaagatgaagaggacttttcactttttgtgaagaagtttcacaaatttgtcaagaatagaagaagcgagaggcgtcaaaattttaaccatggaaaagattccaagaaggctctctaa

SEQ ID NO: 15578 - DNA, 108 bp, Glycine max
  Peptide Sequence Number=SeqID_107263
atggagggtggagatgttcctttgtctgaaatgctaggcacattttccctgtctgtcggtgctgttggaggcttctctccgatgtactttgatttccttggaagatga

SEQ ID NO: 15579 - DNA, 444 bp, Glycine max
  Peptide Sequence Number=SeqID_107264
atgaccatgattacgccaagctcgaaattaaccctcactaaagggaacaaaagctgccttggtgttatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15580 - DNA, 201 bp, Glycine max
  Peptide Sequence Number=SeqID_107265
atgacgggtggatgcatttttgcggagcacgtactacctatggctgagctttgtctaatgcctgggcaggtatctgcggattacatggagtggttttttcgcatatctcacacattcatgataccgacccaggcaagtgaccagcccagagatgcaccagccgcagaccctgagagtacaatacagccgcccagcccccag

SEQ ID NO: 15581 - DNA, 635 bp, Glycine max
  Peptide Sequence Number=SeqID_107266
ttaccctcaccgttgagaggactacacgtcctcgccttgaggggactacatgtcctcaccatcagagggctgcacgccctcacctccagaggactacatgtcctcgccttgagagggctacacgccctcaccttggagggctgcacgccctcacctccagaggactacacctcctcgccttgagagggctacacgccctcaccttgggtattacttaccctcaccgtcagaggactacatgtcctcgcctgcagagggctgcacgccctcacctccagaggactacacctcctcgccttgagagggctacacgccctcaccttgggtattacttaccctcaccgttgagaggactacacgtcctcaccttgagaggactacacgtcctcaccatcagagggctgcacgccctcacctccagaggactacatgtcctcgccttgagagggctacacgtcctcaccttgggtactagttaccctcactgtcagaggactacacgtcctcgccttgaaaggactacacgtcctcgccagcagagggctgcacgccctcacctccagaggactacactccctcgccttcgaaaggcgacacgtcctgaacttcagagggctacacgctctcgcctttag

SEQ ID NO: 15582 - DNA, 216 bp, Glycine max
  Peptide Sequence Number=SeqID_107267
atggaccacaacttcctcattagtccatccagtccgaaaagtctgaaccatcctctaggtggtgccggtggagctggtggaggtggtataatctcaacctccgaggaagccggtgggtctactactggtcgttgcgactcagctggtgcaggctctgtccttgttggtatgggattggggggcacaacctcgggagatcttcctaacggcagctga

SEQ ID NO: 15583 - DNA, 288 bp, Glycine max
  Peptide Sequence Number=SeqID_107268
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggttgcgcaaatgttgggaagggcgatcggtgcgggcctattcgatattacaccatctggcgaaagggggatgtgctgcaaggcgattaagttgggtaacgccagggttttcccagtcacgacgtcgtaa

SEQ ID NO: 15584 - DNA, 252 bp, Glycine max
  Peptide Sequence Number=SeqID_107269
atgagtcttcattcttcatctagtgttaatggaaggcataggtcacatcttagacctcactcccataggagagaaaaggaaagaaagcctcaagaggcctacattaacctcccatactttcatgggaaggacaatgtagaggctaacttagattggaaaataagggtagagaacaacttaaaaggaagtctacttcaaaatcttaaggctctcactcttgtccaaagaaagaccaaggtcaaggcatcttag

SEQ ID NO: 15585 - DNA, 594 bp, Glycine max
  Peptide Sequence Number=SeqID_107270
atgatgaggacaaatcaaaacggcaaaaggttttatcaagtcaaggttaaaggtctagatgtcactagcctcaaggaattaggacgattgatgggacctctccaaaggcaagccttccgcaaagtgtacgggaagattctagatttgaccgtagcggaggtatttacggaagctgtcgtgtccctcgcccaatactatgaccagctgttgaggtgtttcacgtttggggacttccaaatagtaccaactattgaagagtttgaagagatattaggatgccctctaggagggagaaaaccgtatcttttctccggctttcttccttccttgagcaagattgcagctgtgattggggattcagcaaaagagttggatcgcatgaagcaaatttggaatggaatagtgggcctgccacggaaatacttggaaggcaaggcaagggatatggcgagccaagagaagtggggcccgtttgcggatattttagcttcgttgatttttggggttgtcctctttccgaacgtggacaatttgatagacttagccgccaatgatgctttcctcgcatatcaccatagcaaggaaagtccaatg

SEQ ID NO: 15586 - DNA, 335 bp, Glycine max
  Peptide Sequence Number=SeqID_107271
atggaagccatttccaagtggtttgaagagcttgatatatgtgtcaaagtgattctaaagagtaaacttcgggaaattgtctaccctaatctaaattggatgtgtgctccttctgaaaatgtcaaaacaaaaggtatggatgaagattcatggtctttggttcgtaatcatttgctgaaagaacttggacaatggcctgatgagtatatatacctgcttgatggcataaacaaatatgaggatttagagcagtcgctacttgttgatggattatccatggtaaccatggataagtggatgaatattagtgatatgggttatgtgattgcatcaag

SEQ ID NO: 15587 - DNA, 276 bp, Glycine max
  Peptide Sequence Number=SeqID_107272
atggaggtggtttctgcccagagacttcttgaggtggtcaaacgaaggtcgcatgccgataaacaatggtctaggtacttgggatcaagaatttgcctagaggaaaagagagatgagtaccatagacgttgttcatcagataagaatagtgtggatgatgaaaatgatggtggaattgatgtcgggggtgctccggtggctccgagacatcaaattattgttgcagaagcagaggtgtatgaacccttgcgcttcttggatgattctaccatttga

SEQ ID NO: 15588 - DNA, 732 bp, Glycine max
  Peptide Sequence Number=SeqID_107273
caaccccttaaggctagtatgcaagagaagactacctccatgaagtgctttaaatgtcttggaagaggacactttacttctcaatgccccaccaagaaaaccatgattatgaggggccaagaaatttatagtagccaagatgaggcaagtacttcaccttcctctagtgaaagtgaagaagtaaaaggggaagaatctagtaaagaaatctacccccaagaagaaggacaacctttaatggttaaggaggagtgtaaggagacacttgttagcattgccacacctcttgggcttgagtttattcctcaagtaaaggagttgtttgatgagggtttggttcgcaagagcttaaacccttgtgctttgttggtgcccaaaataggtattattagacaccaaatccctatgataggtgttatgatgaatgtgctgagtagtgcaaccctcttcatgatttgtgtacatagggactcattagggcttcccatggaccctaagagaataaaggtcattcctgagtggcctactccaccatcaccactcattgagttggtgaggaactatgttctctcatgggaagatggtcaggaaaggggttttcaatctttaccctactctaacatacccaacatcaccgaaagcctaaagtttcaagaacctcgggatttgtggtcaaatccttttccagggggagagaatgacgcaatcctacccggcaagggcattggatag

SEQ ID NO: 15589 - DNA, 340 bp, Glycine max
  Peptide Sequence Number=SeqID_107274
caaaagcaccgccgggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatgctacttgggaggctgaggaaggaaaatcctttgaacccaggaggtggagtttgcagtga

SEQ ID NO: 15590 - DNA, 296 bp, Glycine max
  Peptide Sequence Number=SeqID_107275
gtggagctaatattgaagaggaggaactaacagatttgaggtcaaatcctcttcaaggggaaggggataatgcaatcctccctaggaagggaccagtcactagagccatgagcaagaggctccaagaggattgggctagagctgctgaagaaggccctagggttctcatgaacctcagggttattgatgcaatctttcccagaaagggaccagtcactagagccatgagcaagaggctccaagaggattgcgctagagctgctgaagaaggccctagggttctcatgaacctcagg

SEQ ID NO: 15591 - DNA, 478 bp, Glycine max
  Peptide Sequence Number=SeqID_107276
ggtgaaagtgggaacctcttacgtgccgatcaacgtctcattttcgccaaaagtggccccggggtttccgggtatcaacggggacaccaggatttattttttctgggaagtgatctcccgtcacggtggtttctgtttttatccagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatattcgcaagatgtggcgtgttacggtgaaaacctggcctatttccctaaagggtttattgagaatatgtttttcgtctcagccaatccctgg

SEQ ID NO: 15592 - DNA, 411 bp, Glycine max
  Peptide Sequence Number=SeqID_107277
atgtacgttaccagtaaaacaaagttcaggactaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15593 - DNA, 600 bp, Glycine max
  Peptide Sequence Number=SeqID_107278
atggtgaaagttggaacctcttacgtgccgatcaacgtctcattttcgccaaaagttggcccagggcttcccggtatcaacagggacaccaggatttatttgttcactgcgaattacttaccgcatcacaggctccagtggcgtatcatggtttctatcagctgtcctcctgttcagctactgacggggtggtccgctccaattcgcacacaagcataccgagccggacatcagcgcggcaaggcgcgtccgctttcccattcagggaactgcggcaactgcttaatggaacggcacgcgatcggtaggcgggcctttgcgctattacgccagcggcgtaaagggggatgtgctcatactggcgattactatgttggactgatgaacgcgcacgctctagaactagtggttatcccccgggcgcggaattgtccgatagatgggcaggaccaaacttcaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 15594 - DNA, 307 bp, Glycine max
  Peptide Sequence Number=SeqID_107279
ctgtctctcctgttcagctactgacggggtggtgcgtaacggcaaaagcaccgcccggacatcagcgctggcaagtgtagcggtcacgctgcgcgtaaccaccacacccgccgcgcttattgcgccgctacagggcgcgtctcactcgccattcaggctgcgcaactgttgggaagggcgatcggtgcgggcctctttgctattacgccagctggcgaaagggggatgtgctgcaaggcgattaagttgggtaacgccagggttttcccagtcacgacgttgtaaaacgacggccactgaattgtaa

SEQ ID NO: 15595 - DNA, 230 bp, Glycine max
  Peptide Sequence Number=SeqID_107280
tcctacagggtgcccctccccccgacaaggtcacgtcatcatagggatcgcgcctgcaagacacccagtggacccgaagaagtccaacagggtcttggagttgtcaagctctaattacgagtctttgcaggcgcaaggcgaaacaccacaacagcctgaggatggccggcagcgggcaacagacgcaccgccatcacctctagagttcacctcagctcatccacaaaaag

SEQ ID NO: 15596 - DNA, 597 bp, Glycine max
  Peptide Sequence Number=SeqID_107281
atgtggtctatttgcccctttccggagatgtcacatcttccggtggagactttttcaagtctcacaagttatctagaactacgtaggtctgagttcctcattggaggatacgtaggagcaagagccttgcttttgtcggaccgccccataatctttgccatactgaccctaagaggcggcgggcccgatgacatgcggagacaaaatttggtcattctgcaccccttttccattcagacacagtcgtgtccgatggcacgcagagacaaaatttggtcattctgcatccttttgtcatccagaggcagcgggcccgatgacacgcggagacaaaatttggtcattctgcacccctttgccattcagacacagccgtgtccgatggcacgcaaagacaaaatttggtcattctgcacccttttgtcatccagaggcggcgggcccgatgacacgcagggacaaaatttggtcattccgcacccctttgccattcagacacagccgtgtccgatggcacgcagagacaaaatttggtcattctgcatccttttgtcatccagaggcggcgggcccgatgacacacgaagacaaaatttg

SEQ ID NO: 15597 - DNA, 666 bp, Glycine max
  Peptide Sequence Number=SeqID_107282
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacataaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15598 - DNA, 489 bp, Glycine max
  Peptide Sequence Number=SeqID_107283
atgcctcaaaatgttctttacgatgccattgggatatatcaacggtgttggaacctcttacgtgccgatcaacgtctcatcgcgctggggtgttcgccaaaagtgttggcccagggcttcccggatcaacagggacaccggatttttttctgcgaagtgatcttccgtatcacaggtatcttattggcgcaataccgtgcgtcgggtgatgctgccgaactttatgatttagtgtatgagggttatttgagtgctccagtggcttctgtttctatcagctgttcctcctgttcagctactgacgggaattgtggtagcgtaacggcaaaagcaccgccggacatcagcgctggcaagtgtagccgggtgcgacgtgcgcgtaaccaccacacggttaattgctgccgctacagggcgcgtcccattcgccattcggctgcgcaactgttcgggaaacggcgatcggtgcgggcctcttcgctattatga

SEQ ID NO: 15599 - DNA, 174 bp, Glycine max
  Peptide Sequence Number=SeqID_107284
atgcgggacaccagcgatttgcatttttctggaacgattccgtcacagcttatcgggcaaaccctgttccctcctgttcagttgaaattggggtggtatccgcgtccaattcggcacaaagcataccgaccggacatagcggcaagtgtaaagcgggtgccgacgtgcagctaa

SEQ ID NO: 15600 - DNA, 414 bp, Glycine max
  Peptide Sequence Number=SeqID_107285
atgcaagacaaaattgattgcaataaaataaatgagataagggaagagagaaatgcaaactcgatttatactggttcgaccacttcccgtgcctacgtccagtcctcaagcaacccacttgagattttccactctctttataaaaccccttttaaaaagtctaaaccacatgtcgcaacctacccttcggcgggagggcgacgcgtgactcgcgggatgcgtgttccacgaaaggaatacgcgcggagtcgccaccaacgtttatttgaggaaaacgtcggaaaaatcggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 15601 - DNA, 929 bp, Glycine max
  Peptide Sequence Number=SeqID_107286
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatttttaaaactactattcttaaacctcacattgatgcaattaacgcgaaaacagaacttactgtggaatttaaagctcttaaaaaagagggacgtaaagctagtcatgttaattttaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15602 - DNA, 93 bp, Glycine max
  Peptide Sequence Number=SeqID_107287
cgagtggattttgtggccgatttaggggtggcctttgtggctgattgggtgttcttggttggaagggtgatgggtaatggcctttgtggttga

SEQ ID NO: 15603 - DNA, 318 bp, Glycine max
  Peptide Sequence Number=SeqID_107288
atgtctcttgctactttgtttggaaagttacaggaacatgaaatggaattgatgagattgaatcaccatgaggagaatgataataaaaagaaaggaatagctcttaaagcttcatcttcaacccaagaaggaagtgataaggaggattcaattgaaatagatgaagatgatgatctcagtctttttgtaaaaagattcaacaaatttctaagagtcagaggaaatcacagaagatcaaattttaaatcacagaaaagggcagaagattcatcctttactccaaaatgttatgaatgcaatcaacctggacatctgagg

SEQ ID NO: 15604 - DNA, 852 bp, Glycine max
  Peptide Sequence Number=SeqID_107289
acatcagtttcgaaaacaactcaaattctcacaaagtttgtctctgctaacaatggtacttatgatgtcatcaatgcataccttcaccgagcttctgcatctttcaacgagctcaaccacctccacaaggaccttggatcatgtgactctcataacaagcacaaaatgcacagaacagagaatggtaatgacagtgggaaggtagtgggaaattttgttcaaagtgttgatattaacaaggagctgagccttcggcatgtgaaatttgatcagttcaaaaggcaacaaagtggcagtgggaatgctgatggtgaaaattttagtcaacaagaagaacaagaaaatgtggatgggggtgaaatgcataagaagaagaaaaagaagaaggaagctgatggaaagcatgttagttctaggaaccctacaattgagaaatgtagttctatgttgttgatggaaagcatgttagttcttggttggggtttgcccgacagcaagaaaccctttttgtggatcattaggcctgaccttgtcattggaggagcaagtgttgaaccatccttggtggattcttcactcattgtggatggaactcaaccactgaaagtgtttgtgctggagtaccaatatcagccaacaaactgcagatatatctgcaatgaatgggaaattgggattgaaattgataccaatgtgaagagagaagaggtggagaagttggtgaatgacttgatggtgggagagaaaggaaagaaaatgagacaaaagatcgtggagttgaagatgaaggcagaggaagccactacacccagtggtttttcattcatgaacttggacaaattcattaaggag

SEQ ID NO: 15605 - DNA, 324 bp, Glycine max
  Peptide Sequence Number=SeqID_107290
atggaagtgagggacaaggttaaactccttccatataggaacctagatgacctagtccaaccttgcataagggtagagcaacaacttaaaaggaagcctacttcaaaatcttatggctctcactattatccaaagaaataccaaggtcaaggcatcttaggggctgcaccttctaagcccaaagatgataaagggaagacagtagaaaagcaaacccccaaggctagtataggacacattgcttctcaatgccccaccaagaaaaccatgattatgaggggtcaagacattgctactacttcaccttcctctagtgaaagttaa

SEQ ID NO: 15606 - DNA, 553 bp, Glycine max
  Peptide Sequence Number=SeqID_107291
aggactgcacgtcctcgtcttcagagggctgctcgccctcaccgtaagaggactacgcgtcctcgccatcagagggttgcacgccctcgccatcagagggctgcatgccctcaccttcagaggactacacatcgtcgcctttagagggctacacgccctcgccttcagaggactacccgacctcaccttcataatgctgcacgccctcgcctttagagggctgcacgccctcgccttcaaagggcgacacatcctcaacttcagaggactgcacgccctcatcttcagaggactacacgccctcacctttagaggactacacgccctcaccttcaggggactgcacgtcctcaccttcagaggactgcatgccctcacctttagaggactgcacgtcctcaccttcagagggctgcacgccctcgccttcaaagggcgatacatcctcaacttcagagggctacacgccctcgcctttagtgggctacgcgtcctcactttcagtgggcttcatatccacaccttaagagaatttaaggtcctctgcccttaa

SEQ ID NO: 15607 - DNA, 634 bp, Glycine max
  Peptide Sequence Number=SeqID_107292
agcactacacgtcctcgccatcagagggaagcaccccctcaccattagaggacaacacgtcctcgccatcagagggctgcacgacatcaccttcagaggactacacgtcctcgccatcagagggctccacgccctctcctttagaggactacacgtcctcgccatcagatggttgcacgccctcaccatcagaggactacacgtcctcgccatcagagggttgcacgccctcatcttcaaaggactacacgtcctcaccatcgaaggcctgcatgccctcaccttcagaggactacacgtcctcgccatcagaggactacacgtcctcgcctgtagaggactacacgtcctcaccatcagagggctacacaccctcaccttcagaggactacacgtcctcgccatcagagggctgcacgccctcaacttcggaggactacacgtcctcgccatcaaggggctgcacgccctcagcttcagaggactacacgtcctcgccatcggacggctgcatgccctcactttcagaggactacatgtcctcgtcatcagaggactacacgtcctcgcctatagaggactacatgtcctcgccattagagaattgtacgccctcacctttagaggacaacac

SEQ ID NO: 15608 - DNA, 1104 bp, Glycine max
  Peptide Sequence Number=SeqID_107293
atggtggaggagaaagttggggaatgcttgtgcaatggcttgaagcaaattgagggagaaaaacaaaagaaggtaaagcttgattatatgaagctttcaacatcagggttggggcaacagggacatgaagggactcgtggggtttacttccctcagggccatagtgagcaggttgctgccacaactaacaaagaaattgatggacacattcccaattaccctagtttgccaccccagttgatttgccaacttcataatgtcacaatgcatgcagatgttgaaacgaatgaagtatatgctcaaatgacattgcagccattgactccggacatttacgatgttgatgtgttcatgaaaagcatggaaggagtggtcagagtgttaagggatcttccttctcatgtatcaacacataaaattgccgccatgaagatgagggcgtgtagtcctttgcagatgagggcgtgcaaccctctgatggcgaggacgtgtagtcctctaaaggggagggcgtgcagtcctctgatggtgaggacgtgtagtcctctgaaggtgagggcgtgcaaccctgtgatggcgaggatgtctagtcctctgcaagtgagggcgtgtagccatttggtggcgagcacgtatagtcctctgcaagtgagggcgtgcagccctctaatggcgaggacgtgtagtcctctgcaagtgagggcgtgcagccctctaagggcgaggacatgtagtcctctaaaggcgagagcgtgcagccctctgatggtgaggacgtgtagtcctctgaaggtgagggcgtgcaaccctctgatggtgaggacgtgtattcctctgaaggtgagggcgtgcagccctctgatggcgaggacgtgtagtcccctgaagctgagggcctgcagccctctgatggcgaggacgtgttgtcctctaagggtgagggcgtgcagccccctgatagtgaggacgtgtagtcctctgaaggtgacggtgtgcagccctccgatagtgaggacgtgtagtcctctgaaggtgagggcgtgcagccctctgatggcgaggacttgtagtcctctgaaggtgagggcttgcagccctccaatg

SEQ ID NO: 15609 - DNA, 387 bp, Glycine max
  Peptide Sequence Number=SeqID_107294
atggcgtcatcgaccctccatccgatcagacgccacgtgaagtggaagatggcccacacgaagaaaacaggggagatgacgactgaggccacaaaggaaatcgctgagaagatcgatgttctcaccactgctattggatgtccagagcaccttggacgtgtccgtgttgctggagctggtgtcaccatcaagcaatactttggatcggctccacgaacgtcccgcagctcttcctccctgcctcctgaagaattgcagcagctgacccaacaaatcagggaccagctagaggagtccatcacagaaaaagtgatgcggcagctcatggcatcgttcagccagatgcagtcccagatgcaatctcagggacttgcactgcctccgtaa

SEQ ID NO: 15610 - DNA, 174 bp, Glycine max
  Peptide Sequence Number=SeqID_107295
atggcagctcacggcggccaccggtggtcttgggtggtggaaaataagctttgggctgctcagcgcaattcccatcggttggagttgcgcttagcacgccatactcgcttagcgggagatcaaaacttattattttcaagatcccaacagtcagattgtagaaacatatcttag

SEQ ID NO: 15611 - DNA, 672 bp, Glycine max
  Peptide Sequence Number=SeqID_107296
atggcaaaaccatcgaagaagcgaaagggcgtttcgacttcatccgcagtcacaggaactcgaagccacggagcatccaaagcacatacaactcaaattcctccctctatatcatctcctatgttgttttcctcgaaagaacaatgtatccgtgacggtgtaccgtttgagggtacacttgatgatgagtggaagttcaatttctctgtttctgatgcccgccggatggtttgcaccaatcaagccgatatgatcggaaggcttcttggcggttcattggcattcgaattatgcatcatgcactacttgattatgcacatcctactccctagatcatccaaccttgcacaggtttctgaggaagatttgataattatgtgggttttcttaaccggtcatcaaatcgactcagaccatcttgtgagatatcgcatgcataaggcattgcgatcaaatgctccacttctatatcctcattcgatcaccttgttcttacaacatcttaatgtccctcttgactctgaggcttttgttaaagtcaagagatctttctctatcggtgcgaatgtgatctcctcttttggataccgcaaagagagggatggttcttgggtgaagaaagacgcaccagcacaggccgcagaagaccgttctccatcaccacatccttag

SEQ ID NO: 15612 - DNA, 192 bp, Glycine max
  Peptide Sequence Number=SeqID_107297
atggcttgcacccacattccggtgaaagttgagatatttacacgtgattctcctcaaatttcagccagcccgcatcaattagaccttgcaccttacgctttagggccctacaatgctcaatggaacgccccggggcttctccatgacaagcacacgttgcaatcccagagtataaagaacctcaagatttga

SEQ ID NO: 15613 - DNA, 156 bp, Glycine max
  Peptide Sequence Number=SeqID_107298
atggaccctaagagaataaaggtcattcctgagtggcctactccaccatgtgttgaggaaagaatccctgagtttctagaacctatgtatttcaggtccaatccttttcaagggggaaggaatgatacaatcctacccaacaaaggcattggatag

SEQ ID NO: 15614 - DNA, 921 bp, Glycine max
  Peptide Sequence Number=SeqID_107299
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtgtgcttctgctggagtaactcggttatatctcgaaccagtacgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagccgtttttccataggctccgcccccctgacaagcatcacgaaatctga

SEQ ID NO: 15615 - DNA, 507 bp, Glycine max
  Peptide Sequence Number=SeqID_107300
atggagaaaactaagaaactgaagtcgggagaatggatcaatgataagtcctttgaatttgttgaaaaatatcaacatcgtcaagaggaaatcttacaacatttgacaaaggaaagcacatctacacaggattcccctaacattgttacttctgttaatgataatgaaatatatttgaatgttgttgtaggtctaaattacaaggggaacgtgtacgtgctaggtactttgagcaaaaggtttagatgctcaaaatcagctccatctacttctattgctcctgtggaagaccaaatagaggagatgcgtgagacaattaataaattgaatgttgaatttttggcaaagacaaataaggagaggacacttaaggaaaagatgttgcagctaatagagaatcatgaccaccaaagtcaggagatgcgacaacagatgcaagagcaaaatgagcaaatttgtcaacaaaatgagcaagtgcagcgtatattacaacacttgcatgtttag

SEQ ID NO: 15616 - DNA, 288 bp, Glycine max
  Peptide Sequence Number=SeqID_107301
atggataactgtgatggagttgtgtctagtgaagttgtggtggctttttgtggtgttgttttgatatattcaaatggcaagttcataaaggtcttctttaggagatttggtttctgtactgaggctaaaatggagcatttgcatgttgctgctaatagtctccaagtcgtgatgcttattgatgattttatgcattctaagggccaattccatgaaataatctcaaaaaatatggaagatgaaggggagtttcataagctgcacttttggccatattggcagagatga

SEQ ID NO: 15617 - DNA, 339 bp, Glycine max
  Peptide Sequence Number=SeqID_107302
ctcagatggaggtgggcaataggggatggtgggtttatgcgcgcattgtggatgtggaaaacttgttgtgcaccatcgcccgaccgccacctaagtggtacctcgagatatgtcgcgggggtcaggacctttgggacgtcaggcgagctcctggcagtcaacagataaaaggaacaaagaccacaaagcgaggaggcttgtggtggctggccagttgtgaattttgggtgatatgtggattatggcctctgctaatcgattaccaaggggttgaaaatgaggcctctggtaatcgattaccagcctgtgtaatcgattacacagagggatgggtcactg

SEQ ID NO: 15618 - DNA, 210 bp, Glycine max
  Peptide Sequence Number=SeqID_107303
atggaaacttctggacgagccattgacctagcccaaaatggccaaaaacattcttttacatttgataaagtttttacaccagaggcatcacaagaagaagtttttctagaaatttcacagcttgtacaaagtgctcttgatggttacaagtcttgtgagacacatgtctatctgttagatttggtgttggatgttgcctttctagcatga

SEQ ID NO: 15619 - DNA, 504 bp, Glycine max
  Peptide Sequence Number=SeqID_107304
atggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgtgccattgatttagatgaattagctgttgcggcgctcttctcttttctaaagcaaggaatttcctttcattcataa

SEQ ID NO: 15620 - DNA, 252 bp, Glycine max
  Peptide Sequence Number=SeqID_107305
atgaatatcgaggaatccattcatgttacctttgatgaatttaatgctatcttgtcaagaaagaatatgctagacgatattgcagattctttagaacatatgaatattcaggaccaagattccaaaggaaatgataaaggaaacaatgaagatcctccagaagaagtcaaatccaatgatgaacttccaagagaatggaaagcttcaagagatcatcccctcgacaacattattggtgatatctcaaaaggg

SEQ ID NO: 15621 - DNA, 683 bp, Glycine max
  Peptide Sequence Number=SeqID_107306
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtaacgccaggttttcccagtcacgacgttgtaaacgacggccagtgccaagcttgcatgcctgcaggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacgg

SEQ ID NO: 15622 - DNA, 222 bp, Glycine max
  Peptide Sequence Number=SeqID_107307
atgtggcacacactcccaatgagaatgtcaatgactccacttcccatactcattgagagccaacaacctcaatctaatcatgcacctatccctcaacccttgggggggacacatgaaataccccacaacaatctagccaacttcgagcctggcctcgaatatgccactgaagggaaagaagttgatggtgtacccctgccaaacacattggagggcccttaa

SEQ ID NO: 15623 - DNA, 267 bp, Glycine max
  Peptide Sequence Number=SeqID_107308
atgtaccctccactagaactgatccacaagagatttaccctctcttgttctcagtcaacaaaccaagtagatgtaccctctacttgtaccacaaaggatgtaccctccaatgtgttaagacaaagttctcaagcgggaaaagggagacacaaaagaattcaggcgattagtccttcgttcttttggaaaagggagaagagagacacaaaaagaattcaggcggttagtccatggcaaattctttttggaaaagggagaagggaatga

SEQ ID NO: 15624 - DNA, 405 bp, Glycine max
  Peptide Sequence Number=SeqID_107309
atggcgcccttcacatatgcatgtagcaaatacaataaggaagttgtgcttaggtataggcttgaggtgatgatcaaccacggagatgaaaacacaaaattcctgctttgggaccgtgaatgcagtgaattaattggtcaatcagctgatgcagttaataagcttaaaattgaagatggtaatgttgatttgaatgcttcaccccaagcacttgataagctgctgggttatgaacttgctttcaagataaaggtgcaacccaagttcaagaattctcctgttttgaagtgttcaactgactcaagcttaataaatgttgtgatggatatgctagctgatgttgagacatcttcaaaaatgaatatcccaatttctgattccaatcattctgcccaacatgaatct

SEQ ID NO: 15625 - DNA, 834 bp, Glycine max
  Peptide Sequence Number=SeqID_107310
atgcgtttacaaaacaacatgcaagcaacagatcaagaagaaactgcagcttttgcacaatggattatagatattggtgatggtattattggagatgaaaatgatggctatgctactattgaaattccacaggaactattaatcacagaatataatgatcctattcatagtataattagctctacatttccagatctatctcatcatcacaatgatcctgaatacttccaaaccagagcaatattagcttccacaaatgaaacagtgcaacaagttaatgattatatgcttacaatgataccgggtgaacaaatggaatatctaagctctgattcagttgacaaatccgaaaccattgaaagttgtcatttccgctcactgacaactgaatttctgaattcattgacaacatctggcttatccaatcactgtctcaaactcaagattggaacaccaataatgccattaaggaacttagaccaaactcaagggttgtgtaacgatactaggttaattatcacaagactagcaaaacatgttattgcagctgacataatttctgggacaaatatcggagatcatgtttacatcccacgaatgtctatgtcgccttcacagtcaccatggccttttaagctattgaggagacaatttccgataatgctttcttatgctatgacaattaataaatcccaaggacaatcactatcttcagttggactttacttgccaaaaccatttttttcgcatggccaactatatgttgcattatcaagagtcaagtcaaagaaaggacttcgaattttaatacatgatcaggacaaaagaaaatga

SEQ ID NO: 15626 - DNA, 194 bp, Glycine max
  Peptide Sequence Number=SeqID_107311
cgaggaagcggaaaagcgcccaatacgcaaaccacctctccccgcgcgttgtccgattcattaatgcagttggcacgacaggtttcccgactggaaagcgggcagtgagcgcaacgcaattaatcggatatcaatttcacacaggaaacagctatgaccatgattacgaattcgagctcggtacaaacgttaac

SEQ ID NO: 15627 - DNA, 402 bp, Glycine max
  Peptide Sequence Number=SeqID_107312
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggagatggatggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 15628 - DNA, 267 bp, Glycine max
  Peptide Sequence Number=SeqID_107313
atggtggggtacgcaccttcaagctttgcggatttggtcttcgccggcaaaagaatcgaagcaggtctgaaaagaggcaaatttgatcatcctgctttgatgaatgagaaaactggagcaaatcaagatgatgagaatgaggaaggaacccatgttgaggttgccattcctacatggccaaatttcccatcagcccaacaatgtcattactcagccaatatcagctcttctcattacccaccagggtacccgagctcgaattcgtaa

SEQ ID NO: 15629 - DNA, 396 bp, Glycine max
  Peptide Sequence Number=SeqID_107314
atgaatatccaccacttagtcaccctcttccttcaacactttaacatccctcttgattttgaaccctatgttccaatgaaggggtcctttctaataggcgcttcagtcattgcatcctttggttatcaaaaagagcatgatggctcttgggtgaaaaagggtgctcgacatgttggtgaagaaggacatgatggagaagattcatctcttatttcaaagattttggacaggttcgatggtcttcaaacctttgttggtgaaaggtttgatactttggagttacaagtggacatgcgcttcaatgaaatggagtcaagaatcaccaaggtcgaagaagatgtctcttatattcgttcaagctttgatctaccaccatcgccgccaccatcattttag

SEQ ID NO: 15630 - DNA, 384 bp, Glycine max
  Peptide Sequence Number=SeqID_107315
gaagacaatgtcataggacataggctaaaggggaaattgcctaactttacatctagaaggtgtgaccaaaccaatcataacatcagaagctacaaaaatattggagttcctattaggccaaagaaatatgttgcaccaccaacttcaaatgaggatgaccacctactatctcaagataagcaagctttgaatgaggctgaagaagttgctgctcatgttcaacaagatctggtggagattaatgtatctcagcctaattggtcacaagatagtgacatggagttgatggtctctgcaactattgttccaccaatagcaaggaataagctaaacataacaagagccaaacaaaggaaggttgctgataaaaatgatgcagtataa

SEQ ID NO: 15631 - DNA, 252 bp, Glycine max
  Peptide Sequence Number=SeqID_107316
atggaaattcgaatggataaaagctataatttgtttgacccattcattggtgcacataatgtaaggcagtcaattaaaacaaagccaaggggttacatagaatccgatcatgtacaacatgatgtgccttaccaagttgaggaaatgtcacatgtaaacaaagtcattgaagttgaaagtatttctggattacaagatttagtagaaggtgtagaagaagtaaaccctgctaatttgttgagaaatgaataa

SEQ ID NO: 15632 - DNA, 302 bp, Glycine max
  Peptide Sequence Number=SeqID_107317
aactggaaggaggtccctactgcttagaaggacttgatttgggaggatattcggacctcacgaggaaatggacccttgcagccgatcaggacggtgtggatgacactgatgtgcagaaaaaggcacaggccatccagaaacataacacttccccccacattttgtctcgtgggggttatgaatatttggagcaaaaactcctggctgagaagaccaagaagaagctggaggaagctgcacagtcaggaagtgttgatggcgtcatcgaccctccatcccccgttagacgccacgtgaagtga

SEQ ID NO: 15633 - DNA, 675 bp, Glycine max
  Peptide Sequence Number=SeqID_107318
atggttgccaaaaatcatttctaccatattgcatttgcaatgcttctctgcatggcattcttggcttttcaagtcacatgtcgcactctccaagatgcatccatgtatgagaggcatgagcaacggatgactcgttacagcaaggggcatatgtgctcctcaatcataaggataactacttttaagtttgaaaacgtgactgcaacaccatccacagtggattgtaggcaaaagggagcagttacaccgtcaaggaccaaggtcaatgtgggtgtggaccaaggttgtgagggtggtcttacggatgatgctttcaaattcatcatccaaaatcatggactcaacactgaagccaattacccctatataagggtgttgatggaaagtgcaatgcaaatgaagcagacaagaatgctgctactattaattactggtggctctgactttcagttttacaagagtggtgtcttcactggttcctgtggaactgagttggatcacggtgtcactgccgtggggtatggtgttagtgatgatgggactgaatattggttggtcaagaactcgcggggacccgagtggggtgaagaaggttacattaggatgcaaaggggtgtggattctgaggaagcactgtgtggcatagctgtgcaagcatcttaccctagtgcataa

SEQ ID NO: 15634 - DNA, 735 bp, Glycine max
  Peptide Sequence Number=SeqID_107319
atggttgccaaaaatcatttctaccatattgcatttgcaatgcttctctccatggcattcttggcttttcaagtcacatgtcgcactctccaagatgcatccatgtatgagagtcatgggcaacggatgactcgctacagcaagcgagacattaatcaatttgcacccaaaaagagattcaaggggcatatgtgctcctcaatcataagaataactacttttaagtttgaaaacgtgaccgcaacaccatccacagtggattgtaggcaaaaggtagcagttacacccatcaaggaccaaggtcaatgtgaacaagaacttgttgattgtgacacaaagggtgtggaccaagattgtcagggtggtcttatggatgatgctttcaaattcatcatccaaaatcatggactcaacactgaagccaattacccctatataagggtgttgatggaaactgtggccaataacccggtttccgtagctattgatgccagtggctctgactttcagttttacaagagtggtgtcttcactggttcctgtggaactgagttggatcacggtgtcactgccgtggggtatggtgttagtgatgatgggactgaatattggttggttaagaactcgcggggaaccgagtggggtgaagaaggttacattaggatgcaaaggggtgtggattctgaggaagcactgtgtggcatagctgtgcaagcatcttaccctagtgcataa

SEQ ID NO: 15635 - DNA, 891 bp, Glycine max
  Peptide Sequence Number=SeqID_107320
atggccgccagagatgaaggttatgagattcaaatcatcagtcattttgtcgatgataacgtgctgaataaatttaaaacattcggctttaagtgccataatatcccacttgaagctcagtcatttaatgttttaactttcttgcgggcctttttggcatctagaaagataattaaaaaaataaatcctgatattttacattgtattactattaagccttgtttaattggcggtgttttgtcaaggtatgatgaacgtccagtgatcgtgagttttgtcggtttaggacgtatattttctggtgggacttgtatacttaagttattgcggtatattaccgttatggcgtataaatatattgccaataataagcgcagtatatttatgtttgagcacaacaaggatagagaaaaactagttggttttgtaggaattaactaccatcagactattgttatagatggtgccggtattaatcctgaaatttataaatactctcttgaacaggaacgcgagataccagttgttctatttgccagtcgaatgctgtggagtaaggggcttggagatctaatcaaagccaagaaaatcctcaagtcaagagatattcattttacgctaaatgttgctggtattttagttgaaaacgataaagattccatttcgctttctgatatacaacaatggcatagtgaaggtttaatcaattggttgggaaaaagttcagatgtctatgatttgatccaaaaatcgaatatagttgctctaccttcgagttattctgaaggcgttccgcgcatcttacttgaagcttcatcagttgggagagcctgtattgcgtacgatgttggcggttgcgacagtctgataatagataaggggatcctctag

SEQ ID NO: 15636 - DNA, 772 bp, Glycine max
  Peptide Sequence Number=SeqID_107321
atgcgcgagtttgggtatatctgggaccagaatccacgcaaggcaaaagagctggcggtagaagctgggtacgtgctggccgccgagttgcgtgcacatggtgtggatttcagttttacgccagtgctggatatggattatggtgacagcctggtgattggtgaccgtgcgttccaccgggatccgcaggcgattaacgagttggcatttagcttgatgcaaggcttgaaaaaagcaggcatggcggcggtaggtaagcatttccctggccatggttttgtggtcgcggattctcatgtcagcattccagtcgatgagcgcgaatttgaccagattgcacaaaatgacatgcagccgtttgtgcgcatgatagacgagggtctacatgcagtgatgccagcgcatgtgatttaccctaaagtggatgataaaccagccgggttctcgccgcgctggttgcaaaaggtgttacgcgaacgcctgggatttaatggcgtgatctttagcgatgacctcagtatggagggggcgaccgtcgcaggggacgtgactgcacgtacgctggcggcactcaatgccggttgcgatatggtcttgctctgtaaccgcccagatttggcagatgaactattagccaatctggactggaaaatctcggcacaaagcattgcccgcctggcgcgcatgcatggcggacatcatccgcaggatatggtcggcctgcgtgaatcagcctattatgtggatgcggtgaagcgtgtggccatggttg

SEQ ID NO: 15637 - DNA, 288 bp, Glycine max
  Peptide Sequence Number=SeqID_107322
atgtcgttgctgggaattttgtggctggcctgttggttggtgagtccagttttactacctggcgatcaagcaatttcacaagtttggggaagccaatctatcatcaaggcttatagagttgaagtaatggttacccaaaacaatgagagtagcaagtttttgctctgggaccgtgaatgtgctgaattgattggtcaaatagctaatgatgtgaataaggtcaagattgaagatggtgatcttgatttgaatggttcccctcaagcacttgacaaactgttgggtcat

SEQ ID NO: 15638 - DNA, 588 bp, Glycine max
  Peptide Sequence Number=SeqID_107323
atgggtcagctccagcgacaagcttttcgcaaagcttacggtaaaatctgggacctagccatggcagaagtctccatagaggccattgcctccctcgcccagtattatgaccagccgttgaggtgcttcacttttggggacttccagctatcacccatggtggaagaatttgaagagatcctaggatgccctctaggaggaaggaaaccatacctcttctcaggattctatccctctttagctagaatttctaagatagtccaaatctcggcaggcgaatgggccccgttcatagacatcctcgcacttttgatcttcggaggagtcctctttctaaatgtggatgggttggtggacctagaagcgatcaacgcttttctcgcctatcatgatcgcaaggaaagcctggttgtcgctatactagcttatctatatgacaccttcaaccgaagatgggttgcatcagttacaatccccattcttgctataagacaacttggctaccctatgagaggggcaccactagaggaagagctcgcacctactattgcacggggtttcaataacaccaacgtgggggcgctttag

SEQ ID NO: 15639 - DNA, 498 bp, Glycine max
  Peptide Sequence Number=SeqID_107324
atgtggtggaaattgaatgagctaaagtatccaacactacaagccattgcaagggatctgttagctattccaatctccactgtagcttctaaattgacatctagtattggaggtcagatattaactcctcatcatagccgacttcattatactactttagaagctttggcattgtcatatccaaatttcatctggggacaattgtttatcgacatgcggattattgccggtcacgttgagctgcttaaagccaattgccccctgggcccatctaggcccattaggaagcttcaacatgaagcaaccggctcgccagctgttcgcactctgggatactacttgcttgtgtggatgcgaaatctaccggcaagtgcaccgggttgtcaagtgttgggtccttttactgagcaaattgatgcaattaaggatgtttctctaattaaagatgtttctatgttctatgtgaacgctcaagtactaaacaccgatgtctcatga

SEQ ID NO: 15640 - DNA, 240 bp, Glycine max
  Peptide Sequence Number=SeqID_107325
atgatgaatggcaattaccggttgaaggggactcttctctccttcagagtattttggacaggtttgatggacttcaaacctatgttggtgaaaggtttgatgctttggaatgacaagtggacacgtgattcgacaaaatggactcaaggatcacaaaggttgaagaagatgtcaccatcattcgcgactgccttgatttacctccaccactaccatcagtttagacattactattattaa

SEQ ID NO: 15641 - DNA, 153 bp, Glycine max
  Peptide Sequence Number=SeqID_107326
atggcaaagacagaatcgcaagccatgccaagcaagccaacaagaaaaggaaggaagtggctaaaggcccaagtggagaaggacgaaggcctaagtggagaaggacaaagcccccgagtggagaaggatgaaggcccaagtggagaaggatga

SEQ ID NO: 15642 - DNA, 357 bp, Glycine max
  Peptide Sequence Number=SeqID_107327
atggcggaaccatcaaagaagcgcaaaggttcttcgagtagaagccaacaacattctgaggctcaggatactccaattccttcctccatttcctcatcctcattgttctcatcgaaagaacaacgtatacggtacacaaaccttttctcctctcgttctatcattgaccctaagttcatagatatggatttcttttctgatgagagtttcgaatgcattcaagcatttcaaaactcaaatctcattccctttatgtctctaaaatttcctgtgtattctgaattggttaaagctttttattctaatcttgaaattcaagaagatttcagaagtttatgggataaagatggtcattga

SEQ ID NO: 15643 - DNA, 512 bp, Glycine max
  Peptide Sequence Number=SeqID_107328
atgcctgccagcgttagaaagccaccgttcatgcacagagaaaggaagccacgaccgacgaattgggaccagtacggagtcaaggggtttcaacttacaatcccgattgctgcaataaagcaatggctacccgatgagaggagcacctactccgcccccagaggaagagatcacggacttctgtattgtcacgaggtttcaatggccaacatggagacacttcagaaggtaccgcaaggcatgggagcttgtatggtacaaaagactaggactataagagctcagaggcatttgagaaccactaaaagggaggaagttgaggcaccggaggaagatctagaagatgggagacatgtcgaattgagggatgtaaatgtagttcggctggaacaaacccaagagggaccatcctccctcaatagggaagagcacggccggaacaagttccgaggggctctgtggggtagtaacaacgagcttaactccggagggaggaaagggaccaatcgcgg

SEQ ID NO: 15644 - DNA, 327 bp, Glycine max
  Peptide Sequence Number=SeqID_107329
atggaagagactctagctcaattcatgcaagtgtcaacgtctaacccaaagagcaccgagtctgcaattaagaatctggaagtccaggtgggccagcttgcaaatcagttagctgaaagaccatcaaacaactttatagcaaacacagagaaaaatcctagagaagagtgcaaagctgtgatgactagaagcaaaatggtgattcaagcggaggaaagtaaagctaatcagaaggtggagggatttaaacaacagctggctgatgaactggcgttggaaccggttgatgacttagttgaacttgaagaaattgttgaggaagtataa

SEQ ID NO: 15645 - DNA, 105 bp, Glycine max
  Peptide Sequence Number=SeqID_107330
atggcatgtatggataccaatatcgtcaccgcctctatcaaggctattgtgagcgggattaaccgctgcagtgtgcaacctatggtcatggagaagattgcttaa

SEQ ID NO: 15646 - DNA, 403 bp, Glycine max
  Peptide Sequence Number=SeqID_107331
atggcctctaggaagaggaaagcaactgcctcccaacctcgggaaccttatgacactacacgctttatatcagaggtcgcttaggagtgatatgaacaaaatgaatgcttccctctatgtgactgaatatgatgagttccgtcgggagctcgagaggcgtagttggcataaagccttgactaggaaacctgaaggtcacattgatgtggccctggtcaaagagttttatgccaatctatttgatccagaggataagtccccgaggcaggtcagagttaggggcaagctgataaagtttgatgctgagacgcttaacacattcttagagaccccgatagttttagagccaggggagaggtactccgcttactccaggttctgtcattcacacccacacccttag

SEQ ID NO: 15647 - DNA, 456 bp, Glycine max
  Peptide Sequence Number=SeqID_107332
atggctactcagttgaaccaagctcaatcccaaaattctaacaaattgccttcacaaattgtgcagaatccgaaaaatgtgagtgccatcaccttgaggtctggcaaccaaattcaagtgcctccaccagtagcagcacctgcacgtgaacctatcaagcttcattctacacatgaaaaagaggatgagatagttgcacaaaagagaaagcttcctaacaaaaattttcatgcaggtggaccttcttctagtaattctgacttaccgcaacctcctatccgtcttccattcccacctagagcaattccaaacaaaaaaatagaagaagcagaaaaggagatcttggagattgtcgcaacctacccttcggcgggagggcgacgcgtgactcgcgggatgcgtgttccacgaaaggaatacgcgcggagtcgccaccaacatttatttgaggaaaac

SEQ ID NO: 15648 - DNA, 258 bp, Glycine max
  Peptide Sequence Number=SeqID_107333
gtcggtcgctccaagctgggctgtgtgcacgaaccccccgttcaccccgaccgctgcgccttatccggtaactatcgtcttgaatccaacccggtaagacacgacttatggccactggattcagccactggtaacaggattagcagatcgaggtatgtaggcggggctaccgagttcttgaagtgctggcctaactacggttgcactagaagaacagtatttggtatctgcgctctgctgaagactgttaacttctga

SEQ ID NO: 15649 - DNA, 856 bp, Glycine max
  Peptide Sequence Number=SeqID_107334
atggggtggttggagtaccaaggaaatgtttggaagcaaaagcaagagtcttggcaggcagcgattgacgcttttctcgcctttcatgactgcaaggaaagcccagttgtcgctatcttagccgatctatatgacaccttcaaccgaagatgtgaaaagaacagtacaaggattgtttgctgtactccgaccctctacgtatggttggtttcgcaccttttctgccaagaggtgagacttgcttgcccgctagaaggccaccgctcatgcatagagaaaaaagaggcaagttgggaccgactcttagcaagcaaagaaggagtgtttgtcaactggttcccccgatggaaagaaggaagaaccaggattgttatttcatgcggaggctttccaaatgttcccttgatggggacaaggggttgcattaattacaatcccattcttgccataagacaactgggcaccaatgcggaggcacttcagaaggttcgcaaggcatgggagatggtgcaaaagaaggacaaggaactcagaggcagtagcaatgggcccatcggttgctaccataggtggttgaaagcctacacgcaaggtgtggattggctcccgaatttgagaaccactaagggggtggaagttgaagctccgaaggaggacgaagaggttcaggccctcaggacagaactcgagaaagcccaaatagtcaaagaaaagttcaaatcaacaaatattaggattcgaaaggagaacaccgaactgagagacataaatatagccagcaccaaggccttggaacaagagaccaaaagggcccgcagggaagaacatggccagaacaaattcccgagagggctct

SEQ ID NO: 15650 - DNA, 276 bp, Glycine max
  Peptide Sequence Number=SeqID_107335
atgtaccatcgcttgttctcagtcacaacaacccaagtagatgtaccctctacttgtaccacaaaggatgtaccctccaatgtgttaagacaaagtcttcaggcggttagtcctttgaaactttgtgaaggggaaacaaaagatatctcaggcgatatgacaacagtgcagggcacttgggatccctggcctagcctagcacaggacacacccttgccagcccaggatgccccctcatcgcctcaggatgacccaacaccagcccaggaggagtga

SEQ ID NO: 15651 - DNA, 150 bp, Glycine max
  Peptide Sequence Number=SeqID_107336
atgtctaactccctgggaatcaaaataggggagaagctggtggagttgttgagtactaaggggttggatcgcttccaacgaaacaaccctccttctttcaatggaggatacaaccctaatggtgctcaaaattgcgataagggaaattga

SEQ ID NO: 15652 - DNA, 216 bp, Glycine max
  Peptide Sequence Number=SeqID_107337
acttatcaaggtaatccttgtggcgtctacccagacttatcttccttaaccggaagtggcgtctacccagacttatcttccttcactggaagtggcgtctaccctgacttatcttccttcaccggaagtggcgtcatccaaacctttgtagcctgtatcaaacgatccgctcctactcaggttcacatcatctggtatcagagcttcggctcttga

SEQ ID NO: 15653 - DNA, 366 bp, Glycine max
  Peptide Sequence Number=SeqID_107338
atgactaattcaatcatcaagattctcaacataattttattccttgccctcgtttcgaaaggctacagccaatgctcgttgcacgacatccacataagtcaaaaacaaacaggagctacaatacacggaaagaaagaatggagtgtgactattgcgaattggtgttcatgttatcaatcgaatgtgatgttaaactgtaaaggatttcaatctgttgaaccaatagaccctcaatttttgaaaatttccggtaatgtttgtcttgttagcaatggtcaacccctcttcagaggtgtcaccgtattcaactatgcttgggacaaaccatttccattcattcccatttcctcaaaaattacttgttaa

SEQ ID NO: 15654 - DNA, 630 bp, Glycine max
  Peptide Sequence Number=SeqID_107339
atggggacaaatcaaactggcaaaaggttttatcaagtcaagattaagggcctagatatcaccagcattaaggagttggggcggttgatgggacctctcctaatgcaagccttctgcaaggcgtacagaaagatcttagatttgaccatagcagagatatccacagaagccattgcatcactcacccaatactatgaccagcccttgagatgcttcacgtttggagacttccaattagtaccgactgttgaagaatttgaggagattctaggatgtcctcttgggggaaggaaatcgtatcttttctccaggtttcttccctccttgagcaagatttcagttgtggtcagggattcggggagaggattggatcgtgtaaagcaaactcgaaacgatgtagtgggcctaccacggaagtacttagaaggcaaggcaagggatatggcgaatcaagaggagtgggccccgtttatggacgtattagcattgttaatctttggggttgtcctctttccaaacatggatggtttggtggacctagccgcaattgatgctttccttgcatatcaccatagcaaagaaagcccagtagtggctgtcttggcggacttatttgacacatttgactga

SEQ ID NO: 15655 - DNA, 219 bp, Glycine max
  Peptide Sequence Number=SeqID_107340
gatgaggaatcatttgatgttactttctcggttggtggagaaaggtttcatgctcataagcttgttttggcagctcgatcaaccatgtttgaaactcaattttttaatgcgatgaagaaggatgatcaagagatagttgttattgacatggaacctaaggttttcaaggtgtcacattctgttccgtacaaaatcgccggtcttaccgcagtccgataa

SEQ ID NO: 15656 - DNA, 647 bp, Glycine max
  Peptide Sequence Number=SeqID_107341
aggactacacgtcatcaccttcagaggactacgcgtctccccttcagagggctacataccttcaccttcgtaggggtcacgccctcaccgtcagaggactacacgtcctccccttcagagggatacacgtcctccccttcagaggactacatgtcctagccatcagagggctacacgtcctcaccttcaaagggctagacatcttcaccttcagagaactacacgccctcaccttcagaggactacatgtccgcaccttcagaggactacatgtcctcgcctttagagggctacacgtcgtcaccttcagaggactacacgtcctccccttcagagggatacatgccctcactttcgtagggctacacaccctcacccttagaggacttcgcgtgctcgccttcagagggctacacgtcctcaccttcagagggttgcacgccctcgccttcatagggttgcatgccctcgccttcataggactccacatctgcgccttcaaagaactcaagggatcgcccccacaagacacccagtggacccggagaagtcccacagggccctggggtttccagctctggttatgggcctctgtcagtcctaccgggtgctcgtccccccagcaaggtcatgccatcgtgacatag

SEQ ID NO: 15657 - DNA, 328 bp, Glycine max
  Peptide Sequence Number=SeqID_107342
cgcccaatacgcaaaccgcctctccccgcgcgttggccgattcattaatgcagctggcacgacaggtttcccgactggaaagcgggcagtgagcgcaacgcaattaatggcaggtctcatggagagtaatgggaactcggtgaaggatgctgagaaacaaatcacccgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15658 - DNA, 456 bp, Glycine max
  Peptide Sequence Number=SeqID_107343
atggtggggtacgcgccttcaagctttgcaaatttggtcttcgccagagaaaggatcgaagtggaaggtgaggatgagggagaaacccatgctgtgactgtcattcctatacggccaagtttcccaccaaaccaacaatgtcattactcagccaataacaaaccctctccttacccaccacccagttatccacaaaggccatccctaaatcaaccacaaagcctgtctaccgcacttccaatgacgaataacacttttagcatagaccaaaacaccaaccaagaaatgaattttgcagcgaaaaagcctgtagccataacccctgctaggtttcctcaacctccatttttccgagggtacgactcgaacacagtgtgtgtttatcatggaggagccccggggcattccattgagcattgtatgaccctgaagcataaggtgcaaagtctaaattga

SEQ ID NO: 15659 - DNA, 435 bp, Glycine max
  Peptide Sequence Number=SeqID_107344
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccagcttggtgaggattacactgagttcatgatttccaagatcaaagcacttacttctgttgaccccgaattgcttcctcgcgccaccaaggctttccgaagtggcagtttcagcaaggtggcacaggatttaaccggcttttacgtcattttggagggatttttcatggtggagaatgttaggaaggcgataaagatcgatgaggggatcctctag

SEQ ID NO: 15660 - DNA, 228 bp, Glycine max
  Peptide Sequence Number=SeqID_107345
atgtgtggcatctcttgtcaatgtcaggattcaacaagcgattctcctcaaatttcagccagcccacatccattagactttgcaccttatgcttcagggtcatacagtgctcaatggaatgccccagggctcctccacgatatgcacatgttgcgttcgagtcgtatcctcagaaaaatggaggtggtgttcgtcattggaagtgcggtagacagactttgtggttga

SEQ ID NO: 15661 - DNA, 234 bp, Glycine max
  Peptide Sequence Number=SeqID_107346
atgaatgaagtcaaatggccacctcctcatatgcgctggcctcatatgaaagccaatcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15662 - DNA, 363 bp, Glycine max
  Peptide Sequence Number=SeqID_107347
atgcagtttgcgggtcagctttgtctagtgcctgggcaggtatttgtggattacatcgagtggtttttccgcatatctcatccattcatgatactgacccaggcaggtgaccagccgagagatgcaccagctgcagaccctgaggactacatacagccgcccagcccccaggttccagtggcatttgtccccccttcacatgtggatgattacgacggatatgagacgattgcacagaggtcggagcgtgtgctcaaccttaggatagtcactgcatgcacagagttatatgacattatgcatgactgtcagacgatcgcgagagggggacccagtgctgatggaactgttagggctcgttag

SEQ ID NO: 15663 - DNA, 432 bp, Glycine max
  Peptide Sequence Number=SeqID_107348
atgccggcccgacacacagcttcagcaactccccggccagtcaataatacagtccccggcgcgagctataataatgcacagcgcccacccccgaaagataacttctctcctgttcccatggcatactctgggccttcattattggagaatcatttggtggtggccatacccgagaggctatcgtttcaagaggagggcccaaatgttaaaaccaacccactagctagtcatggaggggctagcgtgaacgccatcaaagaggatggaccatcgcgggcaaagagattaggagaggtggctacttctagacgcttcatctaccaatcgctgctagcggcatgcatggtttcacctcggggagtcacacgacatggaaacctgtcccgcggtggaagaattgcttcagcggctcatggactgggggcagcttga

SEQ ID NO: 15664 - DNA, 662 bp, Glycine max
  Peptide Sequence Number=SeqID_107349
atgtcctcacctttagagggctgcacgccctcgcccgtcctcaccttcagaggtctacatgtcctaaccttcggaggacaacacatcctcgccttcagagggctgcacgccctcgccttcagaggactacacgttctcaccttcagaggactacacgtcctcaccttcagagggctacacgccctcgccttcagaggactacacatcctcgcctttagagggctacacatcctcaccttcagaggactacacgtcctcaccttcagagggctacacgccttcgccttcagaggactacacatcctcgcctttagagggctacacgccttcgccttcagaggactacacgtcctccccttcagaggactacacgtcctcgccttcagagggctacacgctctcgcctttcgaggactacacgtcctcgccttcaaaggactacacgtcctcaccttcagagggctacaagccctcgcaatcaaaggactacacatcctcgcctttagagggctacacgccatcgccttcagcggactacacatcctcacctttagaggtctgcacgccctcgcccgtcctcaccttcagagggttgcacgccctcgccttcagaggactacacgtcctcaccttcagagggctacacgccctcgccttaagag

SEQ ID NO: 15665 - DNA, 306 bp, Glycine max
  Peptide Sequence Number=SeqID_107350
gagccagttctctatgtgtcagaagatgggagagctggagataatgccaaccagaatgactttgcacacttcactttccctgccgactttgtggtcatggacattgaagaagatgttgatatcccattgatcttgggacgtccattcatgctgaccacaagctatgtggtggatatgggaaaaagaaagttggaaatgggcatcgaagatcaaaagatcagtttcgatctatttgatgaagaaaagcaacttttggaccaaaatgtctgcttgcaggtgaaggagtttgaggaaaaggttctgaag

SEQ ID NO: 15666 - DNA, 369 bp, Glycine max
  Peptide Sequence Number=SeqID_107351
atgctggctaacaatcaagaccagccttggtctagaattttaatctctaagtatggtgggtggaaggagttgatttgtggtggaaggaggaatttcacttcccaatggtggcaggatttgaagagtatcttccagcagcatcacaatgaatgcttaactgataatttaaaatggagagtgggaagggggtccagcatcaatttctggaagcataaatggatggaggacaactgtactctccaaggaaaatatccccagttatatttaataagtaaacagcagaattcatcaatcaattatatgggagattttgtggagggtagtgggaatggaagttatcatggagaaggacttccaaatgcactttaa

SEQ ID NO: 15667 - DNA, 228 bp, Glycine max
  Peptide Sequence Number=SeqID_107352
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtactgctccaataggcgattcatcacctcggtttggccattggtctatgggtgatatgttgtactcatgcataaacgagtgccactga

SEQ ID NO: 15668 - DNA, 153 bp, Glycine max
  Peptide Sequence Number=SeqID_107353
atggtgccctcaaaagatgaaaacagtgtagaggatgacaaggaaggtggaattggtgccggggatgctccggtggctccaggacgtggtgttcgagttgccgcaacggaggtggatgaacccttacacttcttggataattcttccatttga

SEQ ID NO: 15669 - DNA, 78 bp, Glycine max
  Peptide Sequence Number=SeqID_107354
atgactgtggttatgaacagagctaaatacaatctcaagcacatcgattttaaggtgttcattgcagatatgccatag

SEQ ID NO: 15670 - DNA, 285 bp, Glycine max
  Peptide Sequence Number=SeqID_107355
atgggtgccaagtacctcaaagtggtcaaacgagggtcgcatcccaacaaacggatgggagatcaagagaattttagagaagattgtgcagccaagcaggaaaagattggagtaccaggctggatgatgctctttgggcacatcggactgcctacaaagcaccccataggaatgtctccttattgggttgtctttggaaaggcatgtcatcttccaatggagattgagcacaaaacaatactaggtagtgaagacctgcaacttctctatggatcaagctggtga

SEQ ID NO: 15671 - DNA, 1138 bp, Glycine max
  Peptide Sequence Number=SeqID_107356
atgcgcaccaacacgcgcctgggcgtgcgctatgaaaccaccgacgtgatgtcgacctcggtcattgccgttcccgagtccatcgagtggcaggccaacaacgatttccgcatcgtgctgtccgatgagcagcagcccttcacggaaaaggcgcggtacagctacatcctgcccaaccttgatttcagcatcgacctcaccgaggaactgaagggccgtgtgtcgttcggcaaaagcatcgcccgcgcgccgtacggcaatctctatgcaggacccggggcccagcaaccgttcggctcggtgctgatcgatccctcgtcgcgcgccagcggcaattcccagaacccgagcctgaagccgctggaatcggacaacctcgacctggggttggagtggtacttcgccgatgccagctatgtgtcattgacctactggaacaagtcggtcagcaacttcatcggcaacaccgtcgtccaggaaagcctgtacggcctcaccgacccgacctccgggccggatgcgcgggcggcgttggacttcctgaccagcggcgcctgcgtcgcccaggtcgggccggccaacgcagccgcctgctcggccaacgacacctcgctgttcaccgcactggcgttgctgcgcaacaatcctgccggcctgggcgcctacaacggaaccgatgcgcaggtcctggccaccgaagcggcctacgatctgtatgggcaggccaacgatccgctgtaccagttcaacgtcaatcgcccgatcaaccagaacaagtccaagctgcacggctgggagctgggcgggcagtacttcttcggtgacaccgggttcggcgtactggccaactacacggtggtgaaaggtgatgtcggctacaacaacggcggcgatccgggtatcgaccagttctcgctcaccggcctgagcgacaccgccaacgccatgctgatgtacgagaagtacgggtggtcggtgcgactggcatggaactggcgcgatcagtacctgatcctggccaaccagggctccagccgcaatccgtactatgtggagccgtacgagcagtgggatctcagcgtcaactacgcgctcgatgaccactggtccttcagcctggaggcgatcaacctgaccg

SEQ ID NO: 15672 - DNA, 372 bp, Glycine max
  Peptide Sequence Number=SeqID_107357
atgcccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgccaagcttgcatgcctgcaggtcgactctagaggatccctcccttttggctaa

SEQ ID NO: 15673 - DNA, 531 bp, Glycine max
  Peptide Sequence Number=SeqID_107358
atggagcccatgaaagagcaaatgcccacaatgatggaatccatgatgagtatgagaaaaatgatagaggtcaacacagttacagtcgttgccgcaagtactgccactgaggtggacccgactcacccatctagcatcaatcaagcaagtcatctagtcccagatatgataggtcagggaggcgaagcattgggaagtacaggcagcccccattttgtgcaagtccaaagtaagcattccttccgaccatatggcttgcctcccaactatacaccacccaatgttgcacacgctcccgatgagaatgttgataactccgctcccatacccattgagagccaacaacacaaatctggtcatgcacaggtccctcaacccatgggagagagacctgaagtaccccgagaccacactctagccaacttcgagcctcacctcggatatgccactaaggggcaagcatttggtggcatgccactgccaaaccctttggggggccctcagtatcgcccacaaccacatctacaatga

SEQ ID NO: 15674 - DNA, 663 bp, Glycine max
  Peptide Sequence Number=SeqID_107359
atgacggacaaacttacttccttgcgtcagctgactactgtggtcgccgacaccggtgatatcgcggcaatgaaactctaccaaccgcaggatgccaccactaacccttctttgatcctcaacgctgcgcaaatccctgaataccgcaaactgattgacgaagccattagctgggcacgtcagcagagcagcaacaaagaagagcagctggcgctggtttctgacaagctggccgtcaacattggtctggaaattctcaaactgatcccgggacgtatctctactgaagttgacgcgcgtctctcttacgacaccgaagcgagcatcgcgaaagcgcgcagcctgatcaagctgtacaacgatgccggcatcagcaacgatcgtatcctgatcaaactggcctcaacctggcagggcatccgcgcggcggagcagctggagaaagaaggcatcaactgtaacctgacgctgctgttctccttcgcccaggcgcgtgcctgtgccgaagcgggcgtgttcctgatttcgccatttgttggccgtatcctcgactggtacaagcagaacaccgacaagaaagagtacgcagcgcatgaagatccaggcgtggtatccgtgtctgagatctacaactactacaagcagcacggctatgaaaccgtg

SEQ ID NO: 15675 - DNA, 528 bp, Glycine max
  Peptide Sequence Number=SeqID_107360
atgaccggccctctcgatgagtcgatctcttgctttctcataagggtggacccttgggtactagtacctatcttcttcagaggactacgcgttctcacctccctgatattggagggggccaactgtgcgaatacaaccagagagggaggctatcacgtagttactatgcataccatggcaagatttcactcgtgccactgcaaagagacaagtgcagatcgtgcgtaccaacatgaccactcttacacagatatcggtcgcgcccacaagactcctagtggacccaaagaagtccaacagggccctgggtctccagctttggttatgggcctctatcagtcctacagggtgcccgtaccccccggcaaggtcatgccattacgacataggatcgcgcacgcagggcacccaatggacccaaagaagtccaatagggtcctggggtttccagctctgattacgggcctctgtcagttctacggagtgcccgtcatccccaacaaggtcatcaggcctcctactaactga

SEQ ID NO: 15676 - DNA, 675 bp, Glycine max
  Peptide Sequence Number=SeqID_107361
atgagaaagcgccacgctccccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacactctgctcggccgaggcttttcgcttgccggtcgagaaggtgccgcgcgtcgacttcggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 15677 - DNA, 449 bp, Glycine max
  Peptide Sequence Number=SeqID_107362
gaaaaaaaacatcaaaggcccgatggccgtgcctatggcaccgtgatgcgttcatgatctggcagaccctgatagtcaaagaactgacttatttaaaagatccagccaagaggatcctggccatcaaaacgtggcacatcgagtttcatatgtggcttatacaaatggggtggcagtggatgggtggggatggggttggagtgtggggacgctggctgaatggaaagggtggcgagatgttcaagcatggagtccattttctggttcatggaagactgtgtttgggccagggaagcgtgttcgtgggtgagggtggcctgagcttgcgtaagcttggcgacggcatcctccaagcgttcgagggtggtctggcgggtatgatgttcaggcatggcggacgctggtggcggggcaggtcggaccaaaatgataggaaccgctatatctag

SEQ ID NO: 15678 - DNA, 702 bp, Glycine max
  Peptide Sequence Number=SeqID_107363
tggattccctttgacgcagatgccctcagccagttcctgggtgacctgctagttttggaggaaggccaacagtgtgagttcagccagaggaggaatagggccgatgggttcgatgaggaagccattgcccaactgttgtgcacaccggggcaggatttcacccggaccgctgcagggaggcgggtgcggatcatgcgcaccagcatgaccactttgacccagacatggatgacactgctgctcagcaatgtcttacctagcgatcacaactctgatctccctctgcctaagtgccagttggtatatgccatcctgacacggatgagcgtccacgtggcccaggtgattgttgatgccatttatttgtttgcaggtatggcgcctaccaggcaccctctggacccagataagtccaactgggccctggggttttcggcgctgatcacgggcctctaccagtccttcggagttcccatcacccccagtaaagcatccagccaccgtgggcaggggcagggttccgccctttttgcatgccctactccgaagcagtttggggatgaggtcgcatggcctgcagactggcccgaggcccaggcaggggaggagcctgtaggatccctcggtgaggcagatgagtcccatatggatgaagagatgactgacctgctcgatttcttgggaggcagcggagccaagtga

SEQ ID NO: 15679 - DNA, 177 bp, Glycine max
  Peptide Sequence Number=SeqID_107364
atgagaaagcgcacgcttcccgaaggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 15680 - DNA, 993 bp, Glycine max
  Peptide Sequence Number=SeqID_107365
atggcctcagaatcagacgaagattctgaaacagatctacaaaaacaaatccaaaaggccaaacagaccaaaactgtctgtaaccaaaaaccaagccaattgttgactcaacaagaatcaacaccacaacccaacaacagttatatttcaaaaaacaaatttttcaatgttttacaaatggaaccggaatactgggacaagaatcctttcaaagcaaccgccaaagtattccctccgggattccattacaggccaatagccacaaacaaaacccgcaaattctatgaattcattctaatagatacaaactcagtatctattaaacatttcaaagaccccaaagatccaaatctaaatactcattccacaatccaaatcctaaaggttatgcagccacgacattatggctcaaacttaaaccaacccaaaaaattttctgctccatttgacctcgcaggatataattattgggattacatcgacgcctggaccaatgtgttctggcatcaaaatagtaaattcaagcattcatggctaatttacttcaaaaataatactgtgtataattttccaaattggttcctccaatggtggaactacttcggaccaattccacaaatatttccagaagaagtccaacagggattccaacaattcaacaagctctataatagcaaggaatcacgtattccagcagatttaaagtatttttccagtttcgccttgtcatggattttttcatgcaagcaatatccaccgttacagagacacgcctttgtaaaatggtggtcacaattcgatacttcgaaggctgctccagatcaagtcaagaactggttccagagcaatcctgagttcctcaaacctgctgatccggagacctctttgtttctgaatcagaagtcgcaactggcagaattcttagcaagctcaaaatctaaagagagtcttgctcagaatctcaaagaagttctccaactacttcaacaggaa

SEQ ID NO: 15681 - DNA, 384 bp, Glycine max
  Peptide Sequence Number=SeqID_107366
atggaaaaggatgggatagtgggactattagaagtatactcaaaccctgaaaaaccagagattctatgctctctaattgacgacaagggtaatagaaaggagataatgttaataaaactacaagataatggcgtccatatatataagactgaggagcactatattttaccaccaattccccaaatagattctctcattaaggacgtaatagaggaagtagcggaggaattaaaggtagattcaatagtttacaattacggaaatattgatactaattcagagactctacgattaagtaaagaatggtttgatatggaaagattagccttagcttcttcaaaacatgtagcgttatctagcgattcaattctggggatcctctag

SEQ ID NO: 15682 - DNA, 417 bp, Glycine max
  Peptide Sequence Number=SeqID_107367
atggattcctgtaagagaaaagccatagcctcagtgtctcaggccggttatgatagatcaagatttatatcacagaaggcctgggaccgttactcagataatgtgcttgccaggaacattctaccaaaaagaaatgtcaagttgtatatcactgagtttgatgatttcaaaagagaattgattagaagaaactggcataaacagttgaccaacttgactgagggaagcattgatgtggcaattgtcaaagaattctatgcaaacctatatgtccctgaggacaaagaaccaaagcaagttagggttcgagggcacctgataaaatttgatgttgattccctcaacacctttttggagacccagcggtcgtggagcaaggggagagcttgccctcttactccaggtttgctagactga

SEQ ID NO: 15683 - DNA, 348 bp, Glycine max
  Peptide Sequence Number=SeqID_107368
atgggtctgcgaataacattggagaatggagacttgacgaacaacgctaggcaatcaattcgcggggctccagactcgatgattgagaatggaaaattggcaaacagcgctagggaatcaattcgtggggctccagactcgatggtggaggatgcatcgaacagcgctaggcaatccattcatgggtctccgaataagattgaaaatggagaattggcgaacagcgcagggaatgcaattctgacgggctccagacctgatggtggaggacgcatgaacagcgctaggcaatcaattcatggttccccgaataagattggggaatggagaattggcgaacagcgctag

SEQ ID NO: 15684 - DNA, 2031 bp, Glycine max
  Peptide Sequence Number=SeqID_107369
atgagtcagtctccttcctttaaagttaaagaagaacttagtcccagtcttgatccagagtctttacagagatggattgttgctttatgtgctataaggtttgatcttgaacaaggccaactcgtagaagtatgttatccacctggttgtcttacacatgatgaggaactggagattgcttatagttcgtttccagattctatttcccagcaacaaaatcgctccaccattcatgattgtatcttctttttccgattccgtaggcaccttaaatgtcaaaccagcaatgccactcattccaagataactgaagtggacaaggagttttctctaaagtccatagataaaaatagtgttagtaaaagattatccagtacaagtagtggtaatgtttctaaatacatgtatggctttgtctttaatagacagagacacgatgagaggctaaagcgaggaggggagcagaagtctgtggttattttgtcccacagtccttattctagtgtgttcaggcctttattacaaattgtaggtcccttatattttgacattggtaagatagcactggagcatattgctgcttatgtttcaacatggcctgctcctgttcctggtaagttaatggatcttccaattgggaatacaatgcttaaagtgaacctgccacctgcacacagcttgcccatggaaaatggagtatctcttgatgaatctgctgctcctgtggctccttttcttcctaataatcagtatatcccacagggcctttttcacgattcagatctgtttggtgcttttcgtggccttctattgcagctttggttgttatgggagttgttactcgttggtgaacccattcttatcattgcaccaacccctccccaatgttgtgaggccgttgctagtcttgtgagtttggttgcaccattactttgcagtgttgacttccggccttattttactattcatgatcctgagtttgcatgcttgaactcaattcgagaaggggaaaccttccccccaatggttttaggggtgacaaatattttcttccttaaggctctccgtaaaatcccccacattgtctcagttggtagtccacctcctagttcaaacagggtacccctttcgactaggtcttctactggaaaggtttccaatagacctgaaagtcttgggcttcaacaactttccctgcagaagttttctccttcaagtttattgaatgcaattaagctacggagagaaggtcctctttgtctcatgacacaacataaggaagccatttggactacatattctgccacaactaagccagacacctctattttaaataggcttatagatgctggcatgtcgccaagagttgaggagtcaatgtcagttgttaacaatgagatcttacggcgacatttcttggagctcacaattaattttttggccccttttggtctatattttaggactacagcgccattggaaggatcttctccttatgtagatcctccttctttgcctccatttaatgctgatgaatttcttgcaagtttatcagccagaggtccagggaagttcattttgaagcgaatgaaatctaactggcttgacttctacaggcggttcctgaacggacccaacttcatgccttggtttcagaggaggcatgctgtagctgaacaggaacaagatagattgtggaggcatgcaagaatgaaaactgatatacagcatcttatatctaaaatgtctgagttggaagttgtggattctttctgtgttatagagagacttctgcttagagaattactgctgcagcaacctggaaatggaggtattgattccacggcaacttgtcacaaactaatgggagatcttcaggcagttttcaacgcacttacaaaagatatgcaacagctcatgatttcaaatccacaaagggcatccctcctgcaaggtagcccagaattgacaaaactttcagcacactcacttgttcaagccggggatgcgtcttctacatcacccacttga

SEQ ID NO: 15685 - DNA, 1086 bp, Glycine max
  Peptide Sequence Number=SeqID_107370
atggggagcaggagggacgaggcgcccgccataaacagcaccaacgtcttcgccgccctcggaagcctcaagaagaagaagaagaagcccgagaaggaccaccagggcccgtccaagcccaaggacaagaaggacgtcttttgggcccccgcgcctctcacctccaagtcatgggccgatgttgacgacgaagatgacgacgactactacgccaccaccgctcctcccgaatctgtttgggccgcgccgaccgtcactcaaaacgacgccgctgctgctgagactgtggattggttcaactgcatggacatcactgctattccgaaatctgaaagtgagagtgagttggaaggtcttgatgatgcagatgatgatgctgaggatgaacaagaaaatgaaaatgacttagaagtgacagaagaagctgagcctgttctccggaagcctcctgaaccaccagtggttacaaaagaagctgaaaggcaactttctaagaaggaattaaagaaaaaggggcttgaagaacttgaagctgttttggctgagctaggatacacaccgaaggaacccactggccaagaagatgattccaatggtgctgagaagaaagaagaggatcctaatggtgctgtggaaaagaaggagaatgctaccggggaaagcaaaaatgctaaaaagaagaagaagaaggacaaatcttcaaaggagcagaaagaatcacaagaccagcctcatggtgtggatgctggaactggaaatgcaacttctgaaactgctgaaacggagaaggctgaggatgcatctgcaattgatgttaaagagaggcttaagaaggttgcttcaatgaagaagaagaaatcaagcaaggagatggatgctgctgctcgtgctgctgcaaatgaggctgctgcaaggaatgcaaggctggctgcatccaagaaaaaagagaaggcccactacaatcagcaaccagtgcggaacgggttagttctagaggcactttccattgctttaggttttgaatttcagtttgtgcacgatgtctcattgcctcccggttcaaagttgaaaatagtgcaacaatag

SEQ ID NO: 15686 - DNA, 390 bp, Glycine max
  Peptide Sequence Number=SeqID_107371
atgtttcttctatactgtggtttacttgaaggtcaggttgaacctggagcttgtgatcagagtttcggtattcatgttgccgagtttgcaaacttccctgaaagtgttgttaccctagctagagaaaaggcagcagaattagaagacttttctccttctgcaacatccttaaatcatactacacaggaggtaggttctaaacgtaagagagcatttgaacccgatgacatgtctcaaggggctgcaaaggctcgccaatttctagaagcatttgttgctttgcctctagaaaccatggacaaaatgcaagctttgcaagaagtaaagaagttaacagatactttggagaaggatgcagaaaactgtaattggctgcaacagttcttgtag

SEQ ID NO: 15687 - DNA, 264 bp, Glycine max
  Peptide Sequence Number=SeqID_107372
atgggaagagaaccaactacaacaacatggcaaatttccccatctgggaccctaactggtgtcagtgagcaacccgccacacccagtggcgatatgaccgtgcagagcctaagtcgccggggtgcaggagcttgcttttcagaaaagggagttgcaactgccattggcgagttgcctgcaagttgcaactcccattggcgggttgcacaagaagaaatagccatcaccaatggcgatttgttggctataaataccagtgctcac

SEQ ID NO: 15688 - DNA, 1143 bp, Glycine max
  Peptide Sequence Number=SeqID_107373
atgtattcctcaaataccttcctcaacggcaatgacctaatctcgtaccctaaccaaccattttgctttaggcctttttcctttgaaagcaacccaacttataatttttcaaaagaagaagccaattccaattacgcccttcctcctcctccacctcctcctcctttgtcctttttccaatctccctttgacgaaaatatcttcctagaacaccaccaccatgacttgctcctacttcatcagtactctctgactgactctggagtatcaaaaaaccttgaagttgtggccgaaatctcgccaattccttgccctgaacaaggtggaattgcgatggagcacactccaagaaagagatccagcaagagagaccgccacagcaagatcaacaccgcgagaggcctcagggatcgaagaatgaggctgtccctcgaagtcgcgaagcggtttttcgggttgcaagacatgctaggctttgacaaggccagcaaaaccgtggagtggttactgaaccaagcaaagggtgaaatcaaacaacttgcaagggaaaaaacaagtgttgttggtggtggtggcaagagtgcatcatcaacttcggaatgcgaaggggtgtctagcttggacgaggttgcagtgagtactggaggagttaataacgaggagcaagagagggagacagtaccaaacatgatgaagagaagaaaaagtaaggtttgtagaaagagtgcattcaatgctattgataaggaatcgagggaaaaggcaagagaaagggcaagggaaagaacaagagagaagatgagaactcggagagtacttgtttctgatgcatcaaacctgaaccgtttgagttcttggaacccctttgaaacggttgaagactctgcgggtactacacatcatccctccttggatgtgcaccttcatgaggctgatcaagaaccaattagttctcacaacgtgaaggagcataatttgggagaggacatggcgcatgaagataattctttggcgctcatgaacaagtggagcccaactatgttgttcaattctcttcacaactcaggaatccttcaggaacatcaattcgcagaatttcagtccttggggaaacaatgggaagcctacagcaatcaaatctga

SEQ ID NO: 15689 - DNA, 2706 bp, Glycine max
  Peptide Sequence Number=SeqID_107374
atggcagtgtcttcattgagtttaggagcctctatgagtgtatttagttctcaagttttgtttgatgagaaggttattgaccagactattgatacaagggtaaaacttgcatatgctctcgcaagacagtggtttggtgtgtacatcactcctgaggcaccaaatgatgagtggctcttggatggacttgctggtttcttgacagatttttttattaagaaacatttgggaaataatgaggcacggtacaggagatacaaggcaaattgtgctgtttgcaaagttgataatggtggagcgacagctttgagctgttcagcttcctgtaaagatttatatggaactcagtgcattggtttgtatggaaaaataagatcatggaagtcttttcgacattttgctaacaaggttgggaatcttgaacgcccatttcttaaagatttctttcctcggtgggttggttcttgtggatgtcctgttttaaggaagaatatggttgaattggctgtgctgcggggatgtacagcattgcagacttcaaatacatccattcttgatattaatccagatacagaaactcgagatggagatactggatggcctggtatgatgagcatcagggtatatgaacttgatggtatgtatgaccatccaattctaccaatggctggagatgcatggcaactattggaaatacaatgccactcaaagcttgctgctagacgctttcagaagcccaagaaaggtttaaaacttgatgggtctgatgataatggtgatgtgccttccatggatatgcgttcaaataccgagtcccctttattatggattagagcagatcctgatatggagtaccttgctgaggttcattttaaccaaccagttcagatgtggatcaatcaattagagaaggacaaagatgttattgctcaggcacaagcaattgcagcccttgaggcatccccacagctatcattttctattgttaatgccctaaataattttctcagtgactccaaggctttttggagagtacggatcgaagcggcatttgcattggcaaattcagcatctgaggaaactgatttttctggtctactccatctgatgaaattttacaagagtcgaaggtttgatactgacattggactgccaaagccaaacgattttcatgactttgccgagtattttgttcttgaggctattccacatgctgttgctatggttagagctgctgacaagaaaagcccaagagaggctatcgagtttgttttacagctattgaagtacaatgacaacaatgggaacccttactcagatgtattctggcttgctgcattagtccagtcagttggtgagcttgagtttgggcaacagtctcatgccaagctacaatggaatcttgactatcagttgtatccggacattgacccagattgcattaaagctttcagggttcattcctcttgtaagtaccttgtcattgagattcaaactgctgttcaaagacacccaactcttcatgggattcccagagaaaatagaatgctgcatatgagtcttacagaagctagtaactatcaaaagaacatgcttgctcttgattcagaaagcaaacctttggatctgccaagctctattgatgatcttacacaaaatttgggcccgacaatggagggcttgagggacgcacttgatgaagctcctaaggaccaaccttgtgaagctcccacacaggtgcaccttgaagctctaaaggaagcgtcccttgagaagcccaaagaggtatttactgaatttccccaggaagcaccaattgaagctccaaatgaaatttctaaggaggctgatactgtatccaatagccatgaaagaaagagacccattaaaatcaaggtcaaacaatcttctgccaccagtagggctgatactgataatcaggtggttgaacgttctttaggtggtcgtaatgaaatggatcatggagctagcagttcagtttctgtagatgcaccccagaggaattttgctgagactgttagcatcagtaatcacaatattgatgaagttaattcttggcatgatcgcggttcacgcatgactgccagcattggtagtgcaaagtttttgagtgatggtgatgaattggtcaaagaactccagtgcactgctgattcaagtatagtttattcacaacctcagccagaagatccatcatcatccagtattatccaggataacaatatagatgctgatgcacgacgatatgccagccttcaaactctttcagttgcaagatttgatcctgacggagaaccattaggtaaagaaatttctgctcgggggaaagaaaagcacaaaagcaaggaaaagaaacggaaacgggaaagtaataaaggacaccatgatgatccagagtatttggagcgcaaacgattaaagaaagagaaaaaacgtagggaaaaagaactggcaaaacttcagagtgatgaagcgaagagatcctccatagatatgtcaagcaagaaagaggagcctgtagtggacgttgttgctagacaggttacatctgttgaacccactggatatgattctaaattagaaataaaaaagatagataccaccaaaccggagccatctgaaggcacatctggtgcaccaaaaattcgaattaaaattaaaaaccgaatgctcagcaagccctag

SEQ ID NO: 15690 - DNA, 330 bp, Glycine max
  Peptide Sequence Number=SeqID_107375
atgggtttggacccgttggaacaaggcgtttctcaacaccataacgtggatcaatctcggtttcctttgactccggcacgcgactccggtggtggtggcgccgatgatgaccacgatggtggtggtggagaaacgggacagagagaactgaagttggttgttggtgaagacggcgttgttatcattgttggatttggaaccaaaccagacatattgaaagagtaccaagaagaggaagagccaaagaatgaagcttacttgaaggtgctaagcatgcataagaaatactgctacggaagcttgacatgggggagtgcttgcttccattag

SEQ ID NO: 15691 - DNA, 1956 bp, Glycine max
  Peptide Sequence Number=SeqID_107376
atggcccaagattctgagaagagattccattccatcatggacaagctctaccatcctcccaaacccccttccgcctccagttcatctggagtgcagttaccagggaatagcaagaaacgtccttatcagtcgggggtaatggagttgaatcggagaggtgatgttgctgagggacagcagtcctcctcagcctcggccacggcactgcagggatcgctctgccgaccatgggatcgtggtgattttacgaggagattagccacattcaaatctatgtcatggtttgctaaaccaaaggtagttggtgctgtaaattgtgctagtagaggttggatcaatgtggatattgacaccatagcttgtgaagcatgtggggtgcgtcttcttttctctactccagcatcttggaatcagcaacaggtggagaaggcagcattggtctttagcttaaagttggataatggacataaattactttgcccatggattgataatgcctgcaatgaaacactagcacgatttcctcctgcaactcctccggtattagttgacaatttcagagaacgctgttttgctctcttgcaactatcagctcttccccgtatttcatcttcagcaatagactacatgcaaagccaaagcccacttctggaagactttcttggacaatctttgatgctggaatatggaaatggatctgctgaaaattctgggattggggatgttagtagtcaggaggaactgaaattgtattatcaggctcaaaagcttataagtttatgcggttggaaacttcatcctcttccttatgtagttgattggaaggatatgtcagatctgtctcttaataattcaactaatctagttgtccattctgctggaaccaatgaaaattcgaaaacagatgaaaattccaaggattctatcggggaacaaatggatccatattctgcagtattagattgcaccctatgtggagccactactggactgtgggcattctgtacagcaccacgacccgtggaatcaatcagattagttggatatgctgaagtgaatggtggaaatgctaatcttgaaaataggaaaggtgtaaataataccatgcctgatgttgcaaattcatcaaaggatacttcttcaagtctaaatatgacaattgcagggggtcctcccccaacaaggcaaaactttaaagcaataatatctctgcctattattggtcagaatttaagagctcgcctttcttatgattctgattttagggatcatgttttcgttgacagaggtggtattcaatcagatttacagaaggagaaaactgataatactgttaatgcttctattggacaacttgttcctgtgtcatctgaaatcagggagatatcgaattttgaaactggttctcaagctagtcttcatgattcagatgttatagcgggacaatcatctggccttaaggataagatgcatgtacacacagatgctgataaattgaatagttcaacagcaggatatcctagtacctctcagaaagactctacagaaggtgaagcacctttggtttcgcacaagactttggatggcgaagttggtagtcttgaaaattatggggtcaaagacagagaagagaatcctattaacagggacaatgtacattctagtttagggaagttgaagaaccccacggtgtccaataaattaatggaatttgatccaatcaggcagcatagacatttctgctcctggattgcatccatacatgatggggaacctgggtggaaacaaacattatctgctctgtatcatcagaaaaatcatttgccgcattcgccaaatagatttccatcatctatgcccattgttaagaaaatgggtggatactggataacaccatgggcaagagtgcttggagtgcccctaccttatttttataacatgcaatctgttcattga

SEQ ID NO: 15692 - DNA, 582 bp, Glycine max
  Peptide Sequence Number=SeqID_107377
atggatgtgaggaacattgctgtggtggtggaagacgtggatgctgctagaactgcactacaatgggcacttgacaacatcattcgctatggtgacataatcacactgctccatgtctaccctttatcaagatccaaaagcaaaagcaaagctcgtcttcttcgactcagaggcttccagttagcactttccttccaagacatttgcaacaacttctccaatacaaaggttgagattgttgtcacggaagagaacaaagaaggaatgaaaattgtggctgcggtgcgagagattggagcttcaatgctagtggttggacttcatgatcaaagttttctttacagcttggcaatggtccatagcaacatagctaactactttaactgtagaatccttgccattaatcagcctcctgagtccccactgagtccaatggtaggagtccaaggcagttcaaccaacatggacttttcacagatcgacatatctggattacaagttcctgaacctcctccaccaaaggtcaaggagaagaagatgaaagaaaagtcaacacctctagcatctctcgaagctgactga

SEQ ID NO: 15693 - DNA, 345 bp, Glycine max
  Peptide Sequence Number=SeqID_107378
atggaaaataggtctacatcatttctatgggaaagcttcgaattatttaaattgagtggtttggatctgattgagtctaacgatgaatggataactgaagagggatataatgatgaggatgaacaacctcaaggtgaaggtgatggtgacaatgttgaattagtaggagatgttggaggaagttcaaatgatctagttgtaaacgcttttgatcgagataatttaatttttatggaacctaatgatgatgcacaatctgagaaagaccttgatgatggaaatggtgatgaaagttatgatattcatggagatgatcctattagaggattgaacatgattttttga

SEQ ID NO: 15694 - DNA, 2367 bp, Glycine max
  Peptide Sequence Number=SeqID_107379
atggagtcagatgaagacgattttgttttctacggaacgccgatagagcgtgaggacgattcaatcagtcgcaagaagaaggccattgctgagtcctcaggtcagctccgagctctccctgcttggaagcaagaggttagagatgaggaagggcggagaagattccatggagcatttacaggaggttattctgcgggttactataatacagtgggctcaaaggaagggtgggcacctcagtcatttaaatcatcaaggaagagcagggctgaatttaaagagcagaacatactgaattttcttgatgaagatgagaaaactgaattggaaggttgttttttggggacaacttcacagtttgacacatttggtttcacagctgctgaaattgctcgcaaacaagctgagaaggaacagaaacagaggccatccataattcctggacctgctcctgatgaaatagttgttccagccactgagtctgttggggtaaaactgctcatgaagatgggatggagtcgtggtcgctcaatcaaggattcacattctgaggcactgtatgatgctagaagacaggcccgtagagctttcttagcattttcttctgatgatccaaaattgaagattactgggtctgagcccattgagggtgatgttgaaatttttcctgaggagcctgtgaatggcgatgctcagttttctaagagcacaccggtttacgtactcaacccaaagcaagacctgcatggattaggttttgatccttataagcatgctcctgagtttagagagaaaaaaagatcacgcttagccagcaaggggggaggacctggctatagcaaaaacttctccaccagagacagtctttttggtttgaaatttgatttaactcttagcgtcctttcatcagcaggaaaggctgcccctggttttggtattggagctcttgaggagcttgatgtggaggatgaggatgtctatgccactggttatgaatttgaagatgcttatgttcaagaagttgaagaaccttcaacgttgagattagaaaaccagagaacgaaagagcagaaggaccagggtgatctgcgtggttttagagttgcatccaattctgactttaaaatggaaagattcgaggctcctctgattcccaaggattttgtgccccaccatgaattttctggacctctcaacattaaccgcaagagctgtgaagttactccaccagatgttcctcctcctggggatgggaatttaaaactattaattgagggggttgcaaatctggtagctaaatgtggtaaattatatgaggatttatcaagagaaaagaatcaatcaaatccattgtttaattttctttctggaggaactggccatgaatattatgcaaggaaattgtgggaggcacaacagaaacacaagactagtcggcaattggatggaaaaatgcctcccagtgtgcagaggctaacagctgagagtcgaggccagatcctaggggaaaaacctctagaaaaaagttcccaagatctatcctcatctgtttcttctacagatattcatctccaatttaatcttactgatacatttactgagtctgcatcacttattgtgccttcaactcagataattcccttgacacgattcttagattccgttccgtggaatcttaatgataagggtatagctgaacctttgattgccagactctgggcacaatgccagagtgagttagtgaatgtggaaaagcctttcaaagatgatcctacaaagcaagaaagatttgagcagtttcttaaggagaaatataaagggggattacgctctgctagttctagtttagctagtgatatgtcagaagctgctcgtgctcaagagagactaagttttgaggctgcagctgaggcaatagaaaagggacgacaaggcaggggaagcaagcctttaattccatcttccatggattttatcccaggtggtgttatgcagtttacttctggtgaagtaaagccaaagaaagacctgctagctgaagatattttgaagaagaaaatgtaccctaagagggaagagtttcaatggcgcccttctcctcttctgtgcaaacgctttgatcttattgatccatatatggggaagccgccacctgctccacggattaggagtaagatggataccttgatttttacatcagattcagtcaaaggtaccaaagtggacgggcctgttacttcaaagaaagacatctcatctttgcaacaacctactaataaagacataaccaaaagtattactgaaatgaaactgaagaggatgtggaagtcgaaaatattgaaaggccagttgacctatacaaggtaa

SEQ ID NO: 15695 - DNA, 315 bp, Glycine max
  Peptide Sequence Number=SeqID_107380
atggtgccaccaccacttcgccttcccgtcatggtcgtgactacaaatctcggtcatgctgaagcctacgccaccttcattccatcgcaacacctctatgcgaaactccctttgcttgtgccaccacaatttccactcggattcgcaaaacttgaccactgtgggcgtcggaggaggaaacccaaaggcagggaagggagtcaagagaggtacagaggaagacgaagagatgaggaggcaggagagacgctcaaggaagatgttatagaagaagatgctacaaaagaagatgactacgaaaattttggaaaatga

SEQ ID NO: 15696 - DNA, 294 bp, Glycine max
  Peptide Sequence Number=SeqID_107381
atgaacactactcatgaagaagattgcagcattttgggtaagaatccaagggcttatcaacttcttaagcatgcagtcatgaagaataaccatgcactttattccacagtcatgccttggaaaaaccagatcatggtgagagacgaatttgacacccttgttgaggaaactatagtttgttccattcctgaacaaggttctggttgttgtggaatttcatttggaagttctaagctaataccggctaatggggatgatggttacattgggccaagtcagtgtgctcattcctaa

SEQ ID NO: 15697 - DNA, 240 bp, Glycine max
  Peptide Sequence Number=SeqID_107382
atggtgagattgatccaaaaggggagatggagtgcagagagagaaatgatgactcggctggcgagtggcgactcgaggaagttgatgttcgcaacaattgccttgagacgattcattgcagatcagaagaacaacgctaatgttggagcattggtaaagagtggaatcggaattgacacagttggagtgaaagcagaagtcctaattttcttcttccataatttgaggtgcactacatga

SEQ ID NO: 15698 - DNA, 1032 bp, Glycine max
  Peptide Sequence Number=SeqID_107383
atggaaaagaaagacaaaggtataataaggagcttgaggagattggagacatacactatgggttctgctaacggactaactgctataaatgggaaacaacctctcttttcttttgggttgatatccgatgtgcaatatgctgacattcctgatggtaggtcattccttggtgttccacggtactataggcatagcattgtagtgttacagagagcagtaaaagaatggaatactagtaagaggcacaagtttgtgataaattttggggatattgttgatgggttttgtccaaaagatcaatctcttagcactgtaaagaaacttgtggatgaatttgagatgttcaacggaccagtgtaccatttgattggcaatcactgcctatacaatctgcctcgaagtaagttacttccattgttgaagatcaagagttttgaaagccatgcttactatgatttttcaccagtgcctgaatatagatttgtagttcttgatggctatgacataagtgcgattggctggcctcaggatcatccaaaaacattggaggccttgaaattcctccgggagaagaatccaaatgaagacaagaacagtccaacaggtttggtgggccttgaaagaaggtttcttatgtttaatggagctattggaaaggaacaaatggaatggttgaataatgttcttcaagaagcaacaaaattgaaacagaaggtggtggtgtgttgccatctccctctagatcctggtgcatcatctaaggaggcactgttatggaattatgctgaagtaatgaatttgatacacaaatacacttgtgtgaagctttgtctatctggacatgatcacaaaggtggatactcccttgattcccatggagttcaccatagagttcttgaagctgccctggaatgtcctactggaacggatgcatttggatatgctgatgtttatgatgatagagtatcactttatggtactgacagaatgcagagtacagacatgtattttcatcctaaagcagatttgtga

SEQ ID NO: 15699 - DNA, 207 bp, Glycine max
  Peptide Sequence Number=SeqID_107384
atggcagaacatgtttttcatacttcattactagtacctttcaaaccaggaaaatacacgaccattgcccagaggttcttcgctatgcgaaggtatgggggagggatattgtacgcagccttacccttgcatatgcaaagaggctgtttccggattcgaacccatgaccaacaagtcaccaaggcacaacttttaccgctgtactag

SEQ ID NO: 15700 - DNA, 1641 bp, Glycine max
  Peptide Sequence Number=SeqID_107385
atggcgaaagcacgcaagtcgcaagaagaaattgcgagtgaagccatcaagcatgctttgaaggctctgcggaagcgccatttgcttgaggaagctgctcatgctcccactgttctagctctttctagacccatcgtttctcagggctctgagtggaaagagaaagcagagaatcttcaaatggaacttcagcaatgctacaaagctcaatctcgcctgtctgagcaacttgttgtggaagtagctgagtccagagcttcgaaaacgtctcttcaagagaaagaaaatgcattggctgatctgcagaaggagttgactgaattgagggatgagtgctctcaattgaaggtggacttggaagaaaaaattaaatctctggaactggttgtcagtgagaattctgaacttaaagcacaactggagcagatgactactaaagccaataaagctgaagctgaaaacaagatgttgattgaccgctggatgttagaaaagatgaaggatgctgaacgcctaaatgagaacacctcattgtggcctatggcaccgccatcacaaattgcctatggcaggcggatggtggaatatggcagaacacctcattgtggcccatggcaccgccatcacaaattgcctatagcagttggcaaaaaatccaccacgcattccgccatggcagccatggccaacacactgtatgaagagatggttgagaaactaagggccagtggtttagaacaacttgcaaggcagcaggtggatggtatagttcgccgaagtgaagaaggtgctgaattcttttttgattcaaacatcccttccacatgtaaatacaggcttcgtgcacatgaaggtggttgtgcttccatgttgtttgagtacaattccagtaaattgattactgggggacaggatcggttagttaaaatgtgggatgcaaatacaggatccttaagttctactcttcatggctgccttggctcagtattggatctcacaatcacccacgataatcaatctgtcattgctgcaagcagctcaaacaacttgtatgtatgggatgtcaactcaggtcgtgtccgtcatacccttactggccacactgataaagtttgtgctgttgatgtcagcaagatttcaagtcgtcatgttgtcagtgctgcctatgatcgtaccataaaagtttgggacttagtgaaaggttactgcacaaacacagtaatttttcgcagcaactgcaattctctttccttcagcatggatggtcaaaccatattttctgggcatgttgatggtaaccttcggctatgggacattcaaactggaaagttacttagtgaggttgctgcccattcacttgcagtcacgtcactatccctttcccgaaatggaaatgttgtactgaccagtggaagggacaatttacacaatttgtttgatgtgcgatctctggaagtttgtggcacattaaaagccatgggaaacagagtggcttctaattggagtcgctcctgtatcagcccagatgacaatcatgttgctgctgggtctgctgatggatctgtctatatttggtcaatatctaaaggatacaaagacctcgctgcagtggggacagacaggaatgaggctcctgactga

SEQ ID NO: 15701 - DNA, 327 bp, Glycine max
  Peptide Sequence Number=SeqID_107386
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccagataaaaacaaagagccaaaagacttaataggaattagaatatga

SEQ ID NO: 15702 - DNA, 2922 bp, Glycine max
  Peptide Sequence Number=SeqID_107387
atggatggtaggaggcattctgttgatattcctatttccaaaactcttatggcactgaggagagtgaggtcattgagggatccatcaactaatggtgttagcagactctctcctttgattgatgatggagattgggaagatggttctagtaatggtgtttctctgagtttgaggttcctgaatggttctcatgcatgtgattctaatggtaatggtcttttaagatcaagtagtttagattttaagggacaaagggagcaggacactgctgagtttgaattagacatgtggaactctaagatgaaccattgtgggatctcatgtcaggaagggcaacaagatgatggactagtttactctaatcctaagcagcaatgtatttctggagacaaatcttcaaatgaaagctgttgtagcaaccatgaaggtagaggattggatttggtttccatcatgccttcttctaatcatttgaaggatggagagtcctgctatttgtcaactgcaacaagagtagaacactcaaagtcggcaagaaaatccctacgcaagaatcaagtgaaaccatcggaagtgattggtgatattgcaagccatgtaggaagccaacaatgcctttctgtttttgatgcaccctcagctcgtagtgcctcggaacatatcactcaggatgaggacgttttggataattaccatggatgtggattaaggagttgttggtcaaagtcaccaaggtttagagaatcaaatcattattctgaaatagaaggccttcccttgatattgcaacacgtaagtgagacggatctcaatggacatagaaacatgagacacattggtggtgaaattagtccaactttggaaactcctagaagtttatccatgaaattcaggccaaaatctttcagtgatttggttgggcataatgtgataggaaagtctcttttgggtgctatctctacaggaaggatatcatcattttatctcttccatggaccacgtggcactggcaaaacctctgcgtctaggatatttgccgctgcactgaattgcctctcccctctggagcaaaagccatgtggtctgtgtagagaatgtgttttgttctttttgggaagaagtaaacatgttaaggaaattgattctttgagaatcaaccgtgcagacaaggttaagtcccttgttaagaatgcatgcattcctcgagtttcctcgtgttttaaggtgttcattgttgatgagtgccagttattgcatgcagaaacatgggcgtgtcttttgaatagcctagagaatgtttctccacatgtggtttttgtgatgatcactcctgatttggataagcttcctccgagtgcactttcccgggctcagaggtatcactttgcaaagattaaagatgttgacattgcaataagattggaaaagatttgtgttgaagaaggtcttgaatctgaacaagttgctttggacttcattgctgctagatcctgtggttctcttagggatgctgaaactatgcttgatcaactgagtttgcttggtaaaaaaattaccatttccttagtccacgagcttactggggtcatttctgatgatgaattgcttgatttgctggacttggctttatctactgacacttcaaatacagttataagagcccgggaacttgttaggacaaggatagatcctttacaacttatatcacagttggcaaatcttattatggacattcttgcagggaaatttgaacttggtgattcggaaatcagaagattttgtaatagatacacctcggaagcagacctgcagaaactaagtcgtgcattaagaatactgtctgaaacagagaagcagttgagaatttccaagaatcaaacaacatggttcactgcagctcttctacagctgagctccgtagaatattcatctgcggatacaaatgatactaagttgtgtgcacgatctgcgtccaatagaggtgatggtgatatctgcagtacatctcctaaaggggacagcttggagcatcttgctacaacaggtcaatgtgatgacaagtcagatacattaggattaggagtacgggaggatcacagaagaacattggattctatatggtataaagctactgagatgtgtcaatctaacaggctcaaaacttttctcaggaaacaggggaagttgtcttcagtttgtattagtcaagttgccgagttggagttccaccaccgtgactatgtaagtagggctgagaagtcttggaggctgattgcaagttctctgcagttcatattgggttgtaaccttgagctcagaatcaattgtgtaccttcttgtacttcggattctatctatgctaaattgaagaggacatctttcagtttcttcggttgttctcggagaattcgttggaaatctatatcatctaatgaacaaggaagtgaatcagactatgctgattacacctctcaaaggcccatgatgaagactcaaactctaacttgttcctctaatcgtgaacctcgggtgccatcatttgagtcctacaatggaatgcaggtcgtgacaactttgagaagtagtgaaggaaatttgctaagctcagggaaaatgtttttgaataggccagatcaagagactccaagaatttcttgttcaggagttgattctctcaaggaagagggatgcaactatgagcttctagctccatcaacccttgatttagataatcagtctgactgctttccccgaactcgctggcttcataaaaagttctcttcttcatatgcatcacaagagaagaattttgttttatctatccccaagttcaaatgttctgaggcttatggatatgatctggaaccccgtgtcttttcccacagctctaacaactgcatcaatgccattgaggaaaagtag

SEQ ID NO: 15703 - DNA, 1662 bp, Glycine max
  Peptide Sequence Number=SeqID_107388
atgggaggctctgaatccgtttctgtgccactttccatttccaatggcgaagagccccaattgggtgcatcttcttcccccgccgctcctcctgagccatcagatctcaatcacgcggcggaggaagaggcactctccagggagcttcagagcaagttggatttgaaggatggggatgagagtgaagagagagtttcggacttgaacgatggtagaggtgtttgtgatgaagaaactggtaagcctgacggagatagtaggggttgggagaccaatagttggaatgaggaagtgggtgttgatgctgaagttcatgtttttggtgatggtgatgttcatgatgctggtgatggtgatgttcatgatgttggtgatggtgatgttgatgttgatgttgatgatgaagtggagaagaaggaagggggaaacagtggtttagctcagcactaccctttgaggcctgaagctgaggactgtgcattttatattaaaactgggaattgcaagtttgggtttaattgcaagttcaaccaccccattaggaggaaaagtcagtggaattgttgggttgagaagaagggtgttttgcctttgctgaaggctgttaaagagaaggcaggagaaagagaagaaaccacagaaagatcgggcatgacagaatgcaagtattatcaaaggtctgggggttgtaagtttggtaaatcttgtaaatataaccacacaagaggaaaaatttcaacagcaccagcaccacttttggaacttaactttcttggcctgcctattcgtctgggagagagagagtgcccctactacatgcgcactggctcttgtaagtttggagcaaactgcaagttcaaccatcctgaccctacagctgttggaggagtaggaggtgatcctgcttcagggtatggtaatggagggtctatttcattacaaggtgtatcacaaacatctgtaccctcctggtcttctccaagaacattaaatgaatcatctccttttgtgccaatgatgctttcacctactcaaggagtttctacccaaagttctgattggaatggatatcagacttgtcatttatcctatgtgttttgttacaggcatattaaagagtcatgcagattaagcaatgcacatttggctttatgcccaggagcaattttactgatccctaaaaaagcatctgtctacttacctgagaggaacatgcatccaccttctacatttgtcatgaacaacccagcaattgatacaaatgtttacatgcaccatcaaaagcagatgcctgttgatgagtttccagaaaggcctggtgaacctgaatgcagctacttcttaaaaactggggattgtaagttcaagtctaattgtaaattcaaccatccaaagaatcgggttgcaagattacctccatgcaacctcagtgacaagggtctgcctttgagacctgaccaaagtgtctgctcccattacagtcgctatggaatttgcaaatttggaccagcttgtaagtttgaccacccgataaacttgcagcccgtgatgattcctggacttggtcagcaatcctactcaaactcagctagtgttgaagtggctgggatatttggaagtacaggtgttgtaactgatgcgacaattcagcaatctgtgtaa

SEQ ID NO: 15704 - DNA, 1143 bp, Glycine max
  Peptide Sequence Number=SeqID_107389
atggcttcttctgtgtcatccatggtttctaccaccctcctcctaattaccatctgcacactgtcctcacttctgtcagttgcatctgcagcaacagaggagggacgaacaaggccattcaaaagggtctatgcctttggagactctttcacagacactggcaacacccaaaatgcagaaggtccaagtggctttggccatgtttcaaactctccctatggaaccactttctttaaccactccaccaataggtactcagatggtaggcttgtgattgattttgtggctgaagcactttcactgccttacttgcccccctaccgtcatagcaaaggcaatgacacttttggtgttaactttgctgttgctggttccacagccataaaccatttgttctttgtcaagcacaacctctcccttgacatcactcctcagtccatccaaacccagatgatatggttcaacaggtacctggagagccaggactgccaagagtcaaagtgcaatgattttgatgacactctattttggtttggggagattggagtcaatgactatgcctacactcttggatctaccgtctcagatgaaaccataaggaagcttgcaatcagcagtgtctcaggagctttacagacattgcttgagaagggtgccaagtacctagtagtgcagggtttgcctctaactgggtgcttgacattgtccatgtacctggctccaccagatgatagggatgacattggatgtgtgaaaagtgtcaacaaccaaagctactaccacaaccttgtgctgcaagacaaattacaagaattcaggaaacagtaccctcaagctgtcatactttatgctgattactatgatgcctaccgcactgtcatgaagaatccaagcaaattcggattcaaagagaccttcaacgtttgctgtggatcgggagaaccaccttacaacttcactgtgtttgccacatgtggcacacctaatgccactgtgtgctcaagcccttctcagtacatcaattgggatggtgttcacctcactgaggccatgtataaagttatttctagtatgtttttgcaaggaaatttcacccaacctccgtttaattttttgttgggaaaaaaggagagggtggggtga

SEQ ID NO: 15705 - DNA, 366 bp, Glycine max
  Peptide Sequence Number=SeqID_107390
atgaatgaagaagcatcgaaagacacacttggaagcacaagaaaagaaaagggtggcatatataagagttatctaacttcgtcgcggctacttggatcatttggaagtctaggaacatggagcttttccaagacaaggtgtggcacccatggcacaccctcactcaaattaatcatctggttagggagatcaaagtggcctttgcccaacccttctccttcccctccagatcccaacaccattaaaatcaacactgacggaagctcctttgggaacccaggaatatcgggttatggtggtgtctttcgtaatgagcatggccatgtggcttcttggtttctcgggcaacagtgggtttatgactaa

SEQ ID NO: 15706 - DNA, 232 bp, Glycine max
  Peptide Sequence Number=SeqID_107391
gctactcgatattgggcctttgagcacaagtgaagatgaagatctagaaaacaaaaactacaagtacagtatggtggaaattactttcagtggaccaatggaagtttttggtgttcgagcagtaccagccctatcaaacaacttgttcgggttttcaggcctagctgctgttgctgattctgtgcttgtggttgcatttgcttgttcctcttcattgcttcttccactttag

SEQ ID NO: 15707 - DNA, 2115 bp, Glycine max
  Peptide Sequence Number=SeqID_107392
atggagcttataaggaaacgtttgaaggatcatggtatttttgttccatcccgactcaaagtatttagaacgaggaagaagtttatggctgggccatttgaggtagagcctatcacagtgactcattctattcctgattgctgtggactagtgctccgttgttctgatggtaccattcttcacactggggattggaagattgatgaaacgccattagatggtagagtttttgatcgtgaagctctagaggaactctcaaaagaaggagtcacattgatgatgagtgattcgacaaatgtactctcacctggaaggacaaccagtgaatctgttgtggcagatgcattattaaggaatatttcagctgctaaaggaagggttataacgacccagtttgcatccaatatacatcgtcttggaagtgtgaaagctgctgctgatttaactggtagaaagttggtatttgttggcatgtcgttaagaacatatttagatgcagcttggaaggatggaaagtctccaattgatccatctactctggtgaaagcggaagatattgatgcttatgcgccaaaggatttgcttattgtgacaacgggatctcaagcagagccacgtgctgccttaaatctagcatcttttggaagtagtcattctttcaagctgacaaaggaagatactgttttgtattcagctaaggttatacctggtaacgagtctcgtgttatggaaatgctaaaccgcatatcagagattggatcaactatagttatggggaagaatgaatgtctgcacacatctggtcatgggtatcgtggagaattagaggaagtacttagaattgtgaagccacagcattttctacccatacatggagaactcttgttcttgaaggagcacgaattacttggaaaatcaactggcattcggcacacaactcaactgatgagatttatgctccaggttattaagaatggagagatgcttggagtttctcatttgagaaatagaagagtcctttctaatggttttatttcacttggaaaagagaatttgcagttgatgtatagtgatggcgagaaagcgtttggtacatcaagtgacctctttattgatgaaagattgaaaattgcattagatggcatcatagtggttaacatggaaatatttcgccctcaaaatttagacagtccagttgagaacaccttaaaaggaaaaataagaattaccaccagatgcctgtggcttgacaaggggaagctgttggatgctctccataaagctgctcatgctgctcttgcaagctgccctgtaagctgtccactggctcatatggaaaaaattgtgtctgagatgttgagaaaaatggtgaggaagtacagtggcaaacggcctgaagttattgccattgccatagaaaatcctgcagctgttcttgctaatgagataaacacaaagttgtctggaaaattaaatgtggatgggatgtcggcattgagaaaagtggtggatggacatgagaaagagaatcagagaaccgaaatgcaaataagagatcgtattgatgtaggtggtctactacctacaaaagacaatgctatctcaagtggagctgaggatggcttgtctgatgcggaggatccaaatgattattttaaaccatttgttgaatcctctccagttgagaagtcaattaaaactaacaatggttatgttccacgaaaggagaagtcatccccattgaaggatgactgttctgaagacactgaagaatgcaattctgtaaatacatcagattctgaacccaaatcttcaaaatcagcaaagagaaataaatggaaacatgaagaagttaagaagctgattgatatgcgtggggaactgaatgacagatttcaagttgtgaagggaaggatggccctctgggaagaaatatctcagaatttgttggctaatgggatcagcagaagtcctgggcagtgtaaatctctgtggacttctttgttacagaaatatgaggaggtgaagaatgaaaagaagaacaagaaaaaatggccgtattttgaggacatggaaaggattctagctgataacaagacactagaaacaaaatga

SEQ ID NO: 15708 - DNA, 189 bp, Glycine max
  Peptide Sequence Number=SeqID_107393
atgatgatggtaataatgttaggagtagcggtgacgatagagatatatgtcgacagtgatggagtgatggtgacaaaggtggtaaccaatgataacaatattagtggtagtgacaaaggtgatattaatagtaatggtgatgatagtgagacggtgatgacagccaatgatgataataatgacaagtaa

SEQ ID NO: 15709 - DNA, 873 bp, Glycine max
  Peptide Sequence Number=SeqID_107394
atggttttgtttgaaatgcagaatatgtgggattcgacgcccgacactgatctgttactggagcttcctgaagaatatactttcgaaacagcactggctgatttaatagataattccttgcaagctgtgtggtctaatggggaggataagaggaagctaattagagtaaatctgggtaaaagtaagatttcaatcttcgacaatggcccagggctggatgacactgacgagaattcccttgtgaagtggggaaagatggatgcttctcttcacagatcttcaaaatcaaaggcaatcggggggaaaccaccatacttaatgccttattttggaatgtttggatatggtggacctatagcatctatgcatttggggaggcgtgcttcagtttcttacaagacaaagcatgtgaagaaagtctacacattacatcttgagagagaagctttgttaaatacatctagctctcaactcacatggaagaccggtggcggaatcagagatcctttagctaatgaaattagggactctcatggaagctttacaaaggttgaaatttacgagccaaaaataaaagatgttcacataaatagactcccgtcccatctgaaagacctatatttcccttacatacagtgtctccaccaagccataggagacaagaaatctgatgaatggcttgagattggatcatttcccaccagctcacacgatgggcttactcacctcatcattggccataaactgaatggtcagaactatacacaatgcgtaaggtcagtcaagatctttcttcgaggaaaaggaaaggaagactacatctctggagattcagagtgtcccaagaaaggggacacaaatgttcaaaaatga

SEQ ID NO: 15710 - DNA, 141 bp, Glycine max
  misc_feature (9)..(9): n is a, c, g, or t
  Peptide Sequence Number=SeqID_107395
atggctganataggtagtatgactaagtattttcttttttgcggcttgcaggctctaattgtgacagcaatgtcagagattgatggtgatgaattaaaggatagacaactaacaaatggaagtcttgatggtagattgtaa

SEQ ID NO: 15711 - DNA, 2166 bp, Glycine max
  Peptide Sequence Number=SeqID_107396
atgtctcattatgatatacttgaatcttacgttggaagcaccgaaaaggccctagaagcaatattttattcttacaagagatatattaatggttttgctgcaatacttgatgaagatgaagcagcgaatgtttcaatgcatccgaatgtaatatccgttttcttaaacaaagaacggaaattacatacaacaaactcatggaatttccttgggttagagagaaatggtgtgtttccacatgactcagtatggaagaagactaagggtgaagatatcattattggaaatatagacacaggtgtttggcctgaatccaagagttttagtgatgaaggttttggaccgatcccgaaacggtggcgtggaatctgtcaaacagaagataaatttcactgcaacaggaagcttattggagcaagatatttctacaaaggttatgaggcaggttctggtataaaactgaatgcctcagaggttagtgtacgtgactatgaaggtcatggttcacatactttatcaacagcaggtggcaactttgttgctggagctagtgtgtttggttttggcaatggaactgcaagtggtggatcaccaaaagctcgagttgcagcctacaaggcgtgttggccagatacgttctttggtggatgttttgatgcagacattttggctgcttttgaggctgccataagtgatggcgttgatgtgatttcgatgtctttgggttcagaagatcccccagaatattttcaaagctctatatccatagcatccttccacgcagttgccaatggcataacagtagtgggttctggaggaaattcaggaccttctcctggaactgtatccaacaatgaaccttggatgctcacagttgctgcaagcacaactaatagagacttcgctagccatgttacacttggtgacaagaaaatcctcaagggagctagtctttcggagcatcacttgccatctaataagatgtacccattgatcagtgctgttgatgccggaactaaatatgcagctgttaacgatacccccttttgcctgaacaaaactcttgatcctgagaaggtgaaggggaaaatattggtctgtcttcgcggtgttaatggtagaattgagaagggtgtgatagctgctagtctaggcgctgttggaatgattttggctaatgacaaggactcagggaatgaagttctatccgacccccatgtgcttcctacttcacatgttaactttgctagtggaagttacatttataattacatcaaccacaccaagtctcctgtggcttacatttctaaagccaaaacagaattgggtgtaaagccagctccatttgtggcttcattttcatcaagaggccccaatctccttgagccagcaatcctcaagcctgatgtcactgcaccgggagtcgacatcattgctgcttatactgaagccgtatctcccacagatgaggcatctgacacacaaagaactccttactatgcattttctggcacttcaatgtcatgtcctcatgttgctggccttgttgggctgctcaaagcctttcatccagattggagcccagctgctattaagtcagcaatcattacctcagcaactacaaaaggtaacaatagaaggccaatcctgaattcatcatttgtgaacgaggcaactccatttgactatggaggaggacacattcgaccgaatcacgctgtggaccctggacttgtatatgaccttaacactgctgattatttgaactttttgtgtagtcgtggctacaacagttcccagcttaagttgttctacggcaagccttacacttgtccaaagtcattcagtttagcagatttcaattatccaacaatcacagttcctcggattcaccctggacattctgtgaatgttacaagaactgttactaatgttgggtccccaagcatgtatagagtgctcatcaaggcaccaccacaagttgttgtttcggttgagcctaagaaactgaggttcaagaaaaagggtgaaaaaaaggagtttagagttacattgaccttgaagcctcaaactaagtacaccactgattacgtatttgggtggttaacgtggactgatcacaagcatcgtgttaggagtcatattgtagttaacattcagcattaa

SEQ ID NO: 15712 - DNA, 1365 bp, Glycine max
  Peptide Sequence Number=SeqID_107397
atggaggtcgtactcaaagagttgcacgccgatcttcaatctctgagccaatcgcttcccgatccatctcaccatgatttgctccgcaaggtttttcttcctttacaattctcacttcatattccgatcccctcaatgaagccgaagattccgagttgctttgctcacgaaaatttcattcgtttatctgattctgtcatgattcaattgcgtgttgaggaccttgcgaagcttgcagaggctgcacctgttcgtcgctctaaagttgaggatatgagtgctgaggttgtagatagcaatccttatagtcggcttatggcacttcagagaatgggtattgtggacaactatgaaagaatacgcgatttctccgttgccatagttggagtaggtggtgtaggaagtgtttcggctgagatgctaactagatgtggtataggtagacttttgttgtatgattatgacaaagtggagctagcaaacatgaataggttgttctttcgtccagatcaggttggcatgacaaagactgatgcagctgtacagactctgtcagacataaaccctgatgttgtacttgaggcaagttttgaaacctttatgtcgagtttgaaaaataagtcacttcgcccaaataaacaagggagtggcgtggatctggttttaagttgtgtggataattatgaagcaagaatggctgttaaccaggcttgtaatgaattgagccaaacatggatggaatcaggtgtttctgaggatgctgtttctggccatattcaattacttattcctggagaaactgcctgttttgcgtgtgcacctcctcttgttgttgcatctggggtagatgaacgtacgctcaagcgggaaggggtttgtgctgcatctttacccaccactatgggggttgttgctggccttctagtccaaaacactctaaaattattgctaggctttggacaagtctccccgtatttgggatataattctcttaaggattttttcccaactatgcaaatgaagccaaaccctcaatgttcaaatgtagcttgtttggaaagacaggaagagtacatgcttgcaaaaccagcaagagatgctgcagccaaagcaaaaatggaagctgaagcaccatcaactgaggaagtgccacttcatgaagaaaatgaatggaatataagtgttgttgatgatattgagctggatagtccggataccagaagttcagatgttctgccggaaggtctcacacatgaacttcctactgctgacgagtttcataaggcaactcttgacgctccattagttgacaatgacgaccttgaagatcttcgtaggcaacttgaagccattaattctgcatag

SEQ ID NO: 15713 - DNA, 1317 bp, Glycine max
  Peptide Sequence Number=SeqID_107398
atgggtaaggcgtcgaagtggtttcgcgggcttcttggtctcaaaaaaacagagtatgccacctcacccgccaagcctcccaaagagaaacgccggtggagcttcgttaaatcatcatacacagaaaaagacaacaccactgccgccacgtgtccaccactaagaaacaacaacaaccacgcaatggcagtagcagcagccaccgctgcggtggccgaagcggcggtggctgccgccgaagcagccgccgtcgtggtgagactaactagtaacagcggcaggtgcgccgacggcggacccacccggattcgccaacattgggctgctgttaagattcaagccgcttttcgtggctgtttgggattggtgaagttgcaagcattggtgagaggccacattgagagaaaacggacggcagagtggctgaaaagattgcaagcactcttacatgcacagacccaagtttctgcagggttgaccctgcatgcctcaccttcgagttcaaagttatcaagccacctccaaggtccagaaacacccgaaaaatttgaaagccccattagatctaagagcatgaaacatgagcactcacctatactcaagagaaatggctccaaatcctgtgccctgatcaatggctatcaagagatatgtgggagtagatcagagagtcaagggaatgaacaattatggaactcaggaagatcaatgaatagagcacacggctccaatgatgaaagaaatggcaaggttcttgaagttgattctggaaaaccgcacttcacactaaagcgtcgaaacctctcttactccacaggctctgatctttatagtaagagtttgaacagcacaaaggaatcaacatctcttcaatctgctcaaagtccatgttgtgaggttcagtctcacagttacagctcgcaaaaagtgaacaatgaggttgaggagagtccattctgcactgctgacaatagtccacaatacttatctgcctcttctaaagatgatggcttcaaaagaagcccttttactcctactagaagtgatggctctagaagctacattcgcggttaccctgattatcctagttacatggcatgcactgaatcttcaaaggcaaaggccagatctctgagtgcaccaaaacaaaggcctcaaagtgagaggtctggttcatcggatagatactcactcaatggatttgatatgtcaagattggccactcaaagggcaatgcaagcaagcttcaccaacaaagcatatccaggttctggtcgtttggacaagcttggtatgcctgtggggtacagattctga

SEQ ID NO: 15714 - DNA, 1327 bp, Glycine max
  Peptide Sequence Number=SeqID_107399
atgaatatccgtacaccaaccccccttcgcaacggtcatatttcaccgacatctctcaacggtcatataactccctatctctgcaccgttggatgtgaatccgacgacgagaagaggggaactactacctacggtgatggagacagtgctcgtgtcgatcatggagtggtgaagaagaagaagaagaagaagaagtgtataccacaacatggtgcaaatgcgtgtttaaaaagagaggtggggttgttcaacgtttacccgctgcaaatgaaggacttgttcaacgtttctactgctaatatggctttcactatttctcctcaggactactactactactactacttctgccacaaactccaagtgaagaagaagcaagcggcgttacaaaaaccaaaacctcagacgatgttggctgggtgttctagttcgacattgttgtcaccaaggcacagattgaggagcgaagcaccagcacagtttcaagcctgccacttccagctaccttcttccatgagcacgcagagattggacctgccatcatgcaccaccgccaccttcactcgcaacaacaaagaccatcatcatcatcagcccctaagaccagtgggcctctccgtggatcagaaacacatcgaagccaagaccagcacctgttctctcaagcaacacattcgactcccacctcttgccatcactgcatcagcaacaccattggtggaagagtcatccatcatcaacgacaacaacaacaagagtttgaagaagaggctcgcggcggaacaccacgacgattccttcgccaagaggaaaaagagtagcagtactactgagtgtgattggtttcagcctgatgttgttgagactactactttaggagggtttaacaacaacaacacttcacttgtttctttctcctcagaggaacaagagagggtttgttttcttccttctgaagtggtgtctcattctgcacctttccctttgaacccctggctggaatcatgcgtaacaaagatcacaaatttcggcgagggtagccaccgtcatcctcatcatcaccaccacccccaccaccacaacgaccatgcctcaggctccgtctccaatgcttcctcggagagccaaagcctgagactaaacgacaacgtttcagaacacgaagtgggaaacggttcagggaacccttactaccatcaccgcaaggtggaagcaggggaagaagacgaccatcacgggttcgagctcgtgagcttgctcaccggctgcgtcgacgcaattggatcgagaaacgtcactgcaatcaaccatttcatagcaaaattgg

SEQ ID NO: 15715 - DNA, 1758 bp, Glycine max
  Peptide Sequence Number=SeqID_107400
atgcacccatctcgtgccgaagcagcagcatcacaaccctgctttaatggctgtttcccatctccacttcttgcctctgagaagtcccatagaactacttcttccaagcccaaagtcgtcaataataataatgtaacttcatcacacgatgacttcgtcgcagccacatcttccacccttcacccacacacaaatttcaccaaccacgagtccctcccatctttgcaagactcatacatcagcttcaccaaagcattccctcagttctccacaacaacttctgaagtcgatcaaattcgagccctagaataccatcacttgagcaaccactccaacgcctgcttcgactacaccggttatggccttttctcctactatcagcaacaaagaatatcttattcttaccccacaattgcttcttcttcttcatcctcatttccttacttcagatcagatgcatccttctttgatatatcatacaagtcagtgaacttgcagtcgcaggttctatacggtggacacgagtcagaactagaatccagaatcagaaagagaatcatgtctttcatgaatgtctccgaagctgagtacacccttgttttcattgctaatgaggtatctgcttttaaaattgtagctgattctttccaatttcaaaacaatagacagctcctcacagtgtatgaccatagcagcgaggctttggatgtgatgattgagagctgcaagaagcaaggggtgcatgtcttgtcagcagaattctcctggccaaacctcagattggagtggaggaaactaaagaagatggtaacgaagaacaaaagggaaaagagatcaaaaggaggtttatttgttttcccaattcattcgagggtcacaggagcaccatattcctatgtttggatgtccatggcacaagaaaatgggtggcgtgttatgcttgatgtgtgtgggttgaaacctaaggaaatgggcaccttggatcctggttatgccacaagcataggaatcataagccttgtcccagcatatagacatgagactgatgaacaagtagttattgaaactgatgaagcagatcatcagcagcaagatggggcatcatctgcaacagaaatagaggagttaaacataataccctttgactcatctagagatacaaacagattaggtactaaaaatgaaggctttgagattcattgtagaggattagaccatgcagactcggtggggttattactaattagtagcaggaccaagtacttggtcaattggctggttaatgcactaatgagtcttaaacatccacatcatgaaaatagtatttccctaattaggatttatgggccgaagataagttctatccgaggacccgctgtggcatttaatgtatttgactggaaaggggagaaatgtgatcctgcacttgtgcagaagcttgctgataggaacaacatctctttagggagctcatatttgagaaatataaggttctctgacaagaatgaagaggagagacattgggcctcagaaacaacaagaggttgttctgaggttgaaggattgggcctgtccaagaaaaagacacgtagccatgagcctgggatttttgttgtcactgctgcactgggcctcttgacaaacttcgaagatatctacagattatgggcttttctttctaggttcctggatgctgactttgtggagaaagagaggtggagatacatggctcttaaccaaaagactattgaagtatga

SEQ ID NO: 15716 - DNA, 1383 bp, Glycine max
  Peptide Sequence Number=SeqID_107401
atggcttctactggtggcaaatctcattctctaataactacctcaaaacgctccgttttgctgaaggactacctcagggatgacctgagttcatgttcatcgaacggtttcaaatcgctcacacgccaacaatgctgcaccaccgtgggatttttcatggagaaagatctccaactccaacgcaaaagaaggaacacattcactccacggtccactacatcttcttcttcatcaaccatattggctctgcagagagcttctggagccataatcaacgcgataaagtcactgccgttgtcacaaaagagtggtgtcgctggtgttctttctagaagcttttcgaggaaggtgttgagtagaaggttcttctggagaaaagcggcggcgagggaagagggaagcgaaggtgtgccgcggaggaggaaatctttccgcgaactcattatgctggatcatgaggagcatcgtaaagcgacgtcgtcgttgaatgaggatactgatactaccgttttcgctgcacatgccccgagcgtcaccacctcttcgggtcgcggcagtgaaagctggggagacagtgaattcacttttgcgtctaacgctgcttcttcttcctctgagagctccaacgagaattacctcgtacttgaggatacaaaagaaggtgcgccacatcacaagctggaacaagtagtaaccaaggaatattggccaaatgacgagaaggaacaatttagccctgtatcaatactagattgcccatttgaagatgaagaagataattacaagtctcatatcaattccacttccattattctttccttttctgaaggaaggaaacacaagcacatgcacaaaagatgccattttgaaagcgtggttccactggagccggtggttttggagaaaaagttcgcgcggttagagctggaggatgaaccacacaagcattctacgaaacaatgttccaccgtattagctccaacatttcgtcgtgacaacaataacaacatcgaggagaatgctcgcgatcttctcaacttagttaaaaggtcaattgcacccaacgttttgataacaaaggcagagaatttgctgtttgatttcttcaagaagagtatagaggaaaacaaagacattgattactcaaagaagcttcaactttgcaaggtagctgaggattggatacatgggcaaccccaagaaccgtatttgggttgggaagtgcagggaggaaagtgtgtctacattagagagatggataagtgtgaggagtggaaaaactcgtatcaagaaatacaacaattgggtcaggagctggcaaacgaggtattcactaatttggtgaatgagttcatatttgaactcacgacacgtgctagctag

SEQ ID NO: 15717 - DNA, 411 bp, Glycine max
  Peptide Sequence Number=SeqID_107402
atgtcaaacactggttcttccggaaacattccggaagaaggggttcttctggaaaggtcttctggaaatttgaaagttattccggaagttcttccggaagaagtgtttttccggaagacgtttggttacttccggaagaacccttcttccggaaactttccgaaaaatgttcttccggaacttccagaagaacccctaacgggtcttccagaaggctccgccgtcagcctcctttccccattttttccggcatcctctcctctcgtcttctaccctaaggttactatcctaaggggagttagggagactaatctcgttcgcggagaagaagaagacgaggttcgcgcttgccttgcggagaagaagaagcagttcacggagaagggagaagaagcttcgcggaaggaatga

SEQ ID NO: 15718 - DNA, 1020 bp, Glycine max
  Peptide Sequence Number=SeqID_107403
atgggcttcccagccaacggcgcctctgcggcccagcccctaaacttcctcatctacggccgcacgggctggattggcggcctcctcggctccctctgccgggcccagggcatctccttccattacggctcgggccgcctcgagaaccgggcctccctcgaaaccgacatagccctcctcaagccctcccacgtcttcaacgccgccggcgtcacgggccgccccaacgtcgactggtgcgagtcccacaaagtcgagaccatccgaaccaacgtcgtcggaaccctcactctcgccgacgtctgccgcgaccacggcctcattctcatcaactacgccaccggttgcattttcgagtacgactccgatcaccccctcggatccggtatcggcttcaaagaaaccgactctcccaatttcaccggttctttttactccaagaccaaggcaatggtagaggatctgctgaagaactatgataatgtgtgcacattgcgagtgaggatgcctatctcatccgatttattgaacccgcgcaattttatcactaagatcactcgatatgagaaggttgtggatattccgaattcgatgactatattggatgaactgcttccaatttcaattgagatggggaagaggaatctgactgggatctggaactttactaacccaggagtggttagtcacaatgaaatcttggagatgtacagagattatgttgacccgaacttcacctggaacaacttcactctcgaggaacaggccaaggtgattgttgctccgaggagcaacaatgagcttgacgctgccaaattgaagaaggaatttccagaactgttgtctattaaggattctcttattaagtatgtcttcgagccaaaccagaagggtgatgatgcttgtctggatagtctcacggggtttgttactgagaaagtgagaaagggaaaaccattcagtaggaagcgcctgcacaccttaatgctcaatagtgttgttattcactgggaaatataa

SEQ ID NO: 15719 - DNA, 129 bp, Glycine max
  Peptide Sequence Number=SeqID_107404
atgttggtatttaatgcctttgaaaaaaaagcagatatgttaattcgtcgagtccaatccaatccaagtgggccacaagttcagcaagtgaagacgaagaagctgaccggccccaaatctagaaactag

SEQ ID NO: 15720 - DNA, 1233 bp, Glycine max
  Peptide Sequence Number=SeqID_107405
atgtctaccatcattctcagagaccatagagtagcagcaggggcgtatgatgcactgcttaagccaagctttcgtacacccacttggaagaagcttcataattcccatctggtgaaaggccacttttatctaaccaagagtggaggaagctgtgcaattcgaagaaagttgcggggtccagttgttgctgttttagaacttcccttaagccttcaagcgtccagaagaagtgctaatgacttgtttgttgctatgtttaggaactctaaaatattgtgcaatgctacaacagacatttctggtgatattcctgaaagtgctggtgagctgagccagtacgagaaagtgattgaaatattaacagctctttttcctgtgtgggtcatcttgggggccatcgtcggcatttacaaaccaactgctgtaacttggttggcgacagatctttttagtcttggctttggtttcctcatcctctctatgggcttgacattgacatttgaggatttcagacggtgtctgcgaaatccgtggactgtgggtgtagggtttcttgcacaatatttaattaaacccatgctaggctttgccattgcaatggagaaatggaagattttggatcaatatgttgctctaattggagctcatgatttgttcaattttggcatttcaaggtgttcaactattggagctattataatgaccccactccttacaaagcttcttgccggtcaactcgttccagttgatgctgttggcctggcacttagtacctttcaggttgttttagtcccaacgattgtgggagttttggcaaatgagctttttcccaagttcacttcaaagataatcaccgttactcctttgataggagtcattttgaccactctcctttgtgcaagcccaattgggctagcttcagacgtattaaaagctcaaggagcacaactagtattgccagttgttttcctacatgctgcttcatttgctcttggatattgggtttcaagaatatcatttggtgaatcctcgtcacgcactgtatctatagagtgtgggatgcagagctctgcatttggatttttgcttgctcagaggcactttacaaaccctcttgtagctgttccttcagctgttagtgttgtctgcatggcgcttggtgggagtgctcttgctgtgttttggacgaacagaccaattcccctcgatgacaaagatgacttcaagaaatga

SEQ ID NO: 15721 - DNA, 447 bp, Glycine max
  Peptide Sequence Number=SeqID_107406
atgttggaatggttttctcctttagcatggtggcgtatgaagctgaaacaaattctagacattgagagacaaagagggattttagaagataacatagagaatttagtttctattctagcaaggcatctctgtgagatcaatgattactcatacaaaactgtagatccaaatctgtcaagttcatctcagaggccaaaggaaagttatcctactaataggataataccccagaatactgatgatggtcaaatccgaacagagttttatgttccagaaccggtgtttcaaaaggcagaagatttagctgatgattattcctcattaaacagagattgggaagactataatgctcaattaatggaggacttattgcacaagaagagatgtcgttatcatcacccagtgtatggaagtctcacaagatcagaggtacaaaattacaactag

SEQ ID NO: 15722 - DNA, 102 bp, Glycine max
  Peptide Sequence Number=SeqID_107407
atgaaccgaggtgttcggggacgggtacgagcagatgctaggcctgtgatcagcagatcatcatcccgtgtccggctccggacaatcaagaagcactactag

SEQ ID NO: 15723 - DNA, 189 bp, Glycine max
  Peptide Sequence Number=SeqID_107408
gtatctaaactaacctattcaaaagcaagtaaagaaacctcacaatcactcaaaatctcatccaaagctccgcaagatggcttcctcgtcaagctcagctatctctcagtctctccacggccaaaactaaaacctaattctctaaaaagctcatcccctctccaaatttgggatttcagctttaaatag

SEQ ID NO: 15724 - DNA, 819 bp, Glycine max
  Peptide Sequence Number=SeqID_107409
atggcttctcgtaagagaaaagcaccagcttcagtgtcccaggctagacaatgtccttggccggaagatcgtttcgcaaaggaatgtgaagctgtacattacaaatttgatgaattcaggagagaaattgatgggaataattggcataaggagctcactaacttctctgaagggagcattgatgtggcattagtgaaggaattctatgccaacctttatgaccttgaagataaatcaccaaagcaggtgagggtgcgagggaacctaattaaatttgatgatgacgccctcgacacctttttaaacacactagtggtcatcgaggaaggggagagctcaccctcttacttcaagttctgtaggttaaggccagatcctcaagagcttgcacctcgtctatgtatccctgggaggggatttgagctgaatgcaaatgagctacttcttaagattttgaggaagaatcttactactctggcccagacctggagtgttatatctttttctaacttagccccgacatctcatacttcatatattactttggatagggctaagttaatctacgggcttgtaatctccccctaccccagctccttctacctctcctattcttcccgcaccagcaactccaattcttctggatccttcttcttagagcttcgagccattcttttctatgctgtagagcctacatcagggccagctcctgatcgtgcaaagcttacagaatgtggtccattagcggccggagtccagccttctcctttgggagggggtgaggcctccgcagcccaggagcctcagcaggatcagtag

SEQ ID NO: 15725 - DNA, 471 bp, Glycine max
  Peptide Sequence Number=SeqID_107410
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtgatgcatcgcttgaacattctagaacttgttcagctaggagtggcaaagtgggctagcccaacctgtttttgcccgctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 15726 - DNA, 206 bp, Glycine max
  Peptide Sequence Number=SeqID_107411
atggtccccagtggagtcgccaactgtcgcaacctacccttcggcgggagggcgacacggggctcgcaagtgcgtcttccaagaaaggaaaatgcgcgaagttgctaccaacgtctattcaaggaaaacgtcggaaaaatgggaaaggtgtggtctacgaactttaatcgtgaaaggttcgggagttgtatttacgcacgaggaag

SEQ ID NO: 15727 - DNA, 247 bp, Glycine max
  Peptide Sequence Number=SeqID_107412
atggctagaacacgaggtttaggtcgtgctataggtagacttataggcagagatagacatgatgaccatgatgcaactgatgttcccgagaggcgtaggcctactgccttagcccgtaggcaacgggttcatcagatgattgcggatgcatgtgatatggctaaggatgttgctgacatgactgaggatgtccctgatctggctgaggaggcacctaagatgcgtgcggatgtacagggtgctgatg

SEQ ID NO: 15728 - DNA, 291 bp, Glycine max
  Peptide Sequence Number=SeqID_107413
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgtatggccgcgtttgtctcattccacgctgacactcagttccgg

SEQ ID NO: 15729 - DNA, 204 bp, Glycine max
  Peptide Sequence Number=SeqID_107414
atggaagacgcacccgcgagtcccgcgtcgccctcccgccgaagggttacattccaagtgatggttattaacccgacttatagctatcttttggggcactcgtcgatccactcagtgggagtcatcccctctacactccaccaaaagctgaagttcgtaatggagggacattgggtcatagtatcgggtgaggaagacgtcctg

SEQ ID NO: 15730 - DNA, 180 bp, Glycine max
  Peptide Sequence Number=SeqID_107415
atgcgtaaggagaaaataccgcatcaggcgccattcgccattcaggctgcgcaactgttgggaagggcgatcgggttttcccagtcacgacgttgtaaaacgacggccagtgccaagcttgcatgcctgcaggtcgactctagaggatccccagcttcgttcgcagatgtctcttgttga

SEQ ID NO: 15731 - DNA, 387 bp, Glycine max
  Peptide Sequence Number=SeqID_107416
atgtgggcctttcataaaggtctacaaattgattgggcacatcttgttagatatcgcatgcataagccattgcgattgaatgctccattgccatatccacatctagtcactcttttccttcaacactttaacatccctcttgattctgaaccttacgttccaatcaagagatccttcctaataggaactttagtcattgcatcctttggacatgatggagaagattcatctcttctttcaaagattttggacaggtttgacactttggaattacaagtggacatgcgctttaatgagatggagtcaagaatcaccaaggttgaagaagatgtttcttatattcgttcaagctttgatctaccaccaccgccgccaccatcatcttag

SEQ ID NO: 15732 - DNA, 529 bp, Glycine max
  misc_feature (248)..(248): n is a, c, g, or t
  Peptide Sequence Number=SeqID_107417
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccgg

SEQ ID NO: 15733 - DNA, 219 bp, Glycine max
  Peptide Sequence Number=SeqID_107418
atgtattatggatgcaacctaagcatgtttcagaacatgtttggaatggggaagaagatcggaaattacatatcagacaagttgtccccatgtttacgtgtggatggtctaccattaatcggtccaacaaatcttaattgggctgatttatgtgagaaattattgggagtcagaccacaagaaggtgaaattaaaggtagtgtggttaaattgagttga

SEQ ID NO: 15734 - DNA, 300 bp, Glycine max
  Peptide Sequence Number=SeqID_107419
atgaggatggaccgatttgctcttactttgaacaggagtcaagaacttccccgattgctagacaaggccaaagcaatggcggacacatactccgcccccgaggagatccacagacttctcagctatttgcgaatcaagtcactcccgcattttatctctagcatgcattgtatgttggtctcgtcctttgtcacgggaagccggaaggtccatatcaccttcttaactgtacacatagggcactgcgcccccaaatgcgcaagtaagaagagatattttttcgggctctcgtgtccgtaa

SEQ ID NO: 15735 - DNA, 858 bp, Glycine max
  Peptide Sequence Number=SeqID_107420
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaagtcacgacgttgtaaaacgacggccagtgccaagcttgcatgcctgcaggtcgactctagaggatccccactctctcagcttcattccatcaaatgaagaagtgggtttgggtaccgagctcgaattcgtaatcatggtcatagctgtttcctgctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttacttcggaaaaagagttg

SEQ ID NO: 15736 - DNA, 234 bp, Glycine max
  Peptide Sequence Number=SeqID_107421
atgagctatcaagctgggtttagcgggaaaggatgcgctaagcgccaacatcattctattttgaagtcattggaagtgcgcttagcacatgtagtggcgctaagcctgaatcactcactgctaagcacatgttgcagaaatatttttgttgttgtagaaagcgctaagtgccactgttgcgctaagccccaaatgcttactggaagttacaacttcaagttgggcttaacgtga

SEQ ID NO: 15737 - DNA, 285 bp, Glycine max
  Peptide Sequence Number=SeqID_107422
atggagatggagaaggctcacgctactttgaatatggaatcatttgttgttggagataagcggggcggattggcccagtctgctaccaatgcgggcttatgcgggcgggccttacacggggcaggccggctcgcttacccacccctacttgtaggcctagaatcttcttcatcaatggattcctttgcttcttggaagatgaatggcagcggaatggagaaggaagagagagaggagacgccacttcaaggagaagatgagtctagaagaagctcaccaccatag

SEQ ID NO: 15738 - DNA, 468 bp, Glycine max
  Peptide Sequence Number=SeqID_107423
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgatgaagaggaagaatttcaacaactgcctataggaattggagccaccaagctgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 15739 - DNA, 411 bp, Glycine max
  Peptide Sequence Number=SeqID_107424
atggacgaagccgaagaagggtatggtgaaagcaacaatgagtgtttattgggcgaggaagaagatcatgattacaatgacctttacaatgacgtcaatttcaatgaagggtttattcaattgttgcgcaagaacgacaattcagggtttatgctgcagttatttggttcaagattcctaaatttcaagattttgggggttgcttttattgaggaagcatttgtgtattcacaagataaaatttatgattttgagatgaagctaatggatattgacagtgagcaccttgggattccagaggcgtatcatgccatatcattgttaagatgccatcctctgagtttgttaggatctgcaaggatctcagtagtatttgtgacgctagtaattggctttgcttctctattttag

SEQ ID NO: 15740 - DNA, 183 bp, Glycine max
  Peptide Sequence Number=SeqID_107425
atgatgatgaaggacacttaccagttgaaggggactcttctcttctttggagtattttggactggtttaatggacttcaaacctatgttggttggtcatcatcaaaaggggggagattgtagaagcaagcttcatgatgatgaaccaagcaattttgatgatgccaaaagcccaagtgattga

SEQ ID NO: 15741 - DNA, 753 bp, Glycine max
  Peptide Sequence Number=SeqID_107426
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacaggatttggtatctgcgctctgctgaagcca

SEQ ID NO: 15742 - DNA, 707 bp, Glycine max
  Peptide Sequence Number=SeqID_107427
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggttagacacgacttatcggcactggcagcagccactggtaacaggattagcagagcgaggtatgtaggcagtgctacagagttcttgaagtggtggcctaactacgg

SEQ ID NO: 15743 - DNA, 243 bp, Glycine max
  Peptide Sequence Number=SeqID_107428
agttttctgcctttgccctatttttcttggctgtgatagtttgtgctgtttgaatgttgaattacctggatgttggggaagcttgggaggattgatggggacccggggatggtgggcttatgcgcgatttgtggatgtggaaaacttgttgtgcaccatcgcccgaccgccacctagtaccacatgtgatggagtggtacctggagatatgtcgcgggggtcaggagacattggggatgtcag

SEQ ID NO: 15744 - DNA, 381 bp, Glycine max
  Peptide Sequence Number=SeqID_107429
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctgataggaaagggggtaaaggctatggagttgatcaccaaggtagcgcgccaatattcagcaccaaggaagcaccaacaaaaatcggttgcaaccattaa

SEQ ID NO: 15745 - DNA, 282 bp, Glycine max
  Peptide Sequence Number=SeqID_107430
atggcgattcctgtgggctcgatcgccattattattgctatgcaatataagtccggcgagcaagaaatggcctcgaccatggcgctaacgtgggccaaaatgcgcgccacgggacaacaggtaccggagctggtgacatgtccccacgagaacgccgctattggcatggcccatggctattatctcgggagcgggaaagtgcaggccgtcatggttcacactaacgtaggcctggccaatgccgcctgcggcgtcatcaatctggccaacagcaatattccg

SEQ ID NO: 15746 - DNA, 472 bp, Glycine max
  Peptide Sequence Number=SeqID_107431
gacactattaagtcttgtggatgtgtgtattgaattgattggcggtgaggatgagagtaatccgagagagaaaccggaggagactacaactataagagatgatgcattgcggtggttaacaatgttaaggcttggagggattttgggaacccgagtggtacctgaggatatgtcgcgggggtcaggagaccttggggacaacgcgatggcagtgcagctgatccgtgatcgcgtcgtgatggagtgcctagagggtgtttgggagaccctcgagggcaacgagaggtgccaattccgcgacacagttcgactcactgctacatcgcttgtacatccggagcaacccgcacgcacacttcagcagcctgtggagtggatactacctatgcctaccccatatcgactagttgatcccgttcaattgatagaggtgtcatcctctgaagaggatcctgaaggggactcagagtag

SEQ ID NO: 15747 - DNA, 324 bp, Glycine max
  Peptide Sequence Number=SeqID_107432
atgaaaataggcgtatcacgaggcccgttcgtctcgcgcgtttcggtgatgacggtgaaaacgtctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 15748 - DNA, 399 bp, Glycine max
  Peptide Sequence Number=SeqID_107433
atgttgaatactcatactcgtcgtggttcaatattattgaagcattatcagggttattgtctcatgagcggatacatatttgaaggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 15749 - DNA, 309 bp, Glycine max
  Peptide Sequence Number=SeqID_107434
atggtggcccgggagatgttggggaatggttacgagcccggaatgggtttaggcaaaaacaacggcggcagaaccagcctgataagcaccagaggaaaccgtgggaagtttgggagctttataagcgtgagactaagacacgaaggccaagtcgttgcaatatgcgaggatgactttccgaatgggtcagatctggtaataatacctgggaaccgatcatcgatttcaagcaagaaacggatcagacggagagtgaagaggacgaagatgtgggacttccccggagttggagaagatagtcgcccatga

SEQ ID NO: 15750 - DNA, 381 bp, Glycine max
  Peptide Sequence Number=SeqID_107435
atgatgagagcaaatactaaggaggaaatggttgctcaaatcccagatccaaaggttgatccttctcaatatcatgatttagtacattattggtgttctgagaaaggacaaaaaataagcaacattaacaaaaggaaccgctcaaaatatgaggacttgcattgcatgggaaccaagaatcttccaagacggattcatgagatgaaaacaaaggctaagggagtgcaaccttctcaggaagaaatttatattgacactcaaactcgaaaagatggaagcgttgttactgaaaaggctgctactgtaattgatgaactaaaaaagaaaatggttgaagaagagagttcacaaaatttacaaagcacccaagattctacttaa

SEQ ID NO: 15751 - DNA, 498 bp, Glycine max
  Peptide Sequence Number=SeqID_107436
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccccgtcatggatgttaagtcaaccaattatgaagatgaatcatttgaaacactgaagaaggtggagctacccaattttgatgggaaggatcacattggatggttggctagagctgagaaattcgggaaacctgtcgtgccagctgcattaatgaatcggccaacgcgcggggagaggcggtttgcgtattgggcgctcttccgcttcctcgctcactga

SEQ ID NO: 15752 - DNA, 339 bp, Glycine max
  Peptide Sequence Number=SeqID_107437
atggcgctaccaggcacccttgacccgataagtccaacagggcctgggatttcccgctttgatcacaggactctgccagtcgtggccaaccaccgggcgcatgtacagacccatgattatctttaccagttaagcctcagcctacagagccagggttttacttcttttctgtgccctactccggaccagttcagggaagaggtcgcatggcttagagattggcctgaggcccgggcaggagaggcgccagcagaggctcccgacgaggcagatgaggcccgcgagaacgaggagatgaccgatttacttgatttcttaggagggagcggggccacatga

SEQ ID NO: 15753 - DNA, 119 bp, Glycine max
  Peptide Sequence Number=SeqID_107438
gtgtggcggtaggcgtgtcctctgacgtctactctagtttgtcttctggtgtcgcctccggctccggctgtggctcctgggctataggagcctcacctccccccacgggagaaggctag

SEQ ID NO: 15754 - DNA, 969 bp, Glycine max
  misc_feature (878)..(878): n is a, c, g, or t
  Peptide Sequence Number=SeqID_107439
actaatcgtcctcgccttaagagggctatatgacctcacctttagagggctacacgcccttaccttcagaggactgcatgtcctcgcctacagagggctacatgtcctcaccttcataaggctgcacgtcctcgccatcagagggctgcacgtcctcaccattagaggacttcacgtcctccccttcagagggctacacgccctcgccttcagagggttgcacgccctcgccttcagagggatgcacgccctcaccttcagagggccgcacgccctttccttcagaggactacacgtcctcgccttcagagggctacatgacctcccttcagagggctacacgccctcgcctttagagggttatacgccctcacctacagaggactacacgtcctcccctttagagggctacacgccctcgccttcagaggactacacgctcctcaccttcaaaggggtacacgccctcgcctttagagggctatgtgccatcaccttccagaggactacacgtcctcgccttcagaggactacacgtcctcaccttcagagggctacacttcctcgccatcagaagactacatgtccttgccttcagcgggctacacggctaatcgtcctcgccttaagagggctatatgacctcacctttagagggctacacgcccttaccttcagaggactgcatgtcctcgcctacagagggctacatgtcctcaccttcataaggctgcacgtcctcgccatcagagggctgcacgtcctcaccattagaggacttcacgtcctccccttcagagggctacacgccctcgccttcagagggttgcacgccctcgccttcagagggatgcacggcctcaccttcagagggccgnacgccctttccttcagaggactacacgtcctcgccttcagagggctacatgacctcgccttcagagggctacacgcactcgcctttaaagg

SEQ ID NO: 15755 - DNA, 389 bp, Glycine max
  Peptide Sequence Number=SeqID_107440
atgactatgagtaaaaggtttatgaaagctgaggatgaagggagtgtgttgtacaaggagcaaatgggtgaaaagacaagtgctaaggttaaggaaaatgatgtgaagggtaaagagaatcaggaaaaagggaagaaaataatggtccaaaataaagagatgaagaaccaagaaaaagaaaaagaaggagaaaaagaaatagaaaatgagaaaaatgaaaaagaaaaaaaaaagatttttgagaagagtagaagtggaaaggttgtggaaaaaggtgtggaagtaccatatcctgtggaaattgaaataaccatgccctttggcgaagctcaacagcagatgccactctactccaaatttttgaaagatatgttgacaaggaggcacaa

SEQ ID NO: 15756 - DNA, 294 bp, Glycine max
  Peptide Sequence Number=SeqID_107441
atggtggtcattatgcgtaaggtacacttagttgtctggttttgttcattgcataacaggccagacaactaccttaagggaataattatcagcctaaatcaaaggctcctgctaggtggattgtcgtcaagtgtaatagacaaaaaaggaagtgctgagtgcggctattatgtcatgcactggatgtccaccattattttaggaagttttaggaataactggaaagcgtattttaatgatgctagaccattggagccagagggattaaaggtgttgcggatccagtgggcatag

SEQ ID NO: 15757 - DNA, 117 bp, Glycine max
  Peptide Sequence Number=SeqID_107442
atggaggactactacaaggagatgaaaatagccatgattagagctaatgttgaagaagaccgtgagacaactatggctagattcattggaggtttaaagaaggagataactgatgtg

SEQ ID NO: 15758 - DNA, 261 bp, Glycine max
  Peptide Sequence Number=SeqID_107443
atgaccggccctctcgatgagtcgatctcttgctttctcataaggagggctacacgccctcgctatcagaggactgcacgtcctcaccttcgtagggctacacgccctcaccttcagagggctacgcgccatcgccttcgtagggctacacgccctcaccttccgaggactacatgtcctcaccttcagagggctacgcgccctcgccttcgtagggctatacgccctcaccttcagaggactacatgtcctcacctttag

SEQ ID NO: 15759 - DNA, 426 bp, Glycine max
  Peptide Sequence Number=SeqID_107444
atggagagaagtatgatagatgctgccagtggtggagcccttggagacatgacccctgctgaagccagagatttaattgagaatatggcttcaaactcccagcaatttagtgccagaaatgatgctattgtcattagaggagtgcatgaagtagccacgaattcatcttcatcagctaagactaagaagcttgaaggtaaactagatgccttggttaacctaaatgctgctggctcaagcagaccatacgttcctccaccaatccagcagcaacaacaacaacagcaacagccccagaaacaacaaacagttgaggctcctctgcaaccttcccttgaagaacttgtgagacaaatgactatgcaaaacatgcagtttcaacaagagaccagagcctccattcagagcttaactaatcaaatgtga

SEQ ID NO: 15760 - DNA, 1065 bp, Glycine max
  Peptide Sequence Number=SeqID_107445
atgacacagggtagttttgttccccatggtcgagatgacatcttgaatatggccattggaaaaccggaacatctaggtcgagttcgtgcagcgggatctggtatgacccttactcaattttatggtagggcaacacgtacgtcgagtagttcctcagcaacactaatgcagcaacagtgggttgacattattggaaacataaaggaacaagtaaggaatgaatatgaagaacaacacaagaggagtttggaggaatttaagaaggagttgtccagtcagatcttcattcagttgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatatgtgcaacgacaacatactacagtgttggtggccttggggaaaatatgtgaggggggatctgccattcacaatgtcactgatgctgatgatgttgtaagggtgagtgttgacaaagttatagaaggtgacgccaaagtgcccttcccgacatcagagattcaatatgagtctgatactagtccaaagaaacttcctgaaacaaatgaaagggggacgaatgattttgaccatgatctgttgcgtcaactgattaagagcctatatttcatgtacgacacacctgttgagtttaagtgggatggcagcaaatttgggctttcaaatgttgttgcttcattcttcttgacattctctgatgtaaatgaaatagtagctggatacaaatgtttgaacatatctatactacagttatggatgctgtttttggatgagtggggctcaactttgggtcatgcttctgtgtatggattccttgagccacaatcgatacacaatgcaaaggatcgacgtgctgaatatgttgatcatgctattattataagcagtgcaatgaagtcaacaaacacaactgcggatggtacaaataatccagcaactcctaagtggattgaagtcaag

SEQ ID NO: 15761 - DNA, 456 bp, Glycine max
  Peptide Sequence Number=SeqID_107446
atggtggtgagagaactggaacgtaaaattgttcaacttgaacaacataataaggaattgggagatttacttaaagaactcagggaagctcagatcaataatggtgaagcaaattcggtgacatcaaagctccgcaacaagcttagacggttggaagaggtgcataaacattgcgcctcaattgtcaagtctaaagaatctcaatggggtgatcaagtggcaaagatggaagcagatattaatgaagacatggttctaatttctgcagagcaattgagagtgaaagacaagtctataaaaactatggcacaagctgcacaacaacactctctgttggaggaagagcttaaacaacaaaagaaaaagctcgaggaatcatctgagggtcaactaatcttggaagagcaattgctgcagatggaatacaccgtacaatatgaaagaagtgcagctaat

SEQ ID NO: 15762 - DNA, 360 bp, Glycine max
  Peptide Sequence Number=SeqID_107447
atgcgaggtgccgatttccgggacacgattcgattcacggctacttcattggtacatccagaggaaccagcacgcacgcttcagcgcactatggagtggatattacctacacctactccatatcgactagtggagctagtccaagtgatagaggtgacgtcatctgaagaagaccttgaggaggacccagaggagctacctcctgagcctgctgtggatgctcttgactttccagagggtgatgaggacccactccctgatgtggattctccagaggacgtcatgtcagcatctgaggcagactctatggaggagagcggccctggagggatagcgactagtggagactcttcatcatag

SEQ ID NO: 15763 - DNA, 456 bp, Glycine max
  Peptide Sequence Number=SeqID_107448
atgcctcaaaatgttctttacgatgccatgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattcctacgttacccgtaccatgtggaagtagcgac

SEQ ID NO: 15764 - DNA, 414 bp, Glycine max
  Peptide Sequence Number=SeqID_107449
atgcggcagtttggatacacccagaccattcctactccgcctgccgattcatgggtgtcgtttgatgatatacacgacaggtggatgcactattcggaccatatggctgcagcagatcctcgggcagatggtcatgctacgcagcccagagttgcccctcaggatccagacatagatatccatccggtcacgaagccagcagcaccgtcgacatctgcaaggtccgatgtggccgagccgagacatgcagtggaagcttgctttgcgattgcggagaggttggagagccatctcaacctagaggtggtcacgccaggcacatcgacacatgtgctgatcgaagaatgcctcaagattgccaagagtgtcacacaagacccgctagtatatgttaggtctcgacgcaggcggtga

SEQ ID NO: 15765 - DNA, 420 bp, Glycine max
  misc_feature (100)..(100): n is a, c, g, or t
  Peptide Sequence Number=SeqID_107450
atggtaggaactaaaaggcttttagtgataattcccaaagtgctcatatctctcttgatggtttctagagatatcatccccttcgaaaaacatattgtgnctgtagggactaccagcaacaatatgttatcaaagagacaaactctagatgagggttcattgttatcaagcaagtcagagacccagcatgaccacagattcacctccactccttatgttcctatcgacccgtatagggccccttttcaactcacctccccagtggagtcgccaactgtcgcaacctacccttcagcgggagggcgacacgagggctcacgggtgcgtcttccatgggaggaggatgcgcggagtcaccaccaacgtttattcgaggaaaacgtcgaaaacaccggaaaaggtgtggtctacgaactttga

SEQ ID NO: 15766 - DNA, 423 bp, Glycine max
  Peptide Sequence Number=SeqID_107451
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctgggtatgaggacaagaacatagaactgagtgaggcatggaatgaagctgagttaaccaaaccaaaaatgaaggtcaagcaaaagcttcaccaagccatagatctgttgtactctcatggacttggggtaccgagctcgaattcgtaa

SEQ ID NO: 15767 - DNA, 543 bp, Glycine max
  Peptide Sequence Number=SeqID_107452
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgttggcatcgcattcgacatgatgcttctcgctcacaacgccggtggcaaagagaggaccgaagagaactggaagtggctgttcaaggaaaccggtttcgcgcgttacaacatcatcaagatcaacgctctcccttccatcattgaggcgtttccaatctga

SEQ ID NO: 15768 - DNA, 659 bp, Glycine max
  Peptide Sequence Number=SeqID_107453
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatatctagcacagttcaacagatgagaaccttgggtgaagagatcaaggaaagccaggttgtgagtaaggtgctaagaagcctcacaaagaaatatgatcatgtggtggcagcaattgaggaatcaaaggatatggaaggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 15769 - DNA, 258 bp, Glycine max
  Peptide Sequence Number=SeqID_107454
atggtggtagttcatagcccagatgttgaagttttcaagactgagggttcaaaagatgatttcaaacctactgacccaggtcacagcccaggagttggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15770 - DNA, 558 bp, Glycine max
  misc_feature (18)..(18): n is a, c, g, or t
  Peptide Sequence Number=SeqID_107455
atgggaaatcaacagagncaaggatacaaccaagaaggatttttaggttttcaacaaggtctctacaatcagcaagggcaatggatatcacaccctggcaatcaattcaataaggaccagggtggaccatccaacaagccaccccaacaagggccaaatatttttcagaggaccaccaaactggaggagacactagctcaatttatgcaagtgaccatgtccaaccataagagtactgagtcaaccctaaaaaaccttgagatccaggtgggtcaactggttaagctgctagctgagaagtcatccaacagccttggagcaaataccgagaaaaatcccaaagaagaatgcaaagctattatgacaagaagcaggaagcttgtggcggctgaggatgaggatattgtcgctttgaaggagcaagttgttttgaaggacactattgataaaaataatgatgagaaaattcttccactgaagcacaaagaccctgggagtgtgaccattccttgctcaataggtgaagtcacagtgggaaaagctctcattgacttgtga

SEQ ID NO: 15771 - DNA, 588 bp, Glycine max
  Peptide Sequence Number=SeqID_107456
atgaagctttgcttctacagtctattggattccatatggggagcactgaccggtccgggactttcatttgatttcatgatattccgatctcctgcactgggggcctgttgctgtgtattaccgaccagagagggtcgtgcggcagtttggatacacccagaccattcctgttccgcctgtcgattcatgggtgtcgtcagtgtgccagcgactacatggactggttcttccgcatctcgcatgcatcctttcatgacaccaggccatgcatcagatcctctaccagatggtcatgctccgcagccccgagtcgtccctcaggccccacagacagatatccctcacgtgccggagccaggagcaccgtcgacatctgcaaggctcactgtagaggagcctagacatgcaatggaagtttgccatgggattgctgagaggttggagcgccatctcagcctaggggtggtcacgccaggctcatcgacacatgaggtgatcgaagaatgcctcaggatggccaggagtgtcacacaggaccatctagtatatgttaggtctcgacgcaggcagcgcacggatcaagcgtag

SEQ ID NO: 15772 - DNA, 456 bp, Glycine max
  Peptide Sequence Number=SeqID_107457
atggccaccgttgtagctaccacattaattgcctccgccatcaccactgtcattaaccaccaccacctctgccaccgtgaccttcgttgtcaccactgtcaccaccactatcaccatcttccaccactaccattgtcaattacccctagacccactaccaaaactgtcattgttggtggcggtggcgacaacaacgatgacaatcatgacggcggaggtgccgatagtcgtggtgatgatgatgggttaatcataaataatggagatcttataggatgtgatttgtttggtgaatctttcagagatataattgttatatgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 15773 - DNA, 435 bp, Glycine max
  Peptide Sequence Number=SeqID_107458
atgactaggggcaatccaagtgatttacaaccctttgatcctaaaatagatagaacctttcatagattaattaggcatagtgtgcatcctgatcattctgtgcattttgagcattctgagtattctgttgctggtgattttgaacattctgattttgagcattcgactactaattttcatactgagaacatggctcaacctccacctcatgagaggactcttagggagatggctgcacctgatttcatatatgaaagcttgtgcattcaatatcctgatgaggatgttccatatgttctcaagactggactaatacatttgctgcccaagtttcatggtcttgcaggtgaagatcctcataagcatcttaaggagttccatattgtctgtcccaccatgaaccccctgatgtccaggaagatcatatctttctaa

SEQ ID NO: 15774 - DNA, 166 bp, Glycine max
  Peptide Sequence Number=SeqID_107459
gtcgactctagaggatcccccgttcatgcgtcctccacccacgagtttggagtgatgcgtagtgattgcttagtgcaattctccattctcaacccctcttttcggagccccatgaattgcgttttcgttcatgcgtcctccacccacgagtttggagccatgcgta

SEQ ID NO: 15775 - DNA, 309 bp, Glycine max
  Peptide Sequence Number=SeqID_107460
atggcattagtgagggccaacatcgaagacgaatccgaagacacaatggctcatttcctgaatagtctaaatcctgaaatcagagatgttgttgaattacaggagtatacttatcaaggtaatccttgtggcatctatcctaacttatcttccttcactggaagtggcgtctaccctgatttatcttccttcactggaagtggtgtctccctgacttatcttgcctcctcggaagtggcgtcatccaaaactctgtggcctgtatcaaacgttctgccccgtaagattcacatcagaaccctcatctag

SEQ ID NO: 15776 - DNA, 380 bp, Glycine max
  Peptide Sequence Number=SeqID_107461
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgctcaggaaaggtggataa

SEQ ID NO: 15777 - DNA, 579 bp, Glycine max
  Peptide Sequence Number=SeqID_107462
atggggacaaggggttacatcagttacaatcccgttcttgctataaggcaacttggataccctatgagaggggcaccgctagaggaagagctcgcgcctatcatttcacgaggtttcaataagaccaacgtggagacacttcaaaaggtccgcaaggcatgggaggtggtgcaaaagaaggacaaagaactcaggggtagtaacaatgggcccatcggtgactaccgaaggtggttgaaagcccacgtgcaaggtttggattggctcccgagtttgagaaccgctaaaagggaggaagttgaggcactggaggaagacaaagaggtgcaggcccttaggaaagaactcgagcaagcccaaatagtcaaagaaaggttcaaatcagcagttcttaaaatccgaaaggagaatgccgaactaagagatataaatatagctaccaccgaggccttggaacaagagaccaagagggctcgtagggaagagcacgaccggaacaagttccgaggggcagcaatagcgagcttaagctccagagagaggaaagagaccaatcacgagtacatagcatggtcttaa

SEQ ID NO: 15778 - DNA, 215 bp, Glycine max
  Peptide Sequence Number=SeqID_107463
cgaggaagcggaagagcgcccaatacgcaaaccgcctctccccgcgcgttggccgattcattaatgcagctggcacgacaggtttcccgactggaaagcgggcagaatggatgaagcaaaacactttgaagattggtgattttgacacaggaagtcctagccattcaagaattcttgaaacatcctcaagaacatatggatgcaaattccactga

SEQ ID NO: 15779 - DNA, 535 bp, Glycine max
  Peptide Sequence Number=SeqID_107464
caacgcggcctttttacggttcctggcctttgctggcccttttgctcacatgttctgtcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaataatgcttacaaatagagacatctatgacatagcagccctttgttcggggaatgaaaggttattttttgaggcgtgtggatttggcaatgacattttgggctctactaccatgatgtacaggagaactgctccattaacaatccaggaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15780 - DNA, 309 bp, Glycine max
  Peptide Sequence Number=SeqID_107465
atgcacacacgaagctttacaaatccacaattccttaaaagtaggcctaactcacaaaaagtccccagtggagtcgccaactgtcgcaacgtgcccttcgcgggcgagcgagggcgaggctcacggatgcgctttccaaaggaggaaaggtgcgcggagtcgccaccaatgtttatttgtggaaaacgtcgggaaaaccgaaggaaaccggtcaaaatgagaattctaagttcggaagttgtatttacgcttgaggaaggtattagcacctcttacgtttgtctcgaaagacaacagccttatttctag

SEQ ID NO: 15781 - DNA, 365 bp, Glycine max
  Peptide Sequence Number=SeqID_107466
cggatgccgggagcagacaagcccgtcagggcgcgtcagcggttgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgtag

SEQ ID NO: 15782 - DNA, 261 bp, Glycine max
  Peptide Sequence Number=SeqID_107467
atgaatgctcatccggaatttcgtatggcaatgaaagacgccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 15783 - DNA, 261 bp, Glycine max
  Peptide Sequence Number=SeqID_107468
atgagggaaataattgaaactgctatcatggttcatgaatatccttttagtgttgttgaggattctatttggatgtgggtcttccaatatgcaaaccctgattttcttaaggttacttataagggacgacgcatcgagatgcgtgtgatttggtgtaacggaacggagaaggaaggtaggaagcgcaaacgagaagtccgttaccgttatctgccgtttgtttcgttgtctgcttcgaagcatgcagcagggtttgctcgg

SEQ ID NO: 15784 - DNA, 360 bp, Glycine max
  Peptide Sequence Number=SeqID_107469
atggagggggaggaagagatcagagaaagggaggcattacgggatgacgaaaggtgggaacgatggcaatggagatgccattggatccagaggcgtcggaagagggaagatgagggagaagaagcggataaaaagggggaaaacgtgcaccatcaccaatcaactctacggcaatgcacgatggacagtgacagaggcacagttggaggctatgggaaagggatgaagaaaaaaacaactttattaaagacaagtttagactattgttcaactctagaaaaagacattttcacaaaggtttccaaatacaaactggtgtgtctaagtgtggcaagatatgcacaagataatccaagttaa

SEQ ID NO: 15785 - DNA, 603 bp, Glycine max
  Peptide Sequence Number=SeqID_107470
atgttcctccagaaggcggttgcttctggaggaagcaacctggctcgcctgggcgagctgggtggcaagctcctcccctattttccgataaatagagggaggagtgaagaaaatccaagccgaggcgcttccgtaacgtttccgtgggtgatttcgcgaagattttcaactgttcttcgtcgttcttcggtcttcaactgtgaaactaaggctaaaatcaactcgcaaagtcaagctcgtccgcaaaaaatcactaaaaaggattttaaggttcgatacctcagtttttctcaccaagtaaaaatggatcattttaaggtccaacgccttaaaaggaccaccttccaagtgctaataccttcctcaaatgtaaatacaactctcgaatctggaatattcttcatgaccggtttccttcggtttttccgatgttttccacaaataaacattggtggcgactccgcgtattttcctcctttggaagatgcacccgtgagcctcgcctcgctcgcccgcaaaagggttggttgcgacacatatcatccttctagagccattagggggaacttcacaaggaatgtagttcttaccatgattgaatga

SEQ ID NO: 15786 - DNA, 270 bp, Glycine max
  Peptide Sequence Number=SeqID_107471
atgggaggaactaaaaggcttttagtgataactcccaaggtggtcatatctctcttgatggtttctagaggtatcatccccttcgaaaaacatattgcggcagtaaggactaccagcaacaatatgttatcaaagagaaaaactctagatgagggttcactgttatcaagcaagtcggagaccaagcattaccacagattcacctccactccttatgttcccatggacccgggtatagggccctttttcaactcatgtgtgcacaaatag

SEQ ID NO: 15787 - DNA, 624 bp, Glycine max
  misc_feature (620)..(620): n is a, c, g, or t
  Peptide Sequence Number=SeqID_107472
agacggaagccccgatggaacgaattggagattttccagcgacgaagcgcgattcttagcgtcctctcggatccaatccgttgcggaaaccacgttcggcatcgaggacgaaatccgatagctccgaagcacgttcgagctgtcgtcgacggacatcgacaaggctccacggtagcttctcagatcggcgtccgtttcggtatctccgttgtcgtctccgaatccggtccgatcatcgtcatcgtcgtcggagtcgtcggaggaggtggcgagaggtttgcggcggagttcgacgaggcggtggaggacgtggtcgacggtgcggcggtggatgaagaaggcggagagggccatgaaggaggcgccgagcagcgcggccatggcgagtcacacatgcattctgtgaagactggagagaagaacagaagagcggagaggggatcctctatcgagtctcgacctgcaggcagaacttatcaatggccgtcgcttttacaacgtcacatgggaaaacccatggcgttacccaacttaatcgccttgcagcacatccccctttcgccagctggcgtaatagcgaagaggcccgcaccgatcgcccttcccaacagttgcgcagnctga

SEQ ID NO: 15788 - DNA, 75 bp, Glycine max
  Peptide Sequence Number=SeqID_107473
gataaagcccccgtagtggagaaggataaagcccccgtagtggagaaggatgaaggcccaagtggagaaggatga

SEQ ID NO: 15789 - DNA, 716 bp, Glycine max
  Peptide Sequence Number=SeqID_107474
gcgaagcaccccacacttttgaaaatttcggaaaacggtaggtatatcatgaccgaagatgggaaacctttcttttggcttggcgatacgggctggttgcttttcaacaagatgaaccgggcggaagcggagcaatacctggaggatcggaaacaaaaaggtttcaatgtcatccaggccatggtcctgcataccgttccttccgtaaatagttatggtgattcttcgcttgtcaacaaagatatttcgagaccgcttgtgaccgaagggaacaatccggataatgcaacagcgtatgattattgggatcatgtcgattacattattgataaggcagctgaaaagggactctatgttgctttggtcccggtttggggatcaccggtgaaggatggaaaagtatcagctgagcaagcagaaaaatatgccacgtttcttgcggaaaggtggaaagaccgtccgaatatcatttggttaaatggtggtgatattaagggatcagataagatggaagtgtgggagaaaatcggccaaacaataaaatcgatcgatcataaccatttaatgacttttcatcctagaggacgaacggcttcttcggattggttccacgatagaccctggctggatttcaatatggtgcaatctggacaccgtacctacgctcaggatacttccgcgaatgaacagaaacattatggcgaggataactggaa

SEQ ID NO: 15790 - DNA, 370 bp, Glycine max
  Peptide Sequence Number=SeqID_107475
agacgatgcaaagactattactcaaagctagtcgctcactcacagtttaagatcacactctcaccgcaaaatcctcaggaatttaaaatccctgagacaggtccggggcatctggagtctgagcctcctcctcatctatcagatggaaaaacagggaaatcagagagagcaacagcttctccagataaggaatcagaaagatcagcagcttctctatttggggatttagggggagcagcagcttctctagatggggaatcgaagatgataatcaaaggtggagatgggggaactacttcaagctcaggagaagaagatggattcaccactggagattatggatcaactggcgctggttcaacccgtgcag

SEQ ID NO: 15791 - DNA, 225 bp, Glycine max
  Peptide Sequence Number=SeqID_107476
atgctggcatcttcgaaaaaggtgcagatgaccacattggcctctgcttgtcaatcgaacttggggtctccgaatgacgaggtgcggataaccgaaaggtgtctccgcatgctaccagactcttgggtcatgagagcaaaaggtggggtggtcgacaaaagcgaggcttttgctcctacggtttgtggtaagttgggattctggctcaaggctggggtcctctag

SEQ ID NO: 15792 - DNA, 696 bp, Glycine max
  Peptide Sequence Number=SeqID_107477
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaacgacggccagtgccaagcttgcatgcctgcaggtcgactctagaggatccccttactggtgaaaaaagtggggcaaagacagacaagctgaaagcctctgataaagatgttaccaatgtaaaggggaaagtgaaagatggggacaagtcaaaagatgagaaagtaacccaagagagggatggaaaggacgagtccaaaagcaaatctagtaaggaaggtaccgagctcgaattcgtaatcatggtcatagctgtttcctgtgtgaaattgttatccgctcacaattccacacaacatacgagccggaagcataaagtgtaa

SEQ ID NO: 15793 - DNA, 444 bp, Glycine max
  misc_feature (60)..(60): n is a, c, g, or t
  misc_feature (109)..(109): n is a, c, g, or t
  Peptide Sequence Number=SeqID_107478
atgacggtgaaaacctctgacacatgcagctcccggagacggtcacagcttgtctgtaancggatgccgggagcagacaagcccgtcagggcgcgtcagcgggtgttgncgggtgtcggggctggcttaacttatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatttccaggaacatcaatatag

SEQ ID NO: 15794 - DNA, 318 bp, Glycine max
  Peptide Sequence Number=SeqID_107479
gcagatccagctgggtcatttgacacagagcggtatttacggcatttggttcgccagcaggcggccaaccatagggcgcacgtgcagacccatgactgtctctaccagctcagcctcagcctgcagagccagggttttgctttttttccatgccctactccggatcagttcagggcagaggtcgcatggcccggagattggcctgaggcccaggcaggggaggcacccgcagaggctctcggcgatgcagataaggcccgcatggacgaggagatgatagatttacttgatttcttgggagggagcggagccacatga

SEQ ID NO: 15795 - DNA, 593 bp, Glycine max
  Peptide Sequence Number=SeqID_107480
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctttgaggacgaagcccaacttcctagttactgcattttcatgtttatttgattcgggtacggcctcgatcagcgtgcctcaattcacatcaggcaatggtgctaagcaacatggatactcaggatgcctaattcgagcaacaccatcagataatgatagaaagatttgcaacctagatggacttctgagacaattgcgagactgcttctttcaggttccacctccatcttga

SEQ ID NO: 15796 - DNA, 300 bp, Glycine max
  Peptide Sequence Number=SeqID_107481
atgtgcatacttacctatgtcatgacggcacagaccaaccgatacatctgcagggggagattggcattgtggtcgccgggcagattgttactaaatagcaacgtcatccatgtaagagtggtcatgttggtgcgcatgatccgcactcgtctttttgcagcagcacaggggaaatcttgccctggtatgcatagtagacgcgtgatagcctccctttctggatgtgctcgcatagttggtcaccctccaatatcagggggtggcccaggaactgataaaaggaaactactggccccttaa

SEQ ID NO: 15797 - DNA, 213 bp, Glycine max
  Peptide Sequence Number=SeqID_107482
atggcacgcaaaccgaggcaggattttagcgtttcaaagctccacacaaagcttcaacctttggccatcattttgccccaaatcgtgaaaggagagcattttcggggtcgtgaagtgcgtggctacgagtgggacttcgaaatttcaggtttgggtggacttctttccctcttgattttcgtgggtatggggtttgggagatatgatgggtag

SEQ ID NO: 15798 - DNA, 273 bp, Glycine max
  Peptide Sequence Number=SeqID_107483
atgccagtggcgataagtcgtgtcttaccgggttggactcaatatgatagtttccggataaggcgcagcggtcggggtgaacggggggggggcggagcgtttggaaaaacgccagcaacgcggcctttatacggttcatggccttttgctggccttttgctcacatgttctttcttgcgttatccccttatttcgtggataaccgtattaccgcctttgagtgagttgatacccctcgcagcagccgaacgaccgagcgcacagagtcagtga

SEQ ID NO: 15799 - DNA, 252 bp, Glycine max
  Peptide Sequence Number=SeqID_107484
atgcggagataccttatggctatccgcaccctttttcagctagaggcaagcgagtccgttgacatgcagagaccaacgtcgtcatctgcatctttcccggagatgtcaacatcttccgaccgagactacaaaaaagtcttgtatgctatccgtcaaactcaagggtccgagatgtcagtgtcttctggccgagactgcagaaaagtctcatttgctatccgtcagactcaagggtccggtagcatgcagtga

SEQ ID NO: 15800 - DNA, 936 bp, Glycine max
  Peptide Sequence Number=SeqID_107485
atgttcttttctcgccataagacagctagggtaccccatgaggggagcgccaatggaagggagtctctcacctttccttgtgaaagatttaggcgcgcaaggtctcaaggttatacaaagagttcacacgcgaggaaagacaaggagcttagaggcatccgaaatggcgtcatcggtggttatcatggatggctaagagttcacacgcgagggttagattggctctccaaattgaaagttatcaatgaggagaacttcgaagctccggaggaagatgaagaagtccaagctctcaaattagagctagggaaggcgagactcgccaaggagaagttcaaatcagccgctacacacatccggaaagagtgcaccgagttacaagaggaaaacgcggccactgcaagagcccttgaacaagaaactaaaagggcccgcaaggaggaatatggccgagagaaattccgaggagcattgtggggtagcaacaatgagctcaagctccgaagggaggaaagagaccggtcacgggtgcatggcatgatcttaaaagaagagttagctgcgtgtgcaagatccaagaggagtttggctcaacacttggaagccatggagcaaagcatgctagctatcatagggcaatacaaggaagagttgaaccagtctatggcccatgaacaaaagctagtggaggattttgcacaagtgtacgccgaaaaagaagcaagagggagggtgattgatgcattgcatcaagaagcgactatgtggatggataggttcgccttgactttgaatggaagtcaagacctcccacgtctattagccaaagcaaaagccatggccgaagtgtgtacggcccccgaggagattcatgggctaatcaattactgtcaacacatgatagatttgatggcccacataattagaaaccgttag

SEQ ID NO: 15801 - DNA, 165 bp, Glycine max
  Peptide Sequence Number=SeqID_107486
atggaatacttacttgttggtgatgaacaaaagcgcaaaacggaatcaaaaaatgcgaaaaaggatgaccctagggctgcaaattcgtcaatcccgtgggggtggctcgcccaggcattccctgcttgtttcgcacagagaagggcaacgatcggtcggtcgtga

SEQ ID NO: 15802 - DNA, 546 bp, Glycine max
  Peptide Sequence Number=SeqID_107487
atgaccctgaagttgtcatggaattttatgcaaatgtctggcctactgaagaaggttttatggataagcactccaaagtgtggggccaatgttaatagactgcaagaagaggtctataccagtttctatggtgtactggtcacaccaacaaaacacatccagcctctaattaacaaatcatttattgaaaaatattgcaagccaaggcagccagtagcagatgcacccctaccaccagcacatcagccaccatccttggagtccatctcagctcacttgcagaggatggagctccagatgcacacatacatgcgtcatttggctgaccaacaagcagcaaatcatagaggccaaatgcaattgaatgaaaacttctaccattatacactgcaccaacattgccaggaccctggcccttatcattggcctactcctgagcagtttagagccattgttgcatggtctggaaacagacctatttttgcatggggaggcaggacttgtaaatgctcaaggagctgcccaaggagatggaggaagagctga

SEQ ID NO: 15803 - DNA, 306 bp, Glycine max
  Peptide Sequence Number=SeqID_107488
atgaaattaccaatgataagtgaagaagttttccaacccctgaaacccttcctcttcatggctattgtcgcaacctgccctctggcgggggcacaaaacggcctcttgtgcgggccaaggattgattttaaccaaacaaaagtcgtttcaggcattggacctttaaacgatcttttgattcttgaaaggagagaattgttaaggcgctggacccttttggacgatctcttgatttttgaaaagagagaaacgttaaggcgttggaccttcaatgatctcttgtttttgaaaggagagaaacgctaa

SEQ ID NO: 15804 - DNA, 171 bp, Glycine max
  Peptide Sequence Number=SeqID_107489
atggctatttatagaaaacagccaaggagtgcaaggaaatttgccagatcttcttcatcaatggagtcctttggttcttcaagatcaatggcaactgaatggagaagggggaaaggtgattggagatgccacatcaaggaaaagatgagtcagagaagctcattaccatag

SEQ ID NO: 15805 - DNA, 432 bp, Glycine max
  Peptide Sequence Number=SeqID_107490
atgagatcaagtcaaatgccttcgcttaaaaagaggttctatctagtcaaggtcaagagcctagggatcaccagtctaaaagagttaggacagttaatggggcagctccagcgacaagcttttcgtaaagcttacgataaaatctgggacctagccatggtagaagtctccacagaggccattgcctccctcgcccaatattatgatcagccattgaggtgcttcacctttggggacttccagctatcacccatggtagcaaaatttgaagagatcctaggatgtcctctaggggggaggagaccatacctcttctcagggttctatccctcattagctagaatttctaagatagtccaaatctcggtgcaggaattagaccacaaaaagcaagtcgaaaatggggtggttggaataccgagaaaatgttag

SEQ ID NO: 15806 - DNA, 384 bp, Glycine max
  Peptide Sequence Number=SeqID_107491
gcagcctgtaatcgattacaacatcctgtaatcgattaccagaaggcttattgggcctgtaatcgattaccaatacctgtaatcgattacaatgcgttatcttctataaatactcacgaaatcagagctgctgcgcagccaaagcatcctccacgttttcctccatacctagaacttcaaaccttcgattctcactcaattcttcaccaaatcacgtcccaaaaacttcatcaaatggcagagccatcaaagaagagaaagggatcatcctccaccactatcgctgctgcccatcgccgtcacggcccatctggagcacccacagcacctattcctccttctttgtcatctcccaagatcatcaacactattttcatccgatga

SEQ ID NO: 15807 - DNA, 412 bp, Glycine max
  Peptide Sequence Number=SeqID_107492
atggaggtggagcagttaaatgtcattgagttagataggccgtgcaggtctaaacctttaaaggacgtggcaacccctaggaggtttatatttgaggccctacaaaagggaggaattgttgcaacgaatgatagatcaaggctggaagagcagtatatattaatgcagtccacagatgagagaagttttggaaggcctaaacctttcgtgatatatttcaccaaggacgcagctcgacaaaagccccgataccccctagcaactaaacctgttcctttcccataccaaaacagccatgcagtcccgtggaggtatacacctccgagtgaaagggaagaagaaaccaccgacgttagctcattgtcagccaaggtaaccaatatcacagggttgagcggtgtgacccgcaacg

SEQ ID NO: 15808 - DNA, 434 bp, Glycine max
  Peptide Sequence Number=SeqID_107493
cgaggaagcggaagagcgcccaatacgcaaaccgcctctccccgcgcgttggccgattcattaatgcagctggcacgacaggtttcccgactggaaagcgggcaatggtgcaatctggggtggatgctttggtgctgtctatagttccaggggacattgcaaaggtaactacgaggttagagaaagcagcagttcgtggtggagtttgtagatgggataatcctgcctacgaaacagtgaagtttgttcaggagccaaagactgggaaattcagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15809 - DNA, 356 bp, Glycine max
  Peptide Sequence Number=SeqID_107494
atgttcaaatcagcagctctaaaaatccgaaaggagaataagggatgggctctgtggggcaacaacaatgagcttaaactccgaagagaggaaagggaccaatcacgagtagacagtttcatcttgaaagatgagttgaaggcttgctcgaggtctaagagaagtttgacacagcggttatgcgagacagagaccaacatgttagctatcatcaccaagtaccaagaagaactaaacctagccacggcccacgaacatagagtggcagacgagtatgcccaagtgtacgcgaaaaaggaggctagaggaagggtgatcgattcgctacatcaagaggcaacaatgtggatggtccg

SEQ ID NO: 15810 - DNA, 315 bp, Glycine max
  Peptide Sequence Number=SeqID_107495
gattgcatcactttggctttggacttggtcgcctattggtcggccatgtgtcgtaggcaacgctctaacctttttgtggatgagttagggtactctagaggtggcggtggtgcatctgttgcccattgctggccatccccaggctgttatggtgtctcgccctgcgcctgcttgggggcgcagtacttcttgatgaaagctcggcactctgtagaactgacagaggcccgtaatcagagctggagaccccaagaccctattggacttctctgggtccaccgggtgtcttgcgggcgcgattcctgcaaacaatag

SEQ ID NO: 15811 - DNA, 447 bp, Glycine max
  Peptide Sequence Number=SeqID_107496
atgttggaaagttttaaacaacaagaccaaatgtcagttctagaattgtacatagaaaaggatgtggctggtggttcaatgtttcattctgccaattcgcttacatcatgtggaaattatttatctaatgatgacacacaaccggcaacaaatatgagcaatttacatattgacaaagacgatgatgatgatgatgatgattatcttgtgtctaactcatacgttgaagagtctttagacgaagatgacagtgttgacggtatatctgatacagacgatggagtcacaaacattcctcaaccagtaagaattgttcacccagcagaaggtgcacaactaattgaaaattcattttggaatgatgcctcacattataacaatatcaactggagttatcctgatgaggaagacatttgcggtttggagatgccatcgacctttaattga

SEQ ID NO: 15812 - DNA, 1101 bp, Glycine max
  Peptide Sequence Number=SeqID_107497
atggtgcgcggtgatgcgtctggtgaaagacacggcgtggaacgtcgtctgcaccgccgcgagctggcctatctctccgccgacgaactgcgttcgatgtcggataaggcgctgggcgcgctgcgtctggcggtcgccgataacgaacacctgcgcgacgtcctgcgtatttcggaagatccgaaacgtccggagcgcaaaattcagttcttcgttgcggtttatcagcatctgcgcgagcgaatccgccaggatattattcgcactgacgatccggtagaagcgatcgagcagatggaaatcgagctcagccgtctgaccgaagagctgaccaatcgcgaacagaagctggcaattagctcccgcagcgtggcgaatatcattcgcaagaccatccagcgtgaacagaaccgtattcgcatgctcaaccaggggctgcagagcgtgtcgttcggccaggtcaacagcgtgcgtctgaacgtcaacgtgcgcgagacccactcgacgctgctggatgtcctgtctgaacagcatgagcaacatcaggatctgtttaacagcaatcgcctgaccttctcggaagcgctggccaaactgtatcagcgcctgaatccgcagattgacatggggcaacgtacgccgcaaaccatcggtgaggaactgctcgactaccgcaactatctggagatggaagtggaagttaaccgtggttcagacggctggctgcgcgcggagtccggcgcgctgtcgaccggtgaagcgatcggtaccgggatgtcgattctggtgatggtggtgcagagctgggaagatgaatcccgtcgcctgcgcggcaaggatatctcgccttgccgtctgctgttcctcgatgaagcagcacgtctggatgctcgctctatcgccacgctgttcgaactgtgtgaacgtctggagatgcagctgattatcgcggcgccggaaaatatcagcccggaaaaaggcaccacctataaactggtgcgtaaagtgttcaataatcacgaacatgtacacgttgtcgggctgcgcggttttgccgcgccggtaccggaagcgctgcctggaaccgctgacgcctcctga

SEQ ID NO: 15813 - DNA, 52 bp, Glycine max
  Peptide Sequence Number=SeqID_107498
gtcgactctagaggatcccccggatgaaccatatagccaagagaaaccatga

SEQ ID NO: 15814 - DNA, 81 bp, Glycine max
  Peptide Sequence Number=SeqID_107499
cttgcatacggggcagattctgctgctgtgccaatcaccacgacagatcttgttagcaagagtgtggcaattgagtctcta

SEQ ID NO: 15815 - DNA, 1110 bp, Glycine max
  Peptide Sequence Number=SeqID_107500
atggttagaactagagggttaggtcgtgccttaggcagggttataggtagagccctgagcagagaggatcatcatcattcaaatgatgttccccagcgacgaaggcctacagcatccgcacataggcaacaagaagttgcccctgttactgaggatgatactgtcgtgactaaagacgtacatacacatgctgaagaagctattgatgatgctgagggatttccaggtgggtcgtgtgacccattagtgctgactgactatggtgaccatgttgcagtcatcgtaaggaatggagaggaacgtcctgaattgaagttatcctcccgtggaaggaaagttcaaaaatttgggaggcctgctcctgaaattgaagggctatggacactggcgatcgagaacttatatcttcctattaaagacgcattccacaactttgagactctacatgtcgacgaagcagtcttgatgttggtggagttacttgaagtctccggagaggaagctagagctgagacagcacaatgtcatggggcatacatatgcctatcgtggctacaaaatatttatcagagtaaatgtgaagctggacattggattgttgcagctcgtgcctatctgttgcatttacttgagtcagagtggaagctacgcatggggagctgccaccctagttcatattgttggatatatgagcattttccctctgttgctgagtctttgagtgatccagactatgatgagatgtcaccacatgtctgtcggtggatttctacaaaggcttcttcaaagtcattaccaacatcggtgtatcggaaacatctagatggactgacgattgttgatgtttgctggatgccttacggtgatcactgtgtagttatatatgatgggatcccgttgtcgtcagacactgaccagagagggtggtgtggcaatttggatatgttcagaccattcctccacgggttcaatcctactgatccggccaaacatccacctgtgacgcaggatgacacatatatggagccacgtatccttgaggtcctagtggcaccagcagcagcaccagcacatgccccttctgatgtggagcagcctagacatgcagtg

SEQ ID NO: 15816 - DNA, 331 bp, Glycine max
  Peptide Sequence Number=SeqID_107501
atggagaattacaaagaatccatgaacttcatcctagctatgtaccactacagtatcctctactctttccttatggagaaaacggatatagacctgacatacttcatcgttgtacttcatccagcaaaaaaagaaagttataccatggtggaatctgaaagacttagctatatcagaaacaaccaaaagaagcttagaattgataagtattctagcttacaaacttcattggatactggaacagctaaaggcttaaccaagggaaaaagagtcatcttaccctcaacctttgttgggagcccacgttatatggatcaactttactttgacg

SEQ ID NO: 15817 - DNA, 351 bp, Glycine max
  misc_feature (5)..(5): n is a, c, g, or t
  Peptide Sequence Number=SeqID_107502
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtactccccgatcccgactctccaacatgttcccatacctgtactcgatactcgacaggttaaaatttattatcccatccttgtactcgttgggtatcgggtatccccgatcttgtcctgtacccgatccaaattag

SEQ ID NO: 15818 - DNA, 87 bp, Glycine max
  Peptide Sequence Number=SeqID_107503
atggctaatgcaaactgtccgcaagagtcattgcattcagtctcaaacgggaatctaaggtgtgtggctgtgtatgtgtgtgtgtga

SEQ ID NO: 15819 - DNA, 81 bp, Glycine max
  Peptide Sequence Number=SeqID_107504
atgtatccggaagaaattttaggcacagaaggaggaaggtccggaatgaccacttccgggatgaagatttctgttagttaa

SEQ ID NO: 15820 - DNA, 219 bp, Glycine max
  Peptide Sequence Number=SeqID_107505
atgaaaattctaagttcgggagttgtatttacgtttgaggaagctcgcccaggcgagcaaggttgcttcctccagaagcaaccgccttctggaggaagaaattggaaggcccaactttcgaagaagttagggaaactcacggattgcgcaaaaacacctccttttggtttccgccacattacggaatttcacggatcgcgtaagcctgcttccttttga

SEQ ID NO: 15821 - DNA, 520 bp, Glycine max
  Peptide Sequence Number=SeqID_107506
atggaaatccttattcaatcaattgatcccggtgcatggaatgccattattaaaggtcctttcatttctactaaagaactgaatggtgaattagtacctaaagaatgggatgagatgaaagatgatgagaaaagaatagtgcaagatgatcaaaaagccaaaaatattttaacctctggtttatcttctgatgaattttttcgtactacaaggtgcaaaagtgaaaaggaaatttggaatatgcttgaagtcactcatgaaggcacaacggataacttcaaacaagattctaaattgtcttacaagaacttcggaatagaagattacaataatcaaggaatccaagaatctagctacaatgacggtggaagctcttttcgtgaggaagatgcagagaatttcaatttgatggtaagaaaatttggaaaatttctcaagaagtccaaagacaaaaaattctctaaatcctccaagattgaaaacaacaacaacaacaacaacttcacaaccttcgaatgtg

SEQ ID NO: 15822 - DNA, 231 bp, Glycine max
  Peptide Sequence Number=SeqID_107507
atgaggaaaggccttcataaatatgtgatcctcctggacatctggtggtttcatggtggagtagacaatatggaattctttcatatgcttgtgtgggtcttcacctgcaaggccatgaaactttggaagcaaatggatcagtctagttttaagaacatatgggacatcctcatcagggtggagggattaaagggttgtaagtcagatggatttcctcaagtcagacactaa

SEQ ID NO: 15823 - DNA, 689 bp, Glycine max
  Peptide Sequence Number=SeqID_107508
atgacggtgaaaacctctgacacatgcagctcccggagacggtcacagcttgtctgtaagcggatgccgggagcagacaagcccgtcagggcgcgtcagcgggtgttggcgggtgtcggggctggcttaacttgcggcatcagagcagattgtactgagagtgcaccattgcgggcgatcggtgcgggcctcttcgctattacgccagctggcgaaagggggatgtgctgcaaggcgattaagttgggtaacgccagggttttcccagtcacgacgttgatccccatcggaaaaagaggttacgacggcgccaaggctgatatttggtcttgtggcgtaatcctctacgtacttcttgctggttttttacctttccaggatgaaaacttggtggctttgtacaagaaaatttaccgcggtgacttcaagtgtccaccgtggttttcctccgaggcacggaggctcatcaccaagctcctcgacccgaacccgaacacgcgaatcacgatttcgaaaatcatggactcgtcgtggttcaagaaacccgtgccaaagaacttggtgggaaagaaaagagaggaattgaacttggaggaaaagattaaacatcaggagcaagaagtttccactacgatgaatgcatttcggtaccgagctcgaattcgtaatcatggtcatagctgtttcct

SEQ ID NO: 15824 - DNA, 549 bp, Glycine max
  Peptide Sequence Number=SeqID_107509
atgaagctaacagacctcaatgaaaaaggccccatcacagactgccatgcagacgcgggtaagtggtttaacacccatggggaaattttgggcaatacaaaaaaaggaatagagggggagcacgaaaaagcattgcctcttgaggtatctatgcctcacaacagcattttgaatatcacgaatcccagcatggtctatgctgcctctggtcaacacgacttaaaagtggcatctgaggaaatgggccaacagacatgtggcccaactctttttgccacaaagatttatgtgagaagaaaggaggtgttgaggagtaatagcaaggcccaacagtttgagaaatcaattatggacttcaacccagcctctaaaactgaccctctgccttcattacacgaggactctatagagctacaatatgcccttttgaaggaaatgggcttgacttatggggaagatgataacaaggttaaagggttgttgctggatatggagaataaggataatatgatggcagcagagaagggaattaaaattcaacaattatga

SEQ ID NO: 15825 - DNA, 333 bp, Glycine max
  Peptide Sequence Number=SeqID_107510
atggccgtcttttacacgttcgtgactgggaaacctgctggcgtttacgctcacattcttaatcgccttgcagttcacatccccctgttctgccagctggaacttaatgccagcggcacgacaggtttcccgactggaacagcccggctgagcgccctgaacggcattgtctgctcactcattaggcatccccggctttacactttatgcgtctccgggctgcgtatgtgtgaggaattttcagcggataacaatttcaccggaaacagctatgaccgattacgaattcgaggctcggtaccgccaaggatatctcctggcccaaatgggtga

SEQ ID NO: 15826 - DNA, 305 bp, Glycine max
  Peptide Sequence Number=SeqID_107511
gggctctgtggggcagcaataacgagctcaagcttagaagtgctgagagggacgaatcgaggatggaaagcatggtgttagaagatgaacatgcaaaggtgtcagctttgcagattgaaagggaagcgagagagagggtgatagagttgttgcacaaggaagctatgaaatggatgaataggttcgctctcactttgaatgagagtcaagagcttccaaggctgttagccagagccaaggcagtggctgacacaacacgtgccaaggctaaagtcatgagcgagatagaggaagttcaggaatag

SEQ ID NO: 15827 - DNA, 385 bp, Glycine max
  Peptide Sequence Number=SeqID_107512
gtataggcttgaggtgatgatcaaccagggaaatgaaagcacaaaattcctgctttgggaccgtgaatgcagtgaattgattggtcaatcagctgatgcatttaataagcttaaaattgaagatggtgatgttgatttgaatgctttaccccaagcacttgataagctcctgggttatgaacttgctttcaagataaaggtgcaacccaagttcaggaattttgctgttttgaagtgttcagctgactcgagcttaataaatgttgtgatggatatgctagctgatgctgaggtaatgttcaatgcaagttatttgacattacctattggtgaaatagaccatgatccactgcttggacgccccttgacgcctacaaagcggtag

SEQ ID NO: 15828 - DNA, 1086 bp, Glycine max
  Peptide Sequence Number=SeqID_107513
gcttggactagatatactgacaatgtgttgggaagacacatattagctgagaggaaagtggaaatctatcacacagagctggatgaattccagggcgagatggagaggcataactttcacaagcgcttcaccaacttagctgatagtagcattgacctcacattggtgaaggagttctacgccaacctctacagtcccgaggggcctttacctaaacaagtcataatctgggtccacttaataaggattgatgcagacaacctcaatgcctttttagaaacacttatggtgcttgctgagggtgaatctttgcccgcctactcaagatactgcaggatgcctactgacattagagaaattgaggctgcactgtgcatacccgatcgagggtttattttaaatgctgaaggtcacccagggaagatcctcagaaaagatctaaccacccttgctcaggtctggagtgttctatcctactccaacctggctctgacctcccacacatcggatctgactgtggatcaagctaggttaatctttggcctagttactcaactggacatgaatgtcggagtcctcatttctgggcagattacttctatggcccagtctaactcctcaagactcgggtttcctgctcttatcacagctttatgcaggaccagaggagttgcctctgacagtcttttctttgaacatttgagccagatcattaatttggcctacataaggaagaattgttggaaccctgatgatccaataattattattaggggggccagaagaccaagggcaaggccaactgaggctccttctacatcagtagctcctcatctagctgctacatcagcagctcctcctctagctcatattgcagcagctccttctaccctacctcttgtagattttcaaagtttcgaagccatgcttcaaagcatacatcaggggcagattattttgctgcaaagtctccacctggtagcgcctctagacttcatccctacagtagagcaatttaatgaatgggtagcctggccagggactcaacctcctcctcacagggacgatgaggatcccgccgctcag

SEQ ID NO: 15829 - DNA, 108 bp, Glycine max
  Peptide Sequence Number=SeqID_107514
atgggtacctcagagccctacactagggcaatgaaaggcaccatgcgtgagcctcaggcgaacctaggggcagggggagtgacaaaccctgggatttcagtggattga

SEQ ID NO: 15830 - DNA, 486 bp, Glycine max
  Peptide Sequence Number=SeqID_107515
atgagagaaccacagctgtgcaatgttgcttgtcgtctaattcttgatgagaaaacggccaaagagttcaaggaaatgatagatgatgagtatcgggtgaacatgattctagacaatctccctttggttgttcctataagaaggcttgatcaggaagcttccgtggtgtatctgcatggcttccttgttggtctaaagggacaatattccggaatcaaagaggacaagtatttcatccacaaccacttagcatttgtggttaagtatcatagagatccagagttagagttgtcaaggattgtaggatttgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 15831 - DNA, 64 bp, Glycine max
  Peptide Sequence Number=SeqID_107516
atggaggttaaggagtctttgctggggattatggctaccattgcattattgagtagatatggga

SEQ ID NO: 15832 - DNA, 432 bp, Glycine max
  Peptide Sequence Number=SeqID_107517
atggcaacgcagttaatccatgatcgcgtggtgatggagtgcctagagggagtttgggagaccctcgaaggcaatgagaggtgccgattccgtggcacaattcgactcactgctacttcattagtacatccggaggaacccgcacgcacacttcagcagcctgtggagtggatactacctacacctaccccatatcgactagtggagccagttcaagtgatagaagtgtcatcctctgaagaggatcctgaagaggacccagaggagttacctcctgaacctgttgtggatgcccttgactttccagaggatgatgaggacccactccctgatgtggattctccagaggatatcatgtcagcatctgaggtagactctacagaggagagcggccctggagggacagtgaatagtgaagactcttcatcatag

SEQ ID NO: 15833 - DNA, 306 bp, Glycine max
  Peptide Sequence Number=SeqID_107518
atgcctaacatcaaccaagctttccgacccgcatcggaaacccctccagtccagcacccttccaacaaagggcacccactcaaaactcgactcctacacaacctcgccccaccgacagctctaatccgagcacaagtgccaatctgggaaggaattttccgacttgctaccctctttgatcgccaaccaaatggtggtggtatcccccaggaagattttctagtctccttttccttgatggtacaaccccaacccaacctgcgcttatcacggggttatcctggacactcgatagacaatgtatag

SEQ ID NO: 15834 - DNA, 486 bp, Glycine max
  Peptide Sequence Number=SeqID_107519
atgccaatctccccctgcaaaagtatcagttggtctgtgtcgtcccgacatggggatcgcacccacaagacacccagtggacccggaaaagtccaacagggccctggggtttccagctctggttacgggcctctatcaatcctacagggtgcccgtacccccccggcaaggtcacggatcgcgcctgcaagacacccagtggacccgaagaagtccaacagggtcttggagttgtcaagctctaattacgggtctctgtcagttctacagagtacctgtcacctccagcaagggcatcagccccctactaatcgagctttcatcaagaagtactgcgtctcccggaaggcgcagggcgaaacaccacagcagcctggggatggcccggcagcgggcaacagacgcaccgctatcacctctagagttcacctcagctcatccacaaaaaggttagagcgttgcttacgacccatggccgaccaatag

SEQ ID NO: 15835 - DNA, 1320 bp, Glycine max
  Peptide Sequence Number=SeqID_107520
atgcgctgggtgaccatcgccgaagaggatgccgtttcagagatgtggctggtctgggcaaaacatcgcgaacagagccatgccgcagagcgcttcaaacagcagttgatgaacgcctccgccgggcggcattttcagggaaaaccctgcaagtgcttcaccatagccaacagtttatttcgaagctcgaaaataagggagtacgaggtggtcgctgatagtcagccagggcatattgatcagattaagcagaccaacgctggcgcggtgtatcgcctgattgatcagcttggtccggtttcgcgtatcgatctctcgcgcctggcacagctggcacccgccagtattaccaagattgtccgcgagatgctggaagcgcacctggttcaggagacggaaattcaggagccgggcagccgtggccgtccggcagtcggactgttggtcgagacggaagcctggcactacctgtcactgcgcatcagccgcggggagatcttccttgccctgcgggatctaagcagcaagctggtggtggaagaccggcttgagctgccgctcaacgctgagcaaccgctcctcgagtcgattgtgtcgcatatcgatcgcttctttatccgtcatcagcagcggctggaacgcttaacggcgattgccatcaccatgccgggcatcattgataccgaaaatggcattgttcaccgcatgccgttttacgacgacgtcaaagagatgccgctgggtgaagtgctgaaaaaccataccggcgtgccggtctatattcagcatgacatcagcgcctggacaatggcggaggcgctgtttggtgcctcgcgcggggcgcgggatgtgattcaggtggtcatcgaccataacgtcggggcgggcgtgatcaccgacgggcgtcttctccacgctggcagcagcagcctggtggagattggccatactcaggtcgacccgtacggtaagcgttgctattgcggcaaccacggctgtcttgaaaccattgccagcgtggaaagcgtgctggagctggcgcaggtgaggctcggccagtccatgagctcttcgctgcacggacaacccctgacggtagattcactctgcgccgcggcgcgccagggcgatctgctggcgaaggacatcattaccggcgtggggaataacgtgggccgcattctggccatcatggtgaacctctttaacccgcaaaaatcctcattggctcgccgctcagccaggcggcggagatcctgttcccggcgatctcggcctgtattcaccagcagtcgctccactgcgtggggatcctctaga

SEQ ID NO: 15836 - DNA, 425 bp, Glycine max
  Peptide Sequence Number=SeqID_107521
atggagcttacatcagtggttgtgggtgatactgagggccctccaaagtgttttgcaggggtataccaccaactgcttgcccttcagtggcatatccgaggcaaggctcgaagtcggctaaattgtggtgggtatcggagtggagttattgacattctcattgggagtgtacgccacattgggtggtgtataattgggaggcaagctatatggcgggaaggtatgcttgccatatggggggtcaggtccacctcaacaatagtgctggtagcggctgcaaccgcattgacctccattatcttcttcatgcttatcatggcctccatcattgcggtcatttactctttcatggcctccatgttggtctttatctgctcttgcacctcctctacttcacccattactctagctctagcatgggttca

SEQ ID NO: 15837 - DNA, 398 bp, Glycine max
  Peptide Sequence Number=SeqID_107522
gatgccatgagcgacatgatcacgctgcagcacactgaaatcaaagcatcctttgaaacaagtacacatgtgattggacatgtttttaaagttgccttatacaagagggttcttggaattgtttcaaggtatgctttaaatcagatagctgctgagtttgagcgtgtacattatgctggcaagaatccttcttcttgtggttgtcataagaactatgcatggtcttccttgtgcatgaagagatggaaaccatatctaaagagtaaacttcgggaaattgcataccctgatcaaaactctatgtgtcctcctccaacaaagatcaacactaaaggtgcaccgaagaaaccaattaacagaaaccaaatatcaacaaagcgtgatctgtcttacttgga

SEQ ID NO: 15838 - DNA, 138 bp, Glycine max
  Peptide Sequence Number=SeqID_107523
atgtgttttcgtgaagaaaatccaagccgaggtgctttcgtaagcgattcttgggaaattcttcatcgttcttcatcgttctccattcgttcttcgtcgttcttcagtcttcaaccgttttcttttcttccgttttaa

SEQ ID NO: 15839 - DNA, 229 bp, Glycine max
  Peptide Sequence Number=SeqID_107524
aggatccccgatcgaggtggtggtcacggtggttctggaagaggccgtggtggaagcagatttgctaacttccagtgtcaaatctgcctcaagtatggtcattgatgtagctccatgtggagcttgtaggccttggatcttcttcatcaatggattcctttgtttcttgaggtctgattgtagcggaatggagaaggagaaagatgaatggaggtgccacttcaagtag

SEQ ID NO: 15840 - DNA, 414 bp, Glycine max
  Peptide Sequence Number=SeqID_107525
atggacagagccaggttggtttacagattagtcacaggcatggacatgaatatcagagccttaatctcgggtcaaatttctaccattgcccagagtaactcctctaggctcggattcccgaccttgatcactgctatatgcagagctagaggagttatctctgacattctaacctatgagagcctgagcccgaccattaacttggcctacattaagaaaaactgttggaatgtggatgatctgacagttaactttagaggggctaggaaggtaagggctcgaccaacagatattccttcttcttctgtaccaccagctccttccacttctgccactcctacaccagctcctcccacttctgccacccttgcaccagctgcccaagactctcagcgctttgaaaccatgctttag

SEQ ID NO: 15841 - DNA, 458 bp, Glycine max
  Peptide Sequence Number=SeqID_107526
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccaaaaatccaagaatacaagatacaacatcaagaagatctctagtgttttaggaagggaattccaaattgaaactgcaaaag

SEQ ID NO: 15842 - DNA, 230 bp, Glycine max
  misc_feature (174)..(174): n is a, c, g, or t
  Peptide Sequence Number=SeqID_107527
atgttgagtcctatgaatcatggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgnaccgatcgcccttcccaacagttgcgcagcctgaatggcgaatggcgcctgatgcg

SEQ ID NO: 15843 - DNA, 645 bp, Glycine max
  Peptide Sequence Number=SeqID_107528
atgtcgcagaggggatcgttgatcccaacacatattcagccagatatacatgggttaggagcacgagtgagcacaaaagggagcaatgcgaagagtgttcgcaacccatgtctgcctaatgatgttgctcttgtcaaaccccctatggggttgtatgtgcaacgccaagattcaattgagttggtggccttaggaaaaacatatgatggaggctcgaccatacacaatgtggcttatgctgacaatgtcgtaagggttagtgttgagcaagttattgatggtgacgctgaggtcccattcccaacatcagagtttaagtgtgtcagggaggcccttcacacattcattgcatggccaacaccacttgttaaaaaaatctttattgagcatgagggcagtagtccaactaaagacactgaagttgttgaagcggtcaacgatgttgttatagatgaccccttgcgcgagttgattaagagcctagttgacatttatgagaagcctgtagagttagtgtgggatgttactaaatttggaattccaaatgcaactgcatcattgttcgtaacgtgtgctgatgtgaatgaaataatatcaggcgtacagtgtttgaacatagctatactacaattgtggaccatgtaa

SEQ ID NO: 15844 - DNA, 357 bp, Glycine max
  Peptide Sequence Number=SeqID_107529
atggacccgaagaagtcccatagggccctggggtttccaactctggttacgggcctctgtcagtcctacagggtgcccgttcccccagcgaggtcatgccatcgtgacataggaatcgcacccacaaagacacccagtggacccagagaagtccaacagggctttggggtttccagctctggttacgggcctctgtattctacggagtacctgtcacctccagcaagggcatcaggccccttactaatcgagctttcatcaagaagtactgcatccccaggcaggcgcagggcgaaacaccacagcagcctggggatggccagcagcgggcaacagatgcaccgccatcacctctag

SEQ ID NO: 15845 - DNA, 413 bp, Glycine max
  Peptide Sequence Number=SeqID_107530
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgaatcttctcaaggaagcttttcaaggaagtttctcaaggaagcttctcaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 15846 - DNA, 180 bp, Glycine max
  Peptide Sequence Number=SeqID_107531
atggaagaggctatacaagcacaagagtgtagattcgccaagaatagagtggaggaagtgactaactatgtggagcaaaaagatgagaagtttgaaacagtgctcctagcacgtggaggtaatgaaggtagccaagaaaacacatggtaccttgacactggtgcaagcaaccatatgtga

SEQ ID NO: 15847 - DNA, 336 bp, Glycine max
  Peptide Sequence Number=SeqID_107532
atggttgccgggaagctagagcatcgtggtgtcacgctcgtcgtttggtatggcttcattcagctccggttcccaacgatcaaggcgagttacatgatcccccatgttgtgcaaaaaagcggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcggtgttggcgggtgtcgggctggctaactatgcgcatcagagcagattgtactgagagtgcaccatatgcggtgtga

SEQ ID NO: 15848 - DNA, 231 bp, Glycine max
  Peptide Sequence Number=SeqID_107533
atggagggtgctaataccttcctcaaacgtaaatacaactcccgaatctggaatattcttcatgaccgatttccttcggtttttccgacgttttccacaaataaacgttggtggcgactccgcgcattttcctcctttggaagacgcacccgtgagtctcgcctcgctcgcccaccaaagggtaggttgcgactgttggcgactccattggggactgtttttgtgagttag

SEQ ID NO: 15849 - DNA, 642 bp, Glycine max
  Peptide Sequence Number=SeqID_107534
atgtcggctctgaaagatcaaatggctttcatgatggaagccatgctagatatgaaaagattgatagagagtaatgcggccacagctgtcgtcgccagcaccgccgctgaagcagacccggtccttctgtctatggcaaatctagcacatcaactcaccccggatatggtaggacaaggaagagacatattggggaataccaacaaaccacatttggggtacaaccgaagtgcttacccctatggtctaccccccaactttacaccacctgccatgcatgagaacatggatcacgttgctccccctacttttgaagggcaacctccccaacccacagggggcgtttgcgaagaccctcaggagcgtgcccaaggggacgtcgactcctacccccttttcaccactgagggatcggcaccctatggcttgcctcagtccaatatcgtgggagtctctcaaccccacccgatgcaaccactgctcttctttgtagggggaccacctccgatagtggaaggaagaaaaaagctcgatctcatcgaggagagattgagagcagttgaagggttcagagattatccctttgccaacatgaccgacctatgcttggtgcctgatgtcgtcatccccccaaaattcaag

SEQ ID NO: 15850 - DNA, 202 bp, Glycine max
  Peptide Sequence Number=SeqID_107535
tgatcaacgggttcccatgaaccctaagagaataaaggtcattcctgagtggctcactccaccaagtataagaaaaatttggggcatccatgaattaacattcctgatgcaatcctaccccgcaagggcattggctagaagactccaagtagattgggctagagatccaaggaaaggccctagggttctcatgagccttagg

SEQ ID NO: 15851 - DNA, 198 bp, Glycine max
  Peptide Sequence Number=SeqID_107536
atgcacggagttgccaccaacgtttattcaaggaaaacgtcggaaaaatcggaaaggtgtggtctacgaactttaatcgtgaaaggttcgggagttgtatttacgcacggggaagttttatctttttgtggtcgacaagggcgtttcccttgctcctatgtattcctcaattgtgataaggaaatcatacctatgtag

SEQ ID NO: 15852 - DNA, 237 bp, Glycine max
  Peptide Sequence Number=SeqID_107537
atggaggagtttgatgctcatgtggcctggctaggagaccagcccttttcttctagagggggtggagcctctgtagcccatgagcctgtgcctgaggagccaccagcactagcagcagcagaggaggagactactcctgaggagacccagccatctacaccagttgcggagccagagcagcctatacaggattcattagtagctccagcactggatctcaatgaagaccaaccctag

SEQ ID NO: 15853 - DNA, 894 bp, Glycine max
  Peptide Sequence Number=SeqID_107538
ttggaactcttacgtgccgatcaacgtctcatttcgccaaaagttggccccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgctcctttgccttttcagccacagttatctctcaattctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15854 - DNA, 186 bp, Glycine max
  Peptide Sequence Number=SeqID_107539
atggatgaaaatcacaagaagactcacaagttcttagatgttacaaatgcaaccaacttggtcacatcaaagctaattgtccttcaaatgaagaatggcctgagaaaagtgataagaaaagaaaaggaaatcaaccttctaaccaaggattatgagagtgatgagaacatttctcaagaaggttaa

SEQ ID NO: 15855 - DNA, 656 bp, Glycine max
  Peptide Sequence Number=SeqID_107540
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacgaatccggttgttccactatgttatcccaccaaagaagattgtgtctgtcgctgatcatgtcaatactgagtatgaagcgtgggaggttcaagactacactccttgtttggctccaatctactctttcaaaatcggttctgtcacgcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaagctgcaccg

SEQ ID NO: 15856 - DNA, 354 bp, Glycine max
  Peptide Sequence Number=SeqID_107541
atggcaggagctggtgataatggtggtgtatatcatcaactggacggatctcagcgcttattactggacgcgatgactacacaaatgcaacatttgttgaaccgtaacaatgaagagctctacaggcgaatagtcaaatcttccttgtttattcttaaacctctatcccctagagaagtgtgtgatgaccaaattagaatgagagaaaagagagaacaagagaaagaaaatagtgaggcaccacagaggattaggaaaaagaagagtgatacacccgagggaaagagtgatacacataaaagagagagtgatacacatgagagaaaatttaatttattttgcagaggcgagtga

SEQ ID NO: 15857 - DNA, 239 bp, Glycine max
  Peptide Sequence Number=SeqID_107542
ggatcgcgcgtgcacgacacccagtggacccgaagaagtccaacaggttttacggagtgcgtgtctcctccagcaagggcatcagaccccctactaatcgagctttcatcaagaagtactgtgtccctaggcaggcacagggcggaataccacagcagcctggggatggccggcagcgggcaacagacacaccgccatcacctctagagttcatctcagctcatccacaaaaaggttag

SEQ ID NO: 15858 - DNA, 549 bp, Glycine max
  Peptide Sequence Number=SeqID_107543
atgaagcacttcactgacaccctcatcagtgccaacatatgtggattcatccgcactggtgattcggttcccgactgcagtcggtcaggtgtcgtcgagcgtcagccgaccttgatgccctgcttcttcagcttggccaaggttgactcctgggtgtcagccagtgccttgtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15859 - DNA, 117 bp, Glycine max
  Peptide Sequence Number=SeqID_107544
atgggcccagttttgccagactcgcaaagacccttcttggaaggatgtgcggaaaaaggcgcaagccattcacaaatagaacactgccccccacgttttgtctcgtgggggttatga

SEQ ID NO: 15860 - DNA, 845 bp, Glycine max
  Peptide Sequence Number=SeqID_107545
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgactcgttaaaatctgaatatgaggatcaaaagaaactggtaacggacttgggaacaaagctttatattttgaaacgtaaatctcaaacaagcggcggcagtccagaatatgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15861 - DNA, 333 bp, Glycine max
  Peptide Sequence Number=SeqID_107546
atgggtgccaagtacctcgaagtggtcaaacgagggtcgcatcccaacaacggatggtccccggacgaaattaggacacgatcgcctctggatggcgagaaggtgtgcaaaatgaccataatttgtccccgcccacctctcaacttgctgtttttgaatgacaaagggcgcagaatttgtctctgcacgtttatcacccaacttgcgaaatctgaatttcaaagggtgcagaatctgtctctgcgcgtttacccactcagcttgttgttcctgaatgataaagggcgcagaatctgtctctgcgcgtttgcccactcagcttgttgttcctga

SEQ ID NO: 15862 - DNA, 392 bp, Glycine max
  Peptide Sequence Number=SeqID_107547
atgtccaagtatggtggctggaatgctctgattcatggcagaaactccacagctttctctaactggtggaaggacttaaaatctattttccagcagcagcacactaataggctgttctggaaggataaatggagggaggatgatttaactcttcaagaaaaataccctagtttgtatcaagtgagctaccagcaggattcttctatcagcctaatgggaattcttgttaataataaatgggaatggaggatgcaatggaggagaaacttctttgaccatgaaatcgatatggtagaagcctttatggatgagattgatgctgtccagatttacccaaccagtatggactcccttatttggaaggctgatcctagtggagcctattccacaaa

SEQ ID NO: 15863 - DNA, 255 bp, Glycine max
  Peptide Sequence Number=SeqID_107548
atggctactagtgaccacgcaattctgtgtgatagatcccacattcctaccaagagaagcctactagagctttcatcacaaaatgcattgttggcacaaaacaagctattgtccaagcaattggaagcattgatagacatactaagttgtgtcatatgtggtggagcacatagtctagctgctgtattccccaagaagaaacaccacatgaagtcaactacatggggaaccagccaagacaaaatttcaatgtag

SEQ ID NO: 15864 - DNA, 423 bp, Glycine max
  Peptide Sequence Number=SeqID_107549
atgcctcaaaatgttctttacgatgccattgggatatatcaacggtgtgatggtgttaatttcgagggctccagtggcgtatcatggtttctatcagctgttcctcctgttcagctactgaacggggtggtgttatccgctcacaattcggcacacaagcataccgagccggagcatcagcgcggcaagtgtaaagccggggtgcctaatgacgctgcagctaactcacattcacacccttgccgttgcgctctaactgcgccgctttccagtcgggacgctgtcgtgccattcgctgcattcaaggctgaatcggccaactgttgcgcgaagggcgatcggtgcgggcctcttgcgctattacgccagctggcgctaaagcggatgtgctgcatactggcgattactatgttggcactgtaa

SEQ ID NO: 15865 - DNA, 222 bp, Glycine max
  Peptide Sequence Number=SeqID_107550
atgacaccggtaaaccgaaaggcaggaacaggagagcgcacgagggagccgccagggggaaacgcctggggggcggagcctatggaaaaacggctttgccgcggccctctcacttccctgtttttcaagtactgtcattctcacaacttttccatatcgaattcctgcagcccgtggggtaagccactagttctgagcgtgccgcatgacgaccgacggtag

SEQ ID NO: 15866 - DNA, 1022 bp, Glycine max
  Peptide Sequence Number=SeqID_107551
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgagcacctgagcgtccagcgcgagaaccgcgaccgcgagatcgccgtcgcggcgaagaaccgcgagcgggtcatcgccatcgagaccgagcgcatcgagaaggaccggctgctatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 15867 - DNA, 773 bp, Glycine max
  Peptide Sequence Number=SeqID_107552
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagatgagtaagattagccaaagatattcgagcagggtccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15868 - DNA, 782 bp, Glycine max
  Peptide Sequence Number=SeqID_107553
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaggtcatggttgcagatagagagaaggagacacatttgaaaccatggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15869 - DNA, 1272 bp, Glycine max
  Peptide Sequence Number=SeqID_107554
atgattgaatccgaaagactctcctatgttagaaacaaccaaaagaaactcagagttgataagttctatagcttgcagcagtcatccgaagctggaaatacagaaggtttaggccaaggcaagaggattatcttaccttcaacctttgttggcagcccacgttacatggatcaactttattttgatggcatagctatatgcagtcacgtaggcttcccaaatctttttattacttttacctgcaatccaaattggcttgaaattcataggctgctgacacctttgaatttgacaccaatagataggccagaaataatctcccgcattttcaagcttaaatatgagcagatgttattagaccttacaaagaatcacctgctaggcaaagtcgtcgcatatggagatggttatcctgtgtatcgtagaagaaacactggtcggacaataaccaagaatggtattataattgataatagatggattgtaccctacaatccaaaattgctgaaaaaataccaagcacatataaatattgaatggtgtaaccaaagcacttctatcaaatatttattcaagtacatcaataaaggatacgatagagttacgactgtcatggtacatgatgacaatggaacagttccccatgcaaacactccgaatgatgaaatcaaatacatttctccatgtgaatctacttggaggatctttggttttccaatacatggtagaaaaccttctgtagagaggctacagttccatcttccaggccaacatagcgttctctaccaagaccatgatgatattaatgatctcctctctaacccaggcatttctgaatcaaaatttatagcttggatgaatacaaaccaggtttttgttgaaggtcaaagcctgacttattctgaatttgtaactaagttcgtgtataaccagaaacagagatgttggcaacttaggaaaaagggttatactactggcagacttcaatgggttcctccaactacaggggaattattttatttgaggatgatgctgactgtctgtagaggaccaatctcatttgaaaatatcagaacagttgatggtgttgaatattctacatatagagaagcatgttttgctatgggtttttcacaggatgatagagaattcattgttgcaatccaggaagcaaaagactggggctcagcaccttatctaaggaatctttttgtattattacttttgacaggtaccatgaacaaacctgaacaagtgtgggaaaaaacttga

SEQ ID NO: 15870 - DNA, 510 bp, Glycine max
  Peptide Sequence Number=SeqID_107555
atgaacttagtcattgttatcaaaaggaaagaacacgctttacgatgcccttaccaaacctgtgctagagctagagtaatgggtgaagtagaggaggtgcaagagcaaatgaaggccgacatggaggccatgaaagagaaaatggccacaacgatggaggtcatgatgagcatgaagaagataatgggagccaatgcggttacagttgccgctaccaacactattgctaagtgcaaaaacaagcatgccttcccaccatatgacttgccaccctactatacaccacccaatgtggcgtacactcccaatgggaatgtcaataactccactcctatactcgttgagagccagcaacctcaatctgatcatgcacatgtctctcgacccatgggggagacacatgaaatgccccaccacaatctagccaacttcgagccttgcctcggatatgtcgctgaagggcaagcagttggtgatatacccttgcaaaacactttggagggcccttag

SEQ ID NO: 15871 - DNA, 371 bp, Glycine max
  Peptide Sequence Number=SeqID_107556
gaggatgcatgaacagcgctaggcaatcaattcatggggactcctggactcatgatgctggaggatgcacgaacaacgctaggcaatcaattcatggggctccggacttgaaggtggaggatgcactgaacagcgctgaggcaatcaattcatggggctccggacttgatgactatgatgaaggatgcatgaacgctaggcaatcaattcatggggctccggacttcatggcaatcaattcatggggttccggatatgatggtggaggatgcatgaacagcgctaggcaatcaattcatgggactccgaacttaatgatggaggatgcacgaacaacgctaggcaatcaattcgtggggctctggacttga

SEQ ID NO: 15872 - DNA, 216 bp, Glycine max
  Peptide Sequence Number=SeqID_107557
atgcatgcgagacattcttatggaagcaatgccttccaaggttattttgatgatgccaaagaatcaagagttaaacaaagtttcaagcaaagattcaagaatcaagtttcaagattcaagattcaagaatcaagtttcaagtttcaagaatcaagaatcaagatcaagattcaagactcaagattcaagaatcaagagaagactcaatcaagataa

SEQ ID NO: 15873 - DNA, 537 bp, Glycine max
  Peptide Sequence Number=SeqID_107558
atggcacgtcctcctaataacatcaagtctattaatggatcaaaagaggcacttaaacttgtcgtaagaattaatgatctttggttcattgggactccaaacagatctgaacaagcagaaatggtcataattgattctcatggagatacaatccatgttgtctgtaaacaagatcagttaaaatcttggaaggctgatttgattgaaaattatacttacgtaatgcataattttaaagtcatgaagaatgatgaccaatttagaatctgtgatcaccagtataaattagtttttactggagttactgttctcaggcaatccaatttggaggatcttccctttaagaaatatcaatttgctgatttcactaatatcgttgctgggctcttcgaacctaaattgttggttgacattattggtgtcgtggatgaggtagtctatcgtcatgtgggatcagagaatacaagggttgttttcaaactcaaggatttgaggtcatattgtacaattgaccttttgacaaattatgtcttttaa

SEQ ID NO: 15874 - DNA, 699 bp, Glycine max
  Peptide Sequence Number=SeqID_107559
atggggtcaagtcaaatgcctttgcttaaaaaaaggttctatcaagtcaaggtcaagagcctagggatcatcagtctaagagagttagggcaattgatgggtcagctccagcgacaagcgtttcgcaaagcttacggtaaaatctgggacctagccatggcggaagtctccacagaggccattgcatccctcgcccagtattatgaccagccgttgaggtgcttaacctttggggacttccagctatcacccatggtggaagaatttgaagagatcccaggatgtcctctagggggaaggaaaccatacctcttctcagggttctatccctcattagctagaatttctaagatagtccaaatctcagcacaggaattagaccacagaaaacaagtcgaaaatggggtggttggaataccgagaaaatgtttggaggcaaaagcaagaatcttggtaggtagaggcgaatgggcctcattcatagacatcctcgcacttttgatcttcggagggttcctctttccaaatgtggatgggttggtggacctggcagcgattgacgcttttctcgcctatcatgaccgcaaggaaagcctggttgtcgctatcttagccgatctatatgacaccttcgatcgaagatgtgaaaagagcagtacaaggattgtttgttgtactccggccctctatgtatggttg

SEQ ID NO: 15875 - DNA, 385 bp, Glycine max
  Peptide Sequence Number=SeqID_107560
atggtgaaagttggaacctcttacgtgccgatcaacgtctcattttcgccaaaagttggcccagggcttcccggtatcaacagggacaccaggatttatttattctgcgaagtgataaaaaaaatcttcgtcacagctgttcctcctgttcagctactgacggggatggtgttatccgctcacaattcgcaacaagcataccgagccggaacatcagcgctggcaagtgtaaagcctggggtgcctaatgacgctgacgctcggcgaacgtcgccattcgctgcattcaaggctgaatcggccaactgttgcgcgagggcgatcgggtgtcccagtcagaatgcgttctgtgggaaaaaaagctgcaccggtgctcagctgaatt

SEQ ID NO: 15876 - DNA, 282 bp, Glycine max
  Peptide Sequence Number=SeqID_107561
atgtgggcagatatgttgcattggaggaaggagtatggagtagattctattttacaggagtatgaagaggtacagtgttattatcctcatggctaccatggtgtgggcaaagagggccaaccgggatttgagaaaatgtttaaagagaaattcccagcatgttctattgcagcaaagaggcatatagataaaacaacaacaatacttgatgtgcatagagtgaattgggtcagctttagcaaagttgcacatgatcttgttatgcgtatgcaaaaaaattga

SEQ ID NO: 15877 - DNA, 503 bp, Glycine max
  Peptide Sequence Number=SeqID_107562
gacactggggcagacattcctgcagacacaggcgcgcaggctgctgaggatgagcatgagggatttccgggtgctccaagcgacccatccgtgctgacccagtatgcggatcacgttgcttgcagtgtatgtacgggagaggagcgtcctgagttgaagttatcctttcatgggaggaaggcccatagtttaggcaggcctgtccctgccattgagggactaattgctaggacaggactaagtcctctgatcacgtctagtttccatctccctgtgggagagctcacgatcacgctggacgacatctcctcgattctacatctgcccgtggttggcgacttgcacgcctttcagcccttgcacgtggatgatgcggttcagatgctggtggacttattgatggtctctgtagaggctgccagggctgagacagggcagtgtcgtggaccgcccttcgtgacctcagttagaccgggaggtatgcctggggagtggctgctctg

SEQ ID NO: 15878 - DNA, 441 bp, Glycine max
  Peptide Sequence Number=SeqID_107563
atggtgaaagttggaacctcttacgtgccgatcaacgtctcattttcgccaaaagttggcccgtgcttcccgccggagtcaacgagtccgaaccaggattactttcgcttcggtgcgaggaatccgcttcgatcacagcttatcgcaaccgtcgacctcgagggatgcgccggaacttttgattttgtagtgaggctgtccttcctgttcagtatgaaattgttatccgctccaattcggcacaaagcataccgaccggacatcagcgcggcaagtgtaaagccgggtgcagctgagcgtaaccaccacacccgccggttaatgcgttgcgctcaggctgcccattcgccttcggtgcgcaactgttcgggaaacggctgtcggtgccagggcccttcgctattaaacgccacgcggcgaaggggaggcggtttgcagtag

SEQ ID NO: 15879 - DNA, 917 bp, Glycine max
  Peptide Sequence Number=SeqID_107564
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattgccccaaaatggaccaggagttgccgaccctcaaggtcggtcagaaaacaaccgagacagggttgcgaaccctgcccagattcctgggcaagctgacattcgacaagcagaaaggggtctgaaccctggatccaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15880 - DNA, 435 bp, Glycine max
  Peptide Sequence Number=SeqID_107565
atggcgtatcatggtttctatcagctgttccctcctgttcagctactgaaattcggggtggtatccgcgtcacaattcggcacacaagcataccagccggaagcatcagcgctggcaagtgtaaagcctggggcgctaaagggcggagtgtgcatactggcttactatgttggcactgatgcagggactcactatggtccgcgaattcccgctctgagctcgctaccgctcggtcgtcgatgcggcgacgctagaactagtggcttatccccaacggggcaggaattgtcccgtggtatgctacaaggaagtgatgtggcgtttccccctggcggctccctcgtgcgctctcctgttcctgcctttcggtttaccggtgtcattccgctgttatggccgcgtttgtctcattccacgcctgacactcagttccgg

SEQ ID NO: 15881 - DNA, 462 bp, Glycine max
  Peptide Sequence Number=SeqID_107566
atgtaccctctcttgttctcagtcacaacaacccaagtagatgtaccctctacttgtaccacaaaggatggaaagggaagaatcaaaagaattctcagactgtgtcgttttgaattctttgacaaggtagaagggagacacaaaagaattcaggcggttagtccttcgttcttttggaaaagggagaagagagacacaaaaagaattcaggcgaaaacttttagaaagcttttggcaaaggaagaagaagaagaagaagaagaagaagaagaagaagaaaaagttcaaagagattcaaaggttgtaaaagaatatgtggaaaagttgtttgtaagggttgtaggtgttgtaagtgttcttcaaataggcactggtaatctatggattttgaaaatgagggttcgggagttgtttacgcacggggaaggtgatgcaatcctaccccccaagggtattggatag

SEQ ID NO: 15882 - DNA, 240 bp, Glycine max
  Peptide Sequence Number=SeqID_107567
atgggtgatcaagaggagacacaggaacatatgaaagtctacatgtcggctctgaaagaacaaatggcttccatgatggaggccatgttaggaatgaggcaactcatacccaactctcctagctacagcacaccatcatcccccaaatgcggtaggatgaggaaggagcacactggggcacaacagcaacccccatttgggatacaaccgggtggcttacccttatggattgccgcctaa

SEQ ID NO: 15883 - DNA, 201 bp, Glycine max
  Peptide Sequence Number=SeqID_107568
atgggtgccaagtacctcaaagtggtcaaacgagagtcgcatcccaacaatggatggtccccggacgaaattaggtaccgatacatcatctggatactgtcaaattcgttcctcctggttgacacaaggcgcagaatgaccataatttgtctctgcgtgtctttggacgcgatcgagcctgggtggcaaggcgcagaatga

SEQ ID NO: 15884 - DNA, 396 bp, Glycine max
  Peptide Sequence Number=SeqID_107569
atggaacttattgagaatatgactactagtgatcatgctattttgcatgataaaactcatgtacccacaaagagaagcctgctagagctttcctcacaagatgcacttttggcacagaacaagctgctagccaagcagctagaatcattgacaaagacacttagtaagctaccaacacaattgcaagcggctcaaccttcccatttagcaattatgcaggttggaggttgtagtatatatggaggagcgcatgaatctggttgctgtataccccttgatgatgttgcaaaggaagtgaattatatggggaatcagaatagacaaggattcaatgcaggtgttttttcaggttaccagcaaggtgcaaattttaatcggaatcaagggcaaggatga

SEQ ID NO: 15885 - DNA, 216 bp, Glycine max
  Peptide Sequence Number=SeqID_107570
atgaccctttcatcatggcagaacaagctagacaagtattttacgtgcaagacccttgtgatgaaaggtggtgcgtggttctacagggcaaaacaattgagacagaggtcaccaaagcaaatggcatccttaggacttcatacaactcgtgtttgtcgccagtttcatcatccaccacccttaccttctctggcttctcacgtttattgttgttaa

SEQ ID NO: 15886 - DNA, 708 bp, Glycine max
  Peptide Sequence Number=SeqID_107571
ttggaactcttacgtgccgatcaacgtctcattttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15887 - DNA, 198 bp, Glycine max
  Peptide Sequence Number=SeqID_107572
atgtctccttatcgggttgtttttgaaagggcatgtctttttccagtggaaattgagcacaaagcatactgggcagtgaagacttgcaatttctttatggatcaagcgggggaggaaaggaagttgcaactgaggtccagtggagatcaaaagggactccccaaacaagagcttcaaggtcaacagacatcgacttaa

SEQ ID NO: 15888 - DNA, 381 bp, Glycine max
  Peptide Sequence Number=SeqID_107573
atgtcaaccagtgatcatgccattctgcgtgatagaacccatcaacccaccaagaaaagcttgttagaactatcatcacatgacgctttattggcacagaataagttgttttctaagcaacttgagattttaacagaaacacttggttgtaccatctgtggtgaggctcatgaaacagggccattgaagaaaacacttaagaagttcactatatgggaaatcaacagcgacaagggtatactcaaaggaggattttcaggcttccagcagggtccttataatcaacaaggacagtggaggtcacactctagcaatcatttcaacaaagaccagggcagaccttcgaacaagccaatcaaacaagggcctaacatcttttag

SEQ ID NO: 15889 - DNA, 471 bp, Glycine max
  Peptide Sequence Number=SeqID_107574
atgaagatgctcttgataccacatgatgtagctccatgtgaagcttgtaggccttggatcttcttcatcaatagagtcatttgctttcttgaagatcgaatttcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15890 - DNA, 475 bp, Glycine max
  Peptide Sequence Number=SeqID_107575
gatcatgggttctccacctgcctcgcctcctcctcctcctcttcctccttctcctcctcctccgcctcctccttccgatgcattgcctttgccaccacctggtgctaagagaccaatggtccacgttgatcctgctaccggtaaggccaatggtccccacaggaagaaattaagaacatatttggggattgtggcgcatgataaggtggatgtcacctacgagaactggaaggaggtccctactgctcagaaggacttgatttgggaggatattcaggcttttgacagtaggacgaaaaggaagttacttcagactgtcggcgagagatggaggcagtttaaatcagacctcacgaggaaatgggcccttgcagccgatcaggatggtgtggacgacactgtctgtgaaaaatacggcataagcaaggaaaaatgggcccagttttgccagactcgcagagaaccttcttgggag

SEQ ID NO: 15891 - DNA, 389 bp, Glycine max
  Peptide Sequence Number=SeqID_107576
ggcgcgtcccattcgccattcaggctgcgcaactgttgggaagggcgatcggtgcgggcctcttcgctattacgccagctggcgaaagggggatgtgctgcaaggcgattaagttgggtaacgccagggtcttcccagtcacgacgttccccacgaattcattgcctagcgctgttcgtgtatcctccaccctcaaatcttatccagagccccatgaattgcttgtcattcatgcatcctccaccatcgagtctccagctgcacgatttgattgcctagcgctgttcgtctatccgccaccctcaaatcttatccggagccctatgaattgcttgtcattcatgcatcctccaccatcgagtcaggagccccacgaattgatagcctag

SEQ ID NO: 15892 - DNA, 258 bp, Glycine max
  Peptide Sequence Number=SeqID_107577
atgaattcatcatcatcatctgaaactaagaagcttgagggaaaattagatgctttggttaacctggtaacccaactggccttgaatcagaaatttgtacttgtcacaagagtctgtggtttatgctcctctgccaaccaccatacagacctttgcccttctatgcagcaatctggagcaatcgagcaacctgaagcttatgctgcaaacatttacaataaacctcctcaacctcagcagcaaaatcaaccacaatag

SEQ ID NO: 15893 - DNA, 552 bp, Glycine max
  Peptide Sequence Number=SeqID_107578
atggggacaaatcaaactggcaaaaggttttatcaagtcaagattaagggcctagatatcaccagcattaaggagttggggcggttgatgggacctctccaaatgcaagccttccgcaaggcgtacggaaagatcttagatttgaccatagcagagatatccatagaagccattgcatcactcacccaatactacgaccagcccttgagatgcttcacatttggagacttcgaattagtaccgaacgttgaagaatttgaggagattctaggatgtcctcttgggggaaggaaaccgtatcttttcttcgggtttcttccctccttgagcaaaattgcaattatggtcagggattcaacgagagaattggaccgcgtaaagcaaactcaaaatggcatagtgggcctaccacggaagtacttagaaggcaaggcgagggatatggcgaatcaagaggagtggagttccgtttatggatgtattagcattgctaatctttggggttgtactctttccaaatgtggatggtttggtcgacctagctgcaattga

SEQ ID NO: 15894 - DNA, 147 bp, Glycine max
  Peptide Sequence Number=SeqID_107579
atggtcgtcattttgcctaaggaaaatcttgtagtctggttttgtaccttgcataatagtgttttgaaaggacttgacgatactccacaacttaaatccaaggttggtgctaggtggattgttgttaaaacaaaaatgaagcactga

SEQ ID NO: 15895 - DNA, 543 bp, Glycine max
  Peptide Sequence Number=SeqID_107580
atgacattgctacttagcaacattctgcccagcgaccgcaatgccaatctcctcctgcaaaagtatcagttggtctgtgtcatcccgacatggggatcgcacccacaaagacacccagtggacctgaagaagtccaacagggccctggggtttccagctctggttacgggcctctgtcggccctacagggcgcccgttccccccaacaagttcatgtcgtcgtggcatagggattgtgcccgcaagacacctagtggacccgaagaaggccaacagggtcttggagttgccagctctaaatacgggtctctgtcagttctagggagtgcctgtcgcccccagaaaggtcatcaggcccccctaccaatcgagctttcatcaagaaagtactgcgcccccaggcaggcgcagggcgaaacaccacagcagcattgggatggccggtaccgggcaaatagacacaccgccaccacctctagagttcacctcatctcatccataaaaaggttagagcgttgcctacgacacatggccgacccatag

SEQ ID NO: 15896 - DNA, 227 bp, Glycine max
  Peptide Sequence Number=SeqID_107581
gttctatcaagtcaagtcaagagcctagggaccaccagtctaaaggagttagggcagttaatgggtcagtgatgcaagctccattggagcttttaggcctaggatcttcttcatcaatggattcctttgcttcttggaagatgaatggcagtggaatggagaaggaagagagagaggagacgccactacaaggagaagatgagtctagaagaagctcaccaccatag

SEQ ID NO: 15897 - DNA, 363 bp, Glycine max
  Peptide Sequence Number=SeqID_107582
atgggcgtgagatatgaggtccacatgtggggggaaaaagttgagccagtccaaggaccacaatattgggcccatacacagtatgcacaaccttttccaccacataaaaaggttcaaagagaaaggcctaagaaaaatagaaggagagatgtagatgaagacaatgtcataggacatagggcaaagaggaaactgtctgactttacatgtggaaggtgtggccaaaccaatcataacatcagaagctgtaaaaatattggagttcctattaggccaaagaaatatgttgcaccaccaactttaaatcaggatgacaacctactagctcaagatgagcaagctttgaatgaggctaaagtgtaa

SEQ ID NO: 15898 - DNA, 347 bp, Glycine max
  Peptide Sequence Number=SeqID_107583
atgaaaagcacgcatggtcttccttgtgcatgtgagctttctaggcatactgctggcagcatcccagtggagtcagtccatattttctggaggagacttttcttttcagaccaagggttatgtgaggccgaagtcagcatcaaggaagagattgagaccatatctaaaaggtttgacgaacttgatgtgtctggcaaagtaaatctgaagagtaaacttcgagaaattgaataccctgatcacaactctatgtgccctcctctgtcaaaggtcaacactaaaggtgcaccgaagaaaccgatgaaaagaagtcaaagatccacaaagtgtgatccgtgttactggga

SEQ ID NO: 15899 - DNA, 228 bp, Glycine max
  Peptide Sequence Number=SeqID_107584
atgaaagcaaaatgcaaccaaaggtggcttgggggagcaaacaccggttgctcgcccaggcgagctaacctgccatttttttttttgcgctatcatgagtacggccctctacgggtcggcgttcacttactcgaacccactcaagcggcgtttttcgcttgcccagcgtcgggaagggacgacgatctgtcagtcatgaccctagcctttatttacatccgtccctaa

SEQ ID NO: 15900 - DNA, 447 bp, Glycine max
  Peptide Sequence Number=SeqID_107585
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatgccaacgggcaggacgtcgatcgcgcccaccgttacgccgccgccctggaccaacactccacccacccggtggccaaagctgtggtagcagctgtcaaaggcaccattccagcgtgccccagcccgcgcaccctcgctggacgaggcgccagtatcaagcttatcgataccgtcgacctcgagggggggcccggtaccagcttttgttccctttag

SEQ ID NO: 15901 - DNA, 351 bp, Glycine max
  Peptide Sequence Number=SeqID_107586
cttgccgctgatcatcgacatggcgatggtcaccaccagaataccgccggcgatgcggaacgaatcgatagagatgccgaacatccgcaggatcccttcgcccaggaaaagcgacgtccacaaaatgatggcgaccgacaggttggcggtcaggttggttttattgcgccccgcttccgcctggtagctggtcatgctgataaacaccggcaagatgcccaccgggttgaccagcgcaaacagaccgacaaagaacttgataaagccggaaagatccaacagagattggcccacagatgctccgcattaatcgctataaaaaaggtgtgctgcctatgcgcgctaatgtaa

SEQ ID NO: 15902 - DNA, 171 bp, Glycine max
  Peptide Sequence Number=SeqID_107587
atggttaaagcacgtcaaaagggggtatggaaagggaaaagagggaggtggttgccgcccagctcgcccaggcgagctgggttgcttccaccagaaggcacagctttctgttggaacaccctggaaggtccaagtgggcctggttgctatttgcacacccctgtttactaa

SEQ ID NO: 15903 - DNA, 288 bp, Glycine max
  Peptide Sequence Number=SeqID_107588
atggatcagaggttcaacattcaattcgagcgtctcgatatattacgggactcaatcagacatccgaagcttcaacattcaagttcgagcgtctcgatatatgacggaactcaatcagacatccgagtaaaaagtcattgtcgtttgaatttgctctcagcttcaacattcaatttcgagcgtcccgatatattacgagactcaatcagacatccgagtaaaaagttattgtcgtttgaattgcctcagaggttcaacattcaatttcgagcgtcggggatcctctag

SEQ ID NO: 15904 - DNA, 345 bp, Glycine max
  Peptide Sequence Number=SeqID_107589
atggtggcacgggttatgctcaagcacggatttgagcccggaatgggtctaggcaaggacggcctcgggaatgccgacgtagtcgatattaggggaaatccgtccaaaaatggattggggtatgaacccgggatgccgaggaggaggaatgtgccgtcaaggctttgggcggatagggcatggcccggccgcattagccagtgctggaatgatgtccgaggaagagatggccgcagtaggagaggagttccctcaagacccgccaaatttcgtgcaaccatgccatcccgactcccaagtggggaactggcgcgtgataagccagtcagaggtctataccgctga

SEQ ID NO: 15905 - DNA, 759 bp, Glycine max
  Peptide Sequence Number=SeqID_107590
ctgaatgaagccataccaaacgacgagcgtgacaccacgatgcctgtagcaatggcaacaacgttgcgcaaactattaactggcgaactagttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggca

SEQ ID NO: 15906 - DNA, 175 bp, Glycine max
  Peptide Sequence Number=SeqID_107591
ggagaaaaaggaatcgcatgaagacagtacaagtggaagtttcaatctcttctccgtctctctgacatttgggaattctatcggagcagtcggaggaataactgaaggaatctcagggaaccgctatagaagctgctatcgtaggctgaagacacgtgagtccgctcagaggtaa

SEQ ID NO: 15907 - DNA, 177 bp, Glycine max
  Peptide Sequence Number=SeqID_107592
atggaactcacggattgcgcaaaaacacctccttttgatttccggtgcgtctcgggacttacatattgtgcaacaaagggtgccaagtatcttgaaatggccaatcaaaggttgcatgtcatcaagctgagtctccagtattgttttctcttgaggatcaagcacaactctctttga

SEQ ID NO: 15908 - DNA, 372 bp, Glycine max
  Peptide Sequence Number=SeqID_107593
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattggatcattgcttgacagagttgctagtcaatcaagtaatgttgggaaacaggcttga

SEQ ID NO: 15909 - DNA, 512 bp, Glycine max
  Peptide Sequence Number=SeqID_107594
atgctctctcaagggagatttgagtgggatgagggatgtaagatggttgttgcaactgacttagcatgggatgaatacattaaggtatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15910 - DNA, 138 bp, Glycine max
  Peptide Sequence Number=SeqID_107595
atgggtttgtcaggcttaaaggagcactcaaacccggtgacccccaaggcctacactccgaagagtccgtcagggcctctccctcctgattcaggtccaacccctaaaatcattttagcacacagacactgctcgtga

SEQ ID NO: 15911 - DNA, 717 bp, Glycine max
  Peptide Sequence Number=SeqID_107596
atggctacctcaccaaaagatactgcagctcctggttcaccctctgtaccatcatctccgcaccagggacaacctgaattcaatatccagcctatacaaatgattcctggttcagcccctgttcctgaaaaactggttcccaaacgacaacagggtgtgaagatttctgaaaaccctagccttgcaacaagtcctagggaagtagacccggagatggataagaagatccgcagtattgtgagtaacattctgaaaaatgcttctgtgcctgatgttgataaagatgttccaacatcctccaccccgaatgtttctgtgcctgatgttgataaagatgttccaacatcttccgctccaaatgctgaagccctcccttcacccagtgaagaggaatcaacagaagaagaggatcaagcctcagaggagacccctgcaccacgggcaccagaacctgctccaggtgacctcattgaccttgaagaggtagaatctgatgaggaacccattgccaacaagttggcacctggcattgcagaaagactacaaagcagaaagggaaaaacccccatcaagaggtctggacgaatcaaaactatggcccagaagaagagcactccaatcactcctaccacatccagaaggagcaaagttgcaatcccctccaagaagaggaaagaaatttcatcatctgattctgatgatgatgtcgaactagat

SEQ ID NO: 15912 - DNA, 171 bp, Glycine max
  Peptide Sequence Number=SeqID_107597
atgtttccggaagaagcttcttccggaagacttccggaagacaatggaattcttccggaagaagcttcttccggaagcacagaaggaggaaggtccggaatgaccacttccggaagaaggtcttccggaagtagtttccggaagaacttcttccggaattgggcttcgtaa

SEQ ID NO: 15913 - DNA, 931 bp, Glycine max
  Peptide Sequence Number=SeqID_107598
atgtccttcagaggactacacgtcctcgccttaagaggactacaccccctcgccttccgagggctacacgccctcgcctttagaggactactcgtcctcaccttcagaggactaccagtcctcaccttcagaggactacacgccttctccttcagaggactacatgtgctcgccttcaaaggactacatgtgctcgccttcaaaggactacacgtctttgccttcaaaaggctacacgccctcgccttcaaaggaggtctggacgccctcgccttcagaggtctaaacaccctcgccttcagaggactacacgtccttgccttcacagggctgcacgtcctcactttcagagggctccacatttgcgcctttagaggacttaagcaccaccagagggaggctatcgtgcagccaccatgcatactggggcaagatttcacccatgccactacaaagagacgagtgcagatcatgcgcaccaacatgaccactcttacacagatatggatgacgttgctacttagcaacattttgcccagtcaccacaatgctgatctccccctacggaagtatcagttgggatcgcgcccacaagacacccagtggacccggaggagcccaacagggccctggggtttccagctctggttacaggcctttgttagtcctacaggggatcgcgtccgtgagacacccagtggacccggagaagttcaacagggtcttggggtttctagctctgattacgggcctttgttagttctacggagtgcccgtcgcccccaacaaggcgcagtgcaagacaccacaacagcctggggatggccgacagcgggcaatagacgcactgccgccacctctagagtacaaaggatggagcatttcctacgacctgtggccgaccagcaggcgaccaagtccaaagccaaaa

SEQ ID NO: 15914 - DNA, 585 bp, Glycine max
  Peptide Sequence Number=SeqID_107599
atgactatgaagggccaagacatttatagtagtcaagatgatgctattacttcaccttcctctagtgaaagtgaagaaacaaaaatggaagaatctagtgaagaaatctacccccaagaagaaggacaacctttaatggttaaagaggagtgtaaggaggtaagtgtcccctccaagagattagctaagaaggaaattcattttgcaataaagacaaacattaaagaaacttcccctcttagacaacctccacatcttctcctttgtaaaaagacacttattagcattgccacacctcttaggcttgagattattcctcaagtaaatgagttgttggataggggtttggttcgtattacgaggcaccaaattcctatgataggtagtatgatgaatgtgttgagtggtgcaaccttcttttgtaaaatcacccatgcatccaacatcttcatgattcacatacatagggactcattaggtgttgaggaaaaaatcccagtgtttcaagaacctctggatttgaggtcaaatccttttcaagggggaagggatgatgcagtcttaccccccaagggcattggatag

SEQ ID NO: 15915 - DNA, 453 bp, Glycine max
  Peptide Sequence Number=SeqID_107600
atgtcattactcattatatcaactccaggtgaagaccatggcttctccttctactctttctccacctcctcctccttctcctcgtctgccatgaagcggacacgcaaagcctcacgtctacgatccttgtctactagaccacctggtgctgagagaccagtggtggacatcacgtacgagaactgggagaaggtccctactgctcagaaggacttgatttgggaggatattcaggcggaatttgaaatcccacaggcttctgacagtaggacgaaaaagaagttacttcagactgtcggcgagagatggagtcagtttaaatcagacctcacgaggaaatgggcccttgcagccgataaggacagtgtagacgacactgtctatgagaaatacagcataagcaagcaaaaatgggcccagttttgccagactcgcagagacccttcttgggag

SEQ ID NO: 15916 - DNA, 126 bp, Glycine max
  Peptide Sequence Number=SeqID_107601
atgaatgactcgggcatacttatgctatgcatggcaaatgtaattatgagattgagatgcccgaagaaacctcatttcctagttagccatgcattagaggaaaacgcaaggatcatgcatgagtaa

SEQ ID NO: 15917 - DNA, 144 bp, Glycine max
  Peptide Sequence Number=SeqID_107602
atgacatgcggagataccttatggttatccgcaccttttgtcaaccaaaggcaagttttactttcgtcatccagagacattcaagtccggcaacgcgcaagattcttctctgctaggcagggacgatcgagttcgatagcatga

SEQ ID NO: 15918 - DNA, 824 bp, Glycine max
  Peptide Sequence Number=SeqID_107603
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggacttcttcttagctcataggggtgcaaatgatacaattataattcaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 15919 - DNA, 516 bp, Glycine max
  Peptide Sequence Number=SeqID_107604
atggatgacgttgctattcagcaacattctgcccaacaagcacaatgccaatctccccctacagatgtatcagttgggatcgcacccacaagacaccctgtggacccgaagaagtccaacagggccctggggtttccagctctggttacgggcctctgtcagtcctacaggatgcccgttcccccagcgaggtcatgccatcgtgacataggaatcacacccacaaagacacccagtggacccggagaagtccaacagggccctgggggatcgcgcccgcaagacacccagtggacccgaagaagtccaacagggtcttggagtttccaagctctaattacgggcctctatcagttctacggagtgcttgtcgcccccagcaagatcatcaggccccctactaatcgagttttcatcaagaagtactgcgtccccaggcagttgcagggcgaaacaccacagcagcccggggatgggccggcagtggacaatagacgcaccgccgctcacctctag

SEQ ID NO: 15920 - DNA, 915 bp, Glycine max
  Peptide Sequence Number=SeqID_107605
cagggcagcgcctggctattgctgccggcggcagtgagcctgatgctgtttgtctggctgttgacgctgcatccggcggccagcgggcgggtctatgcggcctacggcggcgtgtatgtggcgacggcgctgctgtggctgcgggtggtggacggggtgaagctgtctgcgctggactgggtgggcgccggggtggcgctggaaacagggcgggagtcgcctcccgccgtcggagatcaggcgcctcggtggatgttcagcccggcgaaggactggctgaccggcatcatttccagcgtgttgatgttgacgcgcgccggcaacgtcgcgacccagaacaccgactcggcgatgtcttccggcgtcagcgcatcggcgccttcgtaggttttgttgaccttgccgtcatcgcccttgaagcgcacgttggagaattcggtgccgcccaccaggcccggctcgatatcggtcacgcggatgcgcgtgccgtgcagatcggcgcgcagccccaggctgaactgtttgacgaacgccttggtggcgccgtacacgttgccgccggcgtaaggccagttggcggcggtggagccgatgttgatcacatggccgacgttgcgctcgaccatggccggcagcagcgcgcgcgtcatgttcaccagccccttggcgttggtgtcgatcatggtttcccagtcatcggcgttggccttgtgcgccggctccagccccagcgccagcccggcgttgttcaccagcacgtcaatctggcgcagctcggccggcagtgcttcaatcgcctgttgaatggcggcgcgctcttcgagacgctcaaggcggcgcccggcggcgatcacctgatggccttcacggataaaacggcgtgcgattgcctcgccgaaaccggaggtggcgccg

SEQ ID NO: 15921 - DNA, 60 bp, Glycine max
  Peptide Sequence Number=SeqID_107606
tgttcactcaaaatttggtgaggcttttgctgcttcaaatccaatggtgctcctaggatg

SEQ ID NO: 15922 - DNA, 505 bp, Glycine max
  Peptide Sequence Number=SeqID_107607
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtgtcctgattaagaagagacaatccttcacattctccgtgattgccaaaaagctcaacaagtttggcatcttcttcatcatgctctacaaaggtgttgcaattccttcatcttcaataatgaagattggaaaaattagcgtcttctttttcaagtttttgggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 15923 - DNA, 674 bp, Glycine max
  misc_feature (20)..(20): n is a, c, g, or t
  Peptide Sequence Number=SeqID_107608
gggattcacctggggggcgnctgcattagtccacatgtacaaccatctgaatgacgcttcgcaggcctctacacggcagctgggcggttatattacacttctccagggctggatatacgagcactttcctatagtgcatacatccgtcattcattatgcttatgatgaggggagcccacgggcctgcaggtggcttacgggtaaggctcatattacggggatcaagggagccccatatcggagacgtttggatgccttgagtgtgactgacatgtgctggatgccctatgcgggttcttcgacagtttggctacctttaaacggtccctccgccgccggggagctctgtgtagttcctgaacaggtggcggcagactacatggagtggttttttcggatattgcacccattcgtcacgcggaccgaggagactgctgcgccgagacatccgcctccccttcatcataaggagttcgtcaagccacccatccccgaggtttcagtcgcgaccgatctccctacgcattcagtggttcactgcgtaggatgtcaggggatggctcaagatttaggagcgattgttgaggatttggagcgggtcatcaacctcaggatggtcactgagggcactgacttacatgacatcatgactcgttgtctgaggagagctagag

SEQ ID NO: 15924 - DNA, 531 bp, Glycine max
  Peptide Sequence Number=SeqID_107609
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 15925 - DNA, 482 bp, Glycine max
  Peptide Sequence Number=SeqID_107610
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccaggggtgagtcactgaagaacacaattacatggaaggtaggatgtggggacaagttcaagttttgggaggacagctggatggaaggggagataatgggtgggaatgggattttagatggaggaggccattatttgacaatgaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 15926 - DNA, 162 bp, Glycine max
  Peptide Sequence Number=SeqID_107611
atgaaaaacctcgtcgagcgcctaggagtacatggcgggacatccctcacaatggggagatcagtcagggtcactctgttttgcgagaatgctccaaccatatgggatcagcacaggcttaaagaagcactcaaaccgggtgtatttacccccaaggcctag

SEQ ID NO: 15927 - DNA, 309 bp, Glycine max
  Peptide Sequence Number=SeqID_107612
atggctatacagggcattgaaggggtaatcagtcagttgcaggcaacggcgatgacggcccgtaatcagaatgtggcagaacaacagccgaccatcagctttgcggggcaactgcatgccgctcttgaccgtatcagcgatacccagaccgcggcgcgtacccaggcggagaaattcaccctcggtgagccgggcgtggcgctgaatgatgtgatggccgatttgcagaaagccacggtttccctccagatggggattcaggtgcggaataaactggtgtcggcgtatcaggaagtgatgggcatgcag

SEQ ID NO: 15928 - DNA, 540 bp, Glycine max
  Peptide Sequence Number=SeqID_107613
atgccacccaccaggcaccctctagacccggataagtctaacaggtccctgaggtttccagcgttgatcacaagcctctgtcagtcattcggggttcccgttacacctagtaaggtgattcgaccgccgatcactcgggccttcattgagaagtattgcacacctaggcaggcgcagggtgatgcaccacaggccgcagacgcgccgccaccacctcatcaggctaatcctgctgggtcattagacatggagcgatatctacaacacttggttcgccagcaggcagccaaccaccgggggcaggtgcagatacatgagtgtctctaccagctcagcctcagtcagcaaggccagagtttcattccttttgggtgccctactccagatcagtttagggctgaggtcgcatggcccggagattggcccgaggcccaggcaagggaggcacctgcaaaggctatcggcaatgcagaggaggcccgcatggatgaggagatgacggatttgttcgatttcttgggagggagcggagccacatga

SEQ ID NO: 15929 - DNA, 185 bp, Glycine max
  Peptide Sequence Number=SeqID_107614
ggcgaggctcacgggtgcgttttccaaaggaggaaagatgcgtggagtcgccaccaacgtattagcacctctcacgtcgacaaaaagcggggcttttgctcctacgtaccctcatttggagaggaaaccagacctacgtagttctttcttaagagtgaatcaagcgattctttttactatgaaag

SEQ ID NO: 15930 - DNA, 836 bp, Glycine max
  Peptide Sequence Number=SeqID_107615
atggtgaaagttggaacctcttacgtgccgatcaacgtctcattttcgccaaaagttggcccagggcttcccggtatcaacagggacacccaggatttatttattctgcgaagtgatcttccgtcacaggtatttattcgggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgggctttcgtatgccgtagtttctataatgggtccacaaagtagtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 15931 - DNA, 441 bp, Glycine max
  Peptide Sequence Number=SeqID_107616
atggattggctcccgagtttgaggatcactaagggggtggaagttgaaactccagaagaagatgaagaggatgaattgagggtcttcctaaggtccaagaggagcttgtctcaacggttaagcgagaccgaaaccaacatgttagccatcatcaacaagtaccaagaagaattaaatctagccatggcccacgagcacaaagtagcggacgaatacgcccgagtgtacgcggaaaaggaggctagaggaagggtgattgactcgttgcatcaagaagaaacgatgtggatggtttgctcttactttgaacgggagtcaagagcttccccgattgctggcaaaggccaaagctatggcagacacctactccgcccccaaggagatccacgggctcctccgctattgtcagcacatgatagacttgatggcccatataattag

SEQ ID NO: 15932 - DNA, 411 bp, Glycine max
  Peptide Sequence Number=SeqID_107617
atggtgaaagttggaacctcttacgtgccgatcaacgtctcattttcgccaaaagttggcccagggcttcccggtgctccagtggcttctgttttctatcagctgtccctccctgttcagctactgacgggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 15933 - DNA, 144 bp, Glycine max
  Peptide Sequence Number=SeqID_107618
atgttcttggatggagaaaagaaatctcacgaagacaatacaagtggaggtttcaatcccttctccgtctctctgacgtttgggaactctatcagagcagtcggaggaaaaactggaggaatctcaggggaccgggatccttag

SEQ ID NO: 15934 - DNA, 435 bp, Glycine max
  Peptide Sequence Number=SeqID_107619
atggctgttaagaaagaacattgcaatttttcaatcttcaacttttgttcttgtgataatgtactaatggtaatcatatccatgctcttttggttccctgcagaggagaaagctggaattgaaactgtaccggtttttatctctgttgatcctgagagggatactgttgaacaagtgggtgaatatgtcaaagaatttcatccaaagttaattggattaactggtagcccagatgagatcaagaatgttgctcgtgcatatcgtgtttattacatgaagacagcagaggaagactcagattatcttgttgatcactccatagttatatacttgatgagtcctgaaatgaaatttgtaaagttttttggcaagaacaatgatgttgattcgcttgccgatggagttattaaagaggtaaagcagtataagaagtaa

SEQ ID NO: 15935 - DNA, 474 bp, Glycine max
  Peptide Sequence Number=SeqID_107620
atggaaggaattggaaaacatgatgcaggatgtcgtagctccaccagaggctttattctagaccttggtaaggtatatgctgtcaagtggaaggacgtactcgacagtatatggcatttggttgacaaagacgaaaattatcataacattgtgtacaaccaagatttgaaccaaccagtcattgtagcagggtggataacactgcgcaatttttaccagctcaccggtaatcatctagtatccttgcatcattatggttctgtgaccttcaaggtttatctcactgagcagaaagtttcctgtagtagtctggacgttccaagtgtcatgcattattttttgaaagacaaaggttggactcatttgcacttggaagatgttgcagaatgtcgactcgtgttcaatcattggaggaagacactaaaaattgaagccgatggaaacatttctacagaccttgtcgttcaccactga

SEQ ID NO: 15936 - DNA, 1866 bp, Glycine max
  Peptide Sequence Number=SeqID_107621
atgtttgccaagaggttgttgcacaaggctgtgctgcaccattccaaccataagttgcagcatggcggtttgcagggaaatgagttggatcccagaattgtgattcactatggcattccatcgactgcttcagttctcgcctttgaccccattcagcgacttttggctattgggactttggatggaagacttaaggtgatagggggagataatatagaaggacttttggtttctcctaagcaattgccttacaaatacttggagttcctgcaaaaccaggggcatttagttggtgtcttaaatgacaatgatatccaggtttggaatcttgagagccggagccttgtttgttctttacaatgggagttcgatattactgctttttctgtaatcagcggttcacatttcatttatgttggagaccagcatggcttattttctgtgataaaatttgaagctgaggaaggacaacttttgaagtcatcatacaatttgtctgcaaaatttctaagggaagctgcaggcttttcagaacccagtgagcaaccaatcattggagttcttttgcaaccttcttcttttgggaacaggcaagatataactagaattgtgttccttggtggtggaaaagatctccaattgaaggatgaagatggtaactcttcttccgaatcgggcgccaatcctccagctgatattgtagaacaaaatctaggtgacaaagagataactgctctttgctgggcatcttctactgggtccattcttgctgtgggatacttagatggagatatccttctctggaacttgtcatcagcagcaccttctaaaggccaacaaacttcaaaaaatgttgttaagctacaactttcaactgaagaaagaagactcccagtcatagtcttacaatggtcaaatagccataaatcccaaagtgatagtgctggacagttgtttgtctatggtggcgatgaaattggatctgaagaagttttgactggatttcaggttttaactcttgaatggtcatctgggatggagtccgtaaaatgcaccaatcgtgcagaccttacacttaatggctcttttgcagacttgattttactgccaagtcctggaacaatggggttgagcagcaaagatgaactttttgtactgacaaaccctggacaactacatttgtatgataatgatagtctgtccacattaacatctcagccaaagaggacgccatctgtttctgctgtggagtttccagtgctagtacctattgctgatccatgtttgactgttgcaatacttatcaggttgcccagtaagtcaaattcatcaaaaattctcactgaggtagcctcagcaatgagaactggctcaaggcctggatcagctccttcaaattggcccttgactgggggtgttcccagtctatcatccacggctaaaggtgctgtggttgagagagtttattttgtgggttattctaatggatctgtccttgtgtgtgatgccacacatgcagtcttatcttatatttgctacatagagggagaagtgaatggtataaaagtggctggttcagatgctcaagtgacaaaattggacttctgctctgtttccttactgttggctgtgggcaatgaatgtggtcttgttcgcatttatgacctcaaaggccactctggtggacgaaatttccattttgtcacagaaacaaaaagtgaagtccttgatgctccacaaggaaaaggaccttattgtagctctgtcttttctgttctggattctcctgtgcaagcattatcatttgcaaattctggaaccaaacttgctattgggtttttaagtggccgtgtgggtatcatctga

SEQ ID NO: 15937 - DNA, 1299 bp, Glycine max
  Peptide Sequence Number=SeqID_107622
atgtcggacgatgaaagggaggagaaagagttggatctctcttctgccgaagttgtcaccaaatacaaaaccgctgctgagatcgttaacaaggccttgaagctagttatttcagaatgtaaaccaaaggcgaagattgtggatatttgtgagaaaggggattcatacattagagagcaaactggaaatgtgtacaagaatgtgaagaggaagattgagagaggtgttgctttcccaacatgtttatcaatcaacaacgttgtctgccatttctctccactagccagtgatgaggccgtgttggaagaaggtgatatattgaaaattgatatggcatgccatatagatgggttcattgctgtggtagctcacacccatgttcttcaggaaggtcctgttactggaagggcagctgatgtcattgctgctgctaatactgctgctgaggtggccttgaggcttgtcaggccgggaaagaagcatatgcgatggcaactttgccgaggtgatcagtaccatattggtttcctcttttccctgttgccgatactagaattggctgaaaataatttcatggttgtgctgatatatacaaacaaggatgtaagtgatgcaattcaaaaggttgctgctgcctatgactgtaaaattgttgagggtgttcttagccaccaaatgaagcagtttgttattgatgggaataaagttgtgcttagtttgtctaatccagacacaagggttgacgaagcagagtttgaggagaacgaagtttatgcaattgatatagtaacaagcactggggatggcaagcctaagctgttggatgagaagcagacaactatttataagagggctgttgacaagagttatcacttgaagatgaaagcgtctaggttcattttcagtgaaataagccaaaaatttccaatcatgccattctctgctagggctttggaagagaaaagagctcgacttggtttggtggaatgcgtcaaccatgagctcttgcagccatatcctgttttgcatgaaaagcctggtgattttgttgcacatatcaaattcacagtcttgttgatgccaaatggatcggatcgaatcacaactcatccactccaagaattgcagcccacaaaaacaatagatgatcctgatattaaggcctggctagccttgggcacaaagacaaagaagaaaggtggtggaaagaagaaaaaaggtaagaaaggggagaaggcagatgagtcagctgaagctgagcctatggactcaacaaacgaggccactcctcaagagtga

SEQ ID NO: 15938 - DNA, 438 bp, Glycine max
  Peptide Sequence Number=SeqID_107623
atggcgctttcggcttccgacgtggcagcgatgtactcgctgctttcgaattccatgagcgccgatcaccgcctccgcggtccggcggaggacgcgcttgcgcaatcggagtccaggcctggcttctgctcctgcctcctcgaagtgattaccgcgaaggatttggcgtcgcaaacggatgtgcgcatgatggccaccgtctatttcaagaacagcgtcaaccgctactggcgccaccgccgcgattcctcgggaattagcaatgaagagaaaatgcacctgaggcagaagttgttgatgtactcgagagaagagaatgatcagatagctctgatgctggcggtgctcatctccaaaatcgctcgcattgattatcccaaagaatggtactttttggcatttatttctttggttttcaagaatatttacagtgtctaa

SEQ ID NO: 15939 - DNA, 498 bp, Glycine max
  Peptide Sequence Number=SeqID_107624
atgaaagaaaggattgagagatttttctccactgaatccttgaggtggattctgaggattccgctccgattaaaatgttcctctcgatgtggtggttcggtggcaggcaacgacggctcgtggtggccaccggtggtcgtgggtggtgaagggggagtagaaatgcccaatagtgtgaatttaatgtgtttcaacttcaatttcagtgcgtcatcagctcgcttagcgaggtgtttatctcttcctgtgctaagcgcgcccagcttgcttagtggatattcactaactcgcgctaagcgcgaaaatggcgctaagcgagccttcaaggacagaaagccctttttaaggctgcagttggaaaaatcgagcaagtcgtctagaattaggctaattcagagtgtagagagcagaacagaggcaaaaaacagagcaaggaagccaaaaacctcaactttcaagaggatcttaggtttaggagtaatttctaggttcctatag

SEQ ID NO: 15940 - DNA, 342 bp, Glycine max
  Peptide Sequence Number=SeqID_107625
atggcccccagtttcaccagcactggttgtgaaaccagcatagtctactctgaacgctgctctcctgctctgaacacctacgcgtcctctgcacctaaatcgctagtcaaagtggcgaaaatcactatgtcagctatttcgccagtgacactggcggaacagtcacatatccagtcccaagcgtatatgcatggcgatatacgtgcatgcatggctggggctacgtatcctcaagaccttccaaaacatcaaccgagggtgacaaaaggcacggcggaatacgggtttggtgttttgatggtggctgttatgtgggaggcactgagtgtttggtggttttga

SEQ ID NO: 15941 - DNA, 213 bp, Glycine max
  Peptide Sequence Number=SeqID_107626
atggctagcggcacagcgtaccccgcaggtggagcagggtggccctcgatggggaggctaccatgtggaagagactcacacttgagggggagatgtgttgggtcacaagtgtacccctcgaatctccccaacaattggtatcagagccgatggttcaagttggtgactggctcagacgagtatgcaagtaccgcaggtggccataaaggctag

SEQ ID NO: 15942 - DNA, 495 bp, Glycine max
  Peptide Sequence Number=SeqID_107627
atggcggcaccagaagcatcagtttctaagcaaaagggaatatcaaaatccagcggatggggccgccaattgggcatagccgcgaatgaagcgcctataaaaccctgtcaacccaaggaagccgcggaggtagaaggagctctatgtgagggtgttgaagactgcttccaggtgttgaatgtggtctgcccaagaattattgtagaccaatatatcgtcgaagaagactgcaatgaatttgcacaggaatggtctgagcaattcgttcatcgtggcctggaaggtggccggcgcgttgcagagcccaaagggcatcacgcagtactcataatggccggtgtgggtgcgaaaggctattttggggatgtcttcttcggccatcctgatttgatggaatcactggccattgagcgtgcgataatccacgcagcagcgccagctaccgtccttcttcttcacaaggagcacaggagaggaataagggttgtgacttaa

SEQ ID NO: 15943 - DNA, 183 bp, Glycine max
  Peptide Sequence Number=SeqID_107628
gtatctgtcttagaagtgtctgtggatggagggaccagggtttctgacaaagagtttttgatgtccacagagttgcttatgaggcaattgctgaaactggatggtattgaggctgaaggtggtgaagtaaagctgcagagaaaagctgaggtagtgtttatggtgttagagcttctaacttaa

SEQ ID NO: 15944 - DNA, 513 bp, Glycine max
  Peptide Sequence Number=SeqID_107629
atgtggagaagagtagctaacctcgaaggtggcactgctaatttcattgaaactgaacaatttcttgaaaatgaagaattcaagttctcatttttgcagcatggtgaagaaggtcaattaagtgcagcatatgctgctgaaatgcaaaatcagcaacatgtgagcttaagcagtttcattgtgcttgatatgaatatgattattgtgtgtacaacggattatggtagatatgtgccttttgattttcatcaccactatgggagctcaaactttgataatatgaaaatcctctatgatcaaatctcagaggattttgaaaaacagagatacttcttgatagatagacaaggaaatatactagaggagcagagaggacttgtcagattaaactacattgattcccttgatcgaacaaatgttactcagcgttatctggcccagaagtcattaaatattcagttgcagaggattgaagtgctgacttcctctgagtgcatttctatgtttgcatag

SEQ ID NO: 15945 - DNA, 246 bp, Glycine max
  Peptide Sequence Number=SeqID_107630
atgcatgttcctgagtcttttgaaaccagagctgagtcaaacaagccagtgattagaattaattgtccaagatgcacttttaggatgcagaaaaatcaccgagacactttcatcacaaaggaagaggttgaccctgattcagctcagaaatttcttggtcatactaagtggcttgtaaactactggcttttgcagaatgcttttagcattggaattggagacgcaattgctgatgcttttacttag

SEQ ID NO: 15946 - DNA, 300 bp, Glycine max
  Peptide Sequence Number=SeqID_107631
atggcttctatgtgtccatatgttgacaaggttaaaaccaaatgttcgcaaaagggacgtgcgagcattgtagatgtaagatcagatggtcattgtgggtattgggaagttgcagctttacttggtataggtaaaggttcttggcctctagtccataacaatttgcataaagagttgggactatggcatgacgagtgtgcaaatatctttggaggatatggttgcttctatcaaataaagcaatctttactcattgatcatgtctcaatggttggtgttttattacgtagagatgattga

SEQ ID NO: 15947 - DNA, 459 bp, Glycine max
  Peptide Sequence Number=SeqID_107632
atggagacctggatcttctacaaagagaactggaggaagaacttgagaaagaacgctgctttccagcatggtataacttaccatctatctctcgtcaacacagccatcggtgatgagtttaatgatctagaacagcaatggatttctgtccaagagcaaaagaagaccatacagacaattgagaaaaataagcagaggacacagatggtactttcaatgtatgcttctgtcacaaatattgtgcctaacttggatgaacagtccaaaatttcaggctgtatccttttgatgaatttactattctctgtcccctcatctgtttcttctgatattgtggaaaaggataaaaacgctgttgagaagtttgaatatgacacctcaaatatgactgcccttgatatatgtaatgttttgagtggcaaattagcgatcctgcaattcagttacatattggtgtaa

SEQ ID NO: 15948 - DNA, 1353 bp, Glycine max
  Peptide Sequence Number=SeqID_107633
atggagtttgcggaggatggtgtcgacgaagacgcgcgtgtcctcggtggtgttgccgggggggacgtcaacgacgtaggactcgacgacgacggtgccggcggcggagcgggggtgaagagtggtgacagagcggtagttgaagaggcggtggtcgccgccgaccatgctgaagccgataacgtggcgctcgtcgtcgaggacgtcgaggcgctcggtgctgacggcggcggggaggccggagatgacgtggacctcgcggagggtcccgacgtcgccgtcgccgaggatgacgtggcagctcttgacgaagtgcttgtaggcctgcgggttgtcgaagcgccgcacgacggaccagacggtggagaccggggcggcgatctcctggaccacggcggagcagcactgctgcggggacaccacgtgggtgtggtgccgggccaccgcgtcgggaacaatagtggaaggattgttggcataaagcttttttacattgaggaacttgaagagcagatgaagaaacttcatgaagatcgtgcatcagccatttttgaaagaagaaccactaacaatgatgatgaaatgattgaggtggaagcagctataaaagctgcaatgtcagttttagacaagaaaggtaacaatatggaggctgccaaatctgctgctcaggaagcatttgctgctgtaagaaaacaaaaagatctgccagtgaagttagatgaatttggtagagatttaaatattgagaaacagatgcaaatgaaagtgagggctgaggctcgtcaacgcaagaggtcacaagcatttaattctaataagctggcatacatggaactggatgatcctaaaatagagggtgaatcaaacactgatgagagtgatagtgagagtcaagcatatcagtcacagcgtgatttggtgcagcgggctgctgatgagattttcagtgaagcttctgaggaatatggccaattatcctttgtcaaaagaagaatggaagaatggaaaagagagtattcatcaagctataaagatgcttatatgtcattgaatcttccactggttttctctccatatgtaagattggaacttctgaggtgggacccacttcacaagggtctagattttcaagagatgaaatggtataaattattgttcacttatggtttgcctgaagatggaaaagattttgttcaagatgatggagatgctgaccttgaacttgtcccgaacttggtggcaaaggttgcacttcctattctgcactacgaaatttcccattgctgggacatgcttggtcaacaggaaacagtgaatgctattgctgctacaaaattgattgtgcaacaa

SEQ ID NO: 15949 - DNA, 159 bp, Glycine max
  Peptide Sequence Number=SeqID_107634
atggcttccaatttccaagcattcttgaacaacccagttggtccaaaaacaacacatttttggggacctattgccaattggggatttgttgctgctggtttgatggacatgatgaaaaaacctcccaaaatgatctctggcaacatgacagcaggttga

SEQ ID NO: 15950 - DNA, 1302 bp, Glycine max
  Peptide Sequence Number=SeqID_107635
atgaagcttcaaaaaggaggaagagatggtgcagcgggaagaggaacgatggaagaagccaaaataaaaatggcaaagacataccaaatagtgctagcagggagttcttggggagttagaaacacctttcattctcttgtagccatcttaaccactcttgtagttatcactaccatttatctaagacaggatggaggacatgtatctccaaaaataaatgcctctagtagtaattcgtcatcatcatcaaagtgtgacttgttctctggtaagtgggtttttgataacgaatcttatccattatacaaagagaaggagtgcacgttcatgtcagatcaattggcttgtgagaagtttggaaggaaggacctgagttaccagaactggaggtggcagcctcaccactgtaatcttcccaggttcaatgccacagcgttgcttgaaaggctaaggaacaggaggcttgtgttcgtgggggattcactcaacagaggccaatgggcttccatggtttgcctagttgactctatactgcccaaaaccctcaaatccatgcattccactgccaatggttctctaaacattttcaaggccaaagactacaatgcaactattgagcactattggtctccattgctagtagaatcaaactcagatgacccagtgaaccatagggtaccagaacgaacagtgagagtgaaggctattgaaaagcatgccaggtactggactgatgcagactttctggttttcaacacttatctctggtggagaaggcctgtaatgaatgttctgtggggatcatttggagacccagatggagtctacaaaggggttgaaatgttgagagtctatgaaatggccctgagaacctggtccgattggttggaagtacatgtcaatcggaacaagacccatttgtttttcgttagcatgtcacccactcatgaaagggctgaggaatggagagcagctaagggtaacaattgttacagcgaaacagatatgatagcagaagaaggctattgggggaagggatctgatcctaagatgatgcatgtggtggagaatgtgattgatgatttgaaagccagaggcttgaatgttcaaatgctcaacatcactcagctctcagaatacagaaaagaaggacacccttctatctacaggaagcagtgggatgctctaacccaagaacagatagcaaacccaaatagctatgcagattgcatacattggtgtctccctggtgtgcctgatgtttggaatgaacttctttatgcctatattttccatcaataa

SEQ ID NO: 15951 - DNA, 1851 bp, Glycine max
  Peptide Sequence Number=SeqID_107636
atgaagactaataacaacgtttctggggagaggaaatcgcggaagagacgcaacggtggaagtgattatgtggaagacacacttgaaaagtggaaggagtacaacaggcagcaacaacttggctctagagaaaatggggtggaagtgattcacaaagctcccgcaaaagggtcgagaaaagggtgcatgagaggaaagggagggcctcagaactccgattgcaagttcagaggtgtgaggcagaggatttggggtaaatgggttgctgagattcgcgaacctatcaatggcaagcttgttggtgagaaagcaaataggctttggcttggtactttctccactgcacttgaggctgctcttgcttatgatgaagcggctaaggccttgtatggcccttgtgcccgtttgaatttttccgagtcaatagactctaatggatcatcatcttctagtggaagtgataaaaaatcaccaagtggtttttcagagaatggttgtgatgttgcaaaagctgaggaattggaggtgaaccgtcatcggtgtcatgaagagaaaccaagattttctaaggttggtgtctttgaggagacagaagagaaaccgattctttctggaggttgtgtggctgatgactcaatagaggagttgaaggaaatcacaactggctttgaacagtgtcaaacaagtgaagaatgtatggcaacaactttgaaaaatgttaagtctgaagtaccaggagaaagtgaagaaatggagagagaattggaggaggttgtgaaaaactctggcataggtggagaggttaatcacttgcggaaggagcctatggatatagccatgaatgcaagaggtaactattgtagctctcctggctcttctgatgctgctactgaacatgagattttgctcaagagtgaagaaacaagaggagaatcagttgaaactttgaactcttgtgagttgagctgcagcaaccattgccttggatttatgcataataatatgctgccagataccaatctaagaccaaatcctgaggcatctattgcaaagaaacatactgaggaagtaatttctgaaatcctaggactatgtcaaggcaagtgcttgaagattagccatggtcagtcaccaaatgagcaatttagaagaagtgaacattttgatgagatgaaaactaggcttaagggtttggaatgcaagctgagagcacattctattcattacaagaatcaagcaccaatagtaggggactccaatcatccttctatgcagggaattcatctgtttggtggtggcactgttggaccaattgaaagtatgtcccaagttgaggctttgaacaacatcaacacaaacagaaattcactacctggatttagttctggccatggtaggaagttgtgtgatctttctcaacagctgcacaaacttggtggataccttcctgagcattggaatagtgtgcagtttccagacttggaagttggtcatgattatagtttcttaaatcctgattatgattttggtttatatgaagagcagaaacccaattctgcacaggctaatactttcaaacaaaaggatttcagtttggagttggtactcatgacttggccactcagacccacttctgcacaggctaatactttcaaacaaaaggatttcagtttggagttggtactcatgacttggccactcagacccacttctgcacaggctaatactttcaaacaaaaggatttcagtttggagttggtactcataacttggccactcagacccacttctgcacaggctgagtgtctgactcttaaagtcaatccaagtcaactagggagtggcatataa

SEQ ID NO: 15952 - DNA, 219 bp, Glycine max
  Peptide Sequence Number=SeqID_107637
atggccgaagaattcgtgaagggctctgttcatcaaaatggcgtcgctgtcataacccttgatcgccccaaagcttggtatctaattttttttcaaccttccttttctttgcgagcattttccattatggccgaagaatttgtggagggctctgttcatcaaaacaatgttgctgtcatgaccctcgatcgccccaaaggctgcattaggtgctcctga

SEQ ID NO: 15953 - DNA, 108 bp, Glycine max
  Peptide Sequence Number=SeqID_107638
atggccggtggtgcaaatttcgtgcaaagggttctctcttacgtggtgaatgaagtggttatcaatggtcttgccaacaggcaaaacttagtgatctccacggcttga

SEQ ID NO: 15954 - DNA, 1293 bp, Glycine max
  Peptide Sequence Number=SeqID_107639
atggttagaacacgaggtttaggtcgtggcttaggaactggtagaggcagagacatgagtcaggatgcacataagcctgaagttcctcgacgtcgtaggcctactgcttcagatgttcctcatgtgtctgacgctactccagagatgacaagcatcgtcgatgctgtggacgcagagggagtggctagtgatggtagcttgggttcacttgctgctgatgagggattccctggtgggccacgcgacccatcggttttgactgcgcctgagatagaaggcatgattgcagccaccgaattgagtccactgatcaggtgttctataatcaccactgatcctggacttatatccgccttcgtcgagaggtggcatagggagaccaacaccttccacctgccagtaggagagttgacgatcactcttgatgacatttcgtcactcctacaccttcccatcactaaagcgctgcatgcctttgagccgctggttacttttgacacggtgaggcttttgacggagctgcttgaggtcacccttaaggaggctacagctgagacccgtcaagctggtgggcctcatgctttcagggacctggcccaggcagggggattctcttggggagtggctgcattggtccacttgtacgagcatctgaatgaggcatcgcagacccctacacggcagatggtcggttacattacactacttcagtgctggatatacaagcactttctggcggtgcatcagtacgtcgttgatgatgcttatgctaaggcaagcccacgtgcctccaggtggcttacgggtaaggctcatatgacagggatcaagggagccccataccgggcacgcgagctcagatggggtcagattgtcgtctacgttcgactagagcggaccgtcccttctcctcctgttcgtgattcattgacgggtcctgatatagatgaccgatggctgcacttttcagaccatctagtgcccacgggggagatctgtgtagttcctggccaggacggcgctgagccgagacatccacctaccccacatgatgaggagttcgtcgagccacctatcccggaggttccagttgcgtccgatctccctacgcattcagtggttaattgccaaggatgtcaagcattcgttgaggatttggagcgggtcatcaacctaaggatggtcactgaaggcactgacttatatgacatcatgactcattgcctgaggatagctagaggtgatgccgcaaatggaagtcttaggtcgcgacaaagacgacgcatagactag

SEQ ID NO: 15955 - DNA, 99 bp, Glycine max
  Peptide Sequence Number=SeqID_107640
atgggaaagggtgaatggcattttcgccctttcacccgaattgctgggtgccccaacaaaaaatgctggtgccccaagcaatacccgacggtgaaatag

SEQ ID NO: 15956 - DNA, 264 bp, Glycine max
  Peptide Sequence Number=SeqID_107641
atgccggttctcaccctttctactaacgttagccttaatgatttagacgcctcttcgatactctcccaagtaatctccaccgtcgccagcatcatgcgcacacctgagcctccagctgcctatggtgaactggtgtccatgggtgctcttaacccagaattgaacaaaaaactgagtgctggaattgcctgcgttcttgaaaccaagttgttgggctataattgtgcattgaacgggtctatcatggtagtcgagtccaaatga

SEQ ID NO: 15957 - DNA, 602 bp, Glycine max
  Peptide Sequence Number=SeqID_107642
atgtcgaagaactgggtcttgaaaaagcataacaagactttccttgattggtttaaagatataatctttgctgatgaaaatgcctctaaaacattaagaaagctagctgatgtgcctaaaagaaatgcaacaccgatgattgtgcggaccgatgacgtgttgtctcgtgaggattatgaatatttagaaaagaagttgatggatgagaagagaaagaaaaaacaagaggaagctgctcaatccggaagcactgaggtcatgattgatcctccatctcccatcagacgacacgtgaagtggaagatggcccgcaccaaaaaaattggccatatgacgtctgaggtaacaaaggaaattgctgagaggattgattcgttggaggagcatgcatcacagggttcgtttgtccctcatggacatcaggatgtcctgactgctgccattgggcaaccagaacacgctggtcatgtgtgtgctgttggagtcggtgtgaccatcaagcaatactttggaccggctcaacgaaccgcccgcagcacttcttccatcgctcccgaagaactagtgcagttgactcaacaaatcaaggaccagctggagga

SEQ ID NO: 15958 - DNA, 390 bp, Glycine max
  Peptide Sequence Number=SeqID_107643
atgccgttagcggggttaaactgccccgttaagacacgtgccacggagagggagccacatgccgcggaggccacgagggagttgaagccggagaacacgttggggatgagagggaaaccagtgtcgttttccattgtgtatttgcagctttttgagtggtggtggtggaggtttaggaatttttggccagagcttgtgcctaatttgcagtctgctattccgatgatagtgaccacgcctgagaaatgggatgccattacacgcaagagcagtgacatgtcattgtccatggtggtaaagctcttaattattgatgaagtccatctactcaatgatgataaagctctagttgccaggaccctacggcagacattggcttatgacagctag

SEQ ID NO: 15959 - DNA, 204 bp, Glycine max
  Peptide Sequence Number=SeqID_107644
atggcaggagaatggagaagaagagttgagaggagacgccacttcaaggagaagatgagtcaagaagaagctcaccaccataggaagccatggataagagcttggagcccactaatccaagatcaagtccaagattctccactaagtgtgcttaggttgaggcatgtaaagcatgaaggacatgcacaaagtgtgactatatga

SEQ ID NO: 15960 - DNA, 561 bp, Glycine max
  Peptide Sequence Number=SeqID_107645
atggtcatattgaagtcatcagtaccaatatcatttgagggtaacaaggaaccagcagcatatgctgagatagtttcaatgggtggcataaatacagaagtgaagaggaagctgattgctaccattggaaccattttgcagtccaacctgtctatcccaagaacacgatttttcctcaaagtctttgatgtgagaggacgtttattggtatgcaataggaatcccatcagtgcgagttcagggctcaggccaaggtgccacccactgtggatggtcgttcttttggaggatttcttgggctgcggcggggataaaggctattgctacattgactcaacccaagccatatttgtgtcattcaaatcctcacccaacaccaccatcaacaataacaaccatttcacatggagaaggtctccaacgttggaatcgtttttagcccctgttgacttaagcgattttgctttggttcataccctcatctccgttgccaacgagattgtgtcgtgttttttgaagtgtgttgatgaattggcaagtgcaccaatgcgtcccaagtag

SEQ ID NO: 15961 - DNA, 138 bp, Glycine max
  Peptide Sequence Number=SeqID_107646
atgagatgtactgccaaaaagccttactctaggtccattgttggtgcttggaaggaaattaagaagaggattaagaaaacaaaggatgagaagaagactaagaaaccaaatactgatatgaggatttttgtttgttga

SEQ ID NO: 15962 - DNA, 1128 bp, Glycine max
  Peptide Sequence Number=SeqID_107647
atggttcctttggtgggggcgcggaagaaaacacaaacttctcagttcagtgtgactcaaactttctctccaaattcatcatgtggccgaaatttgagaaagaaccaacttggtggcatcatcttcggatgcaagaatgccacaatgaaagaatgtctatctaaacaactgtttggcttaccagctcatcacttctgttatgtgaagaatattgatccagggttgcctctgtttctgttcaattatactgacaggaaacttcatggaatttttgaggcagccagcagtgggagaatgtttatagacccctatggatggactacagatggttcagagagaacacagtatcctgcgcaggtgcaaatttgtgtccgactaaagtgccacccattgcctgaagataaattcaaagaagtaattgcagacaactactacactcataatcgtttctattttgagctagaccatgcacaaacaagcaaacttatttccttactatcagctggagcaattgcctctgataattctgccccacagaatacacagaagtggataactgtatcacgacctcttgcatcaaatgaaactttgagggaaggtgaaacatctaaaatgcttgaattagagacagagcattctactcactcaagtacaagatcatattggattgaaaatgacttttcttttgacggatacatccggccattagatactaatgaagttgagaaggaagtaaacgaggatgagcagaacagcatatttatgaaactgaaggagttaacacttgacagtgaaagtcaagatttatccttggcaaacaatgccaatgatactcctggtatgaataacacagaagagggttatatggaggcgttggatggtttagatgagaaggaacagacttctaatcctccatttgattatcaatataacatagcccagtgtattttagttggtgcaagaggtcaaagaattgacaaatttccagaaaatacaaacggagaggaattgctacctggagcagaagctgttccatcaattggtatcaaagctttccaccatgtcttgcagctgcaaacaagtggcgcaagtggtgacactgtcattgcagtgtttgcctcagattag

SEQ ID NO: 15963 - DNA, 426 bp, Glycine max
  Peptide Sequence Number=SeqID_107648
atgaaggacaagtatattgttcaaagcttgttaaagaacttagaaaaaatcaagaacaagcttgttcgcacatcgttcgcatgtatgacatccactccacaagcttgtggttacgtgagcctgaactactaccaatatatagatgttgtttacacaaatgaacacatcttaaaagcttactccgcacattggtggcctcttgggaatgaagcggctattcctccttctaatgacgcatggacacttatccctgacccaactacaattcgtgcgaaaggtcagccaaaatcaacaaggataaggaatcagatggattgggtcgaaccatctgagcaccgacaaaaatgcagtagatgtggagccgaagggcataacaagcgttgttgtccaatgcaatctgagcgtgggagttgttcaaatcattga

SEQ ID NO: 15964 - DNA, 858 bp, Glycine max
  Peptide Sequence Number=SeqID_107649
atggctcaaaaaaagcttctctctaagagggcaaggaaggacgctgcgggagaaggatccaagagacgggtccaactgagagagggggaatacacggagttccaggaggaagttgccaggaggcaatggactcaactcacagggcccgtggttaaatatgacccagaaatagtcatggaattctacgcgaatgcatggcccatggaggaaggagtcagggataagcgctcctgggtgcggggcgaatgggtcccctatgatgatgatgccattaaccagttcttggggcatccgttggtcttggaggaaaggcagcattgcgagttcagtgaaaggaggagccatgcttcgggatttgatgaggaggccataggccagctggatcacgcctccaagacacccagtggaccagaaaagtccaacagagcactggggttcccggccttgatcacaggtctctgccaattctatggggtgtcggtcacacccacaaagctcatctggcctctcattaataggtccttcattgaaaagtactgcatgccaaggcaggcacaacaaccagggcaggaccagcagcagcagctagccatagatgcaccaccgccacctctacagcagccaccatctctagagtccatctcagctcacatcttttatcagtataccctgcatcaacagcaccagaaccccagtccttacccaaggcctactctcgagcagttcagggccacagttgcatggcctgaaggtaggcccaattttcaggcaggggtagggcccacagaggccccaagagatgaagatggagctcaagaagtcgatgacatggccgatgtgatggacttcttcctttga

SEQ ID NO: 15965 - DNA, 183 bp, Glycine max
  Peptide Sequence Number=SeqID_107650
atggttggcagctgtggtaatggggtgggagagaaaaatgtactggttggccctgcatttcagaggtttgcagtgaggacatcaaaaagaattgaagatatttctaacaaagctgttcagaagaggcaggagctagctgagcagatcaaggacatctcgaaaaatatggaggttgtatgctga

SEQ ID NO: 15966 - DNA, 282 bp, Glycine max
  Peptide Sequence Number=SeqID_107651
atgagggggtttagtggatttgcagctcgcccaggcgagttgttgcttcaacctgaagtaaccatgcttgcccaggcaagctcagcttgcccaggcaagctgaaagagaaagggagtaagggacgcgaaagcaattgcgcaacgcgagagtggaatgtggcgagcatgcaacgatgcaatgagcaacatggtcctggcacgatgggcacgcagtgccgcgaggagttgagtgatagtgagagagcgaaagtgagaatcacagaggaagaacgagagttgtag

SEQ ID NO: 15967 - DNA, 1323 bp, Glycine max
  Peptide Sequence Number=SeqID_107652
atgggaggctgttgcagccacgatgtttcggttcgagggaaggtggagagcgagatgggtgatagagaatatgagtatgaacatgagaatgatgtgtcttttgaacaaggtggagcattggtaaggttaagaggttcctctaggtttgtatcaatgtacgcacaacagggtcagaaaggtgtgaaccaagatgcaatgacagtttgggaggactatactggagaaaaggatgtgatcttttgtggtgtgttcgatggtcatggtcctctaggccacaaggtttcacaatttattcgtgacaatctaccctcaaaactgtctgcagcaatagaaatttcacagcagaagaccatcaaatactatgatgccaatgatgcagagactggcagctttgatgatgcctacgatgacaataaccacaacatgtcccttgcttcatgggagggatgcttgctgaaatccttcgatgagatggatgagtaccttgctcaggaaattaacactgacagctattgcagtggttgcaccgctgtgacattaattaaacagggtggccagttgatagttggcaatttgggtgattctcgtgcagtactttgcacaagggatagggaccaactcattcctgttcaactcactgttgacttgaaaccagatattccaagtaggtcttggttttggcttcaattcccaagtattactagtccatcaagtgaaacctcaagaattgttaactgtgaaggaagagtttttgcagcagaagaagaaccagatgtgtacagaatatggatgcctgatgatgactgccctggactagccatgtcaagagcctttggggacttttgcctcaaagattatggcctcatctcagttcctgatgtgttttacagaaaaattaccccacaagatgaatttgtggttttggcaactgatggggtgtgggatgtgctcactaacagtgaagtgataaacatagttgcttcagcaccaaggaggtccattgcagccaagttgttagtgaagcgtgctgttagagcctggagatacaagtatcctggttccaaggttgatgactgtgctgccatatgcttgtttctgggtgaacaatctgttttgttaaattcacaatcctacatgagtagaaagagtagacagcgcagcaagcacttgaatcgcactaagtccactagaaatgaagacaatgaaactgtgtatggcaagattggggtggagctagagcgagccaactctttatcaaaacttcctcgccttgctaggggtatgagtaaacggcaatcatctaagtactacacaccaagttga

SEQ ID NO: 15968 - DNA, 768 bp, Glycine max
  Peptide Sequence Number=SeqID_107653
atggaagaacaacagatgaaggaaacaaaatatacctttgttgactggacattgagcgtcgcaaaagggggaaggtcccaggaaggggagggggaaggtcgcgcaaggggaagagagaaggaggccatgactgtgaaggaggggaaggaagaagaagaaagccgcaacgtcgaggagggaggccatggcagaggaagaagaaagaaagaaacagtgggagggaggaaagagaaggaagaaggtggaggggaggagaagaacaaagtcaggcattatgccaagcatggtgcttgtgttaccattatcactaccccaactaatgccttgacattccagaaagccatagacagtgacttcagttgtagataccacatcaaaactcaagtggatctgcatccagattgtcttgtaactgatgtgctttatccttggacagtggagtcagcagaaaaactaggcattgcaaggctttacttttacagttcaagctacttcgcaagctgtgccacccattttatcagaaagcataagcctcgtgaaagtgattatgagcaactttatcatagcaccaaggcggtcaagtgttggagtgtaggaccagtttcagcctccgctaacaagagtgatgaagaaaaggccaataggggacacaaagaggagcttgcactagagtcagagtggctaaactggcttaattctaagcaaattgagtctgttctttatgagttttggaagcttcaccaggctctctcattctcagattgttga

SEQ ID NO: 15969 - DNA, 414 bp, Glycine max
  Peptide Sequence Number=SeqID_107654
atggagagcagcagtgggagagagagcacggggcgtgtgccactgtcaggggtggtcagatgtactgtcatggctatggtgttcccagagatgtctacttcaatgaaactctcattgggttgggataatactcacgttggtgatatttatgcctcgaaaggaattagtcgtgcttttggtgacttccgagttctgagcaaaattggagttttacctcggtattcagcactctttaaaagtcaagcatttgttgtgtcagttactgatgctgatgttattggtttgggaatgaagggaagaatttggctgactaaagtgtcgagggttaggtcttcagtttggaaagttgggggtaaacgtccaggttataatgcaagtgactctgagtctgatgaattggaagaagattcttaa

SEQ ID NO: 15970 - DNA, 348 bp, Glycine max
  Peptide Sequence Number=SeqID_107655
atggtcatcattgtcaatgcggaagcttgtggttacgtgagcatgaactactaccaatatataaatgttgtttacacaaatgagcacatcttaaaagcctactccgcacaatggtggcctcttgggaatgaagcagctattcctccttctgatgacgcatggacacttatccctgacccaactacaattcgtgcgaaaggtcggccaaaatcaacaaggataaggaatgagatggattggctcgaaccatctgagcaccgacaaaaatgtagtagatgtggagcaaaatggcacaacaggcgtcgatgtccaatgcaatctgaccatgggagttgttcatttaattga

SEQ ID NO: 15971 - DNA, 1842 bp, Glycine max
  Peptide Sequence Number=SeqID_107656
gtggagcttcaattccgtggtgcaaatgatgtgaaagaaaatgacgcaatatttaattaccgcaggaagtaccttccaacccaacaggttgcttatcacactccaccacggtttcctttggatgtaattgaaaatattcgcaaaggagcatctctgatatttcaacagctttgcctgcaagattttgcacgaattgatggatggtttttgccaaattcaagttccaaattgtcaccatcaccagaaagtgagtttggaaggactgaatctggtaccataatattcactgacattaacctggttggtttttctcatacaaacatccttagaagcattattcaccatgcttgcttgcgatttccaaatcttgcttcagttagtggtatatcaggtaacacatcagaacggcaagtatctcttatgagtggtacaaatgtctggctcaatttgctagccttccatgatcttgaggtaactccatgtttgctttcccctacaagtgagtgtgcatctagcgttgatatcggaaaaaaggctgatgatgtaatgaatagaacagttttgtcattaccttattctcttgtgctaagacatactactgaggaggtactggatgcatgcatggaagcaattgagccagaacgggctgcaataacatctgacctacggaagaaagtaatgaacgatcttatggagggtttgaaggaccacaattggtttactgggtttgatattgctgatgatctgcctgcaaaattttcgttaaggcagtggatcaagctagccaaggaagtccaagcaacaatttttattgcagtgcatggaggcattggagaagatggtacacttcaatctttgctggatgctgaaggagttccctacacaggtcctggtgcaatggcatcgaagatttgtatggacaaagttgcaacatctgtggctataaaacatgaagctacagtgccaaacattatgtgtcaaaccagcaaaagatggatgctcaactggggtcgcaagactatgaagattagaggaattatgttttacaacttgctgattctattttcattcagctgttctgaggaccttgcaatatatgtcagagctctggaggactgtctactaagaattcctccaaatagcttatcaaaggcacatggtatgattgagatgccaaaccctcctccagaatacttaatttttgaacctttcatagagacggatgaaataattgtgacatccaaatttgaggatgcaactggccatggcctcacgtggaaagggcacagcagatgggtagaaataactgttggcgtcataggaaaacgtggatcaatgcactcgctaagtcctagtgtaactgtcaaggaatctggtgatattttgtcacttgaggagaagttccaaggtgggactggcatcaatctgactccgcctcccttgtcaattatgagtgagaatgctttgaagagatgtaaacagcacattgaactgattgcaaacactctacaattggaaggattttcacgtattgatgcatttgtaaatgttgacagtggagaggtaaatactgtgcctggaatgacaccttccactgttctgattcatcaggcactagtagaacagccaccgttgtatcctcatcagttcttccgtaagcttcttgatttggcatctgaaagtttgtatcttcttaaactgactttgaagaaagattctaaatgtgttttcaacaaagctggtgagcccttaaaaggtagtgaggttgtatggcaagaagcacatgtgcgtgggtcatcaacaattgatgaaatcagactaaactctcactttagtccatga

SEQ ID NO: 15972 - DNA, 687 bp, Glycine max
  Peptide Sequence Number=SeqID_107657
atggtatattccaacacccctgctgattttgattttaaacttgaaagccttgcccaaagtttccagactttgtctgatttagcaaagcatctagctacagctgtggacatagtatttccagttatacacggtcaatttggtgaagatggtggcattcaggaattgctggaaaagtataatgttccatttgttggcacaggatcaaaggagtgctgccaagcatttgacaagcataaagcatcattggagctcaggaagcatggattcataacagtacccagtttcttagttcaggggtatgaaacaaagaaatcagaactatcagaatggtttgaaaagcaccagctggaccctgacttagggaaagttgtggtaaaaccaacaagaggagggtcaagcattggtgttagagttgcatatggtgtgaatgattctcttgtaaaagccaatgaaattatgtctgagggaatcgacaataaagtgctaatagaaatatatcttgaaggtgggagtgagtttacagccattgtccttgatgtaggatctgcttcagatagttttcctgttgtactacttccgactgagaggagactgagtatctatattgagacagaagaaagtatcagttgctgtttgattcaatggaatgtgcatgatgagaaactgagaatgaaaaagggaacataa

SEQ ID NO: 15973 - DNA, 588 bp, Glycine max
  Peptide Sequence Number=SeqID_107658
atgtttccaacggatttccaaacacacccgaagccattcagtcgccactgcatttatctaaacgccctctttttctacaatttccatattcctatcacgcagaacactccttactctgtccttaggccgccacttggagacgaggccgctgtcggaggggccagcggggacggcggcctcgaaggcgtcgtggcggagctcgcagaggaaaacggtgtggggaaggtaggccatgctggtggcggcattaccggcatagttgccgctgctgctgctggagatggcagcttcggagtcacggcggtgcgcaaaatcggcgtcgtcgttgctactgctgttgttaacagcggcgacggcggcggaggtggtggaatcgtcgaggtggctgtggatggagggaacgacaagaacggtgatggtgatgatgatgatgatggttatggtgttggcattgatgatggtagggatggtgatgatgatgaaggggggcgcatagaacagtggcggcaggcactgtctctacctgaagggaaaacggaaacgagtgatacgaaattgcgattttgtgaagcgaaacgagaaaaataa

SEQ ID NO: 15974 - DNA, 1344 bp, Glycine max
  Peptide Sequence Number=SeqID_107659
atggttaggaccagaggattaggtcatgccttaggtcacgttactggaagagtcgctatgattgcggcgcacgatgagccagtggtccctgcgccagatattgaggctgatgtatttccggatgacccgatggcaccagctgatgtagagaacattgtggcagacattcctgcggacacaggcgcggaggctgctgaggatgaccatgagggatttccaggtggtccgagcgacccatccgtgttgacccaatatatggatcacgttgcttgcagcgtatggacgggagaggagcgtcctgagttgaagttatcctctcacgggagaaaggtccatagtttaggcaggcatgtccctgccattgagggacccattgctgggacaggactaagtcctctgatcgcatgttcggtagacaccggcgatcggggacttttgtcctcgtttgtggagcggtggcactgggagacgtctagtttccatctcccggtgggagagctcacgatcacgctggaagacgtctcctcgcttctccatctacccatggttggcgacttgcacgcctttcagcctttgcacgtggacgatgcgcgccgatgccaagcaggtcattgtacagctgcggctcgtgcatatcttcttcatcttctggattgcactctgtttactaacaagagtgcaaccaatgtgcatgttgtgtacttggaagcccttcgtgacctcagtatgacggggaggtacgcctggggagtggctgctctgccgatagcttggcggttacatcacactgctgcagtcgcggactccactgttgatcaggaatatgacgaggattccccgcgtgcgtgtaggtggattgcgacaaagaagaccgtgaagagcatacgtacttcggcgtacagggagcgcctggaccaactctggattacggatgtctattggatcccgtatagggagcaccaatcggttcgggacttccatgtcatatcatgctattccggtctcttgcgctgggggcctgttgctgtttattaccgaccagagagggtcgtgcggcagtttagatacacgcagatcattcctgctcctcctgtatgcgctgtgccaggtcagtgtgccagtggctacatggattggttcttccgcatctcgcatcctttcatgacaccaggccacgcatcagatcctctgcctgatggtcatgccccgcagccccgagtcacggatatccctcacgtgccggagccaggagcatcgtcgacatctgtggaggagcctagacatgcagtggttggagcgtcatctgagtctaggggtggtcacaccaagttcatcgacacatga

SEQ ID NO: 15975 - DNA, 378 bp, Glycine max
  Peptide Sequence Number=SeqID_107660
atgagtggaaagggattggagcatgttcgaaaatcactttctcaatatcagcttcttagagcatgtttggaaatcaaatgggataccaattgggaaagagggttttcagtttatgtaatatttaaagaactcaaaaacttcgacatccttaccttcaggaacattggaaaggtgtcaacaccactcaaaaggccacgacttcggctacgtggcggtggtgggagcagcaggtccacttcggcttcaagtactttggggaaacacaacgtcagggtggtagcgggacggagttcacagcgggatgaagtagttcaggcaacagcgggcatgctaggtttttggagggtaggagagggtgtttactgcgagagtatataa

SEQ ID NO: 15976 - DNA, 648 bp, Glycine max
  Peptide Sequence Number=SeqID_107661
atgtcggtattcaacgacactgtgttaccaccacgtgtcgtaaccgatgtagaaagaggctgcactgaatcttcgatgagtccttcgacaacgaccacttccaaattgagctatgcgagaatggctgttagaggcgcctcattctcatttgtgtttatagctgcacgaggttcaaggattggtccagaggatgagatctttaatgtgtgtgtggatattgatgagagtttggattttgaagttaaagtgaatgtcaagcgtggtgttgtgaaaattttaatttggagatgcatccttgttgaacctaggaagcaacaatttggtttccgctcttggcctcgacaacatccgagagagagttacatcactcgtatgcctaaattgcgtgttttgtgtcacttgaaccatgtgttttgcaccaccacctctgcagatatcatacgagcatggaatttgcgtgtagatgttgttgaggatggtgccaacgatgagtatggtgaaatggagctagttcatggcagggatgttgggggcgcgatggaaacgacaaggtcgttgtggatgttgaagttggagatggcggaggttggtgtcgttgtagatctggaagggttctatgtaagggtttctaagagtagtgttaagtga

SEQ ID NO: 15977 - DNA, 150 bp, Glycine max
  Peptide Sequence Number=SeqID_107662
atgggcttacaggactaccttcaagacccctataggcctggctccattccaaatggtttatggcaaagcttgccacttacaggctctatcaggggaaaagaggaagttgcaattcttggagtaggaagagatgagattgaatgcttatga

SEQ ID NO: 15978 - DNA, 783 bp, Glycine max
  Peptide Sequence Number=SeqID_107663
atggaagagaacaaagacaaaagaagtctaaagacagaaaatagagtggaggggtggtgtggtggattgtgctctctgtggaaggttgggatggaatggtgggtaaggccatgggatcaaacagatgaggaaagagacgttgaggaggaagggtccaatgaagggtggccatgtggcaaggttaagtggcttgatggggaagtggaagagatggacggtggagattggttgaatgttggctggctggttaaagggttgagggttctagaacgtgaaaagtgtcacgagcaaggtgggatttttcaagtgaaggtaagggacaagggaacactcgaggagaggtaccatcataccggcaaagttgagagatatgaaccactgagtagatgtgagacccttctgaaagcagtaatttgtaagcaacaactccaatcttacagaggacttggaaggggccaaagaagtgttgacagtggccactgtggaggatctagtaatgtaatcaggcaaagtgtggggagaatggccgtacagagctttaaacaaagacattctgatggcagagtgaaaggtggagttgaaccaatattctgcctagttgagataattgaaccaaaggcaaggatgcttactgacaaagcatctaaggcaatgctgaactgtaattttgtgccttgcattttgaacaattccttccaaaaagcactgagaaagagaggatccctatcagaggtgatagttattggaagaccatgtaggtggcatctcttagtggagaagtga

SEQ ID NO: 15979 - DNA, 342 bp, Glycine max
  Peptide Sequence Number=SeqID_107664
atgcttttagatagagacaagccacatgcatgcgtacccggcaaattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 15980 - DNA, 429 bp, Glycine max
  Peptide Sequence Number=SeqID_107665
atggctagcatgaaggttacatgggtggttgtgatcatgtgcatggccgtggtgggtgcaccgatgatggcgcaagccatgacatgcaatgatgtgacggtgaacatggcacagtgcctatcctacctgatgcagggaggaacaccttcaacactttgctgcagcggagtcaagaacattcttggctctgctgtcaccaccgttgacaaacaaactgtgtgcaactgtctcaaggcggatgctgctaggtacaacatcaatgaccagtatgctcaggcactccctggtttctgcaaggtcaatgtcccttacaagatcagccgctccactaactgtgcaaggagtggtggaatccacactaaagaactcaatcatcaggttctgaacaagccatggacagatttgctcatttctgcagcgggatactga

SEQ ID NO: 15981 - DNA, 528 bp, Glycine max
  Peptide Sequence Number=SeqID_107666
atgggtggagtctacaagttcgaagaaacaactgatgggtacagcaagatgcaaacctataagggaatgcttcttgaccctgcaaagaacttgaagaatctcctaagagtaggtggcctgactaccgaggacaaaatgcttgtctacctcattacctacattctcactccaaggtcaagtatcaagatgaattgggtattgttgatagaagacatcatattaatgagttgtcagttagtggactacaaatttccttatgtcatgcttgcttcaagattcattgactatttcaatgtcgatgtatctaatgagatagtggattttaccaaagcatctagtgagattaccgaaaggaatctcaagaaacatggaaagaggtttgccaaccatgagtggataatcattggagagcaagcaaactcaactaaagttcacagttcgctggagaacataactaccaggctagaaaacatagaaactaggttgatgtttagaagcctccttaaccccgatgaggatgaagcttag

SEQ ID NO: 15982 - DNA, 719 bp, Glycine max
  Peptide Sequence Number=SeqID_107667
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccacaaatcctacagctgcattacctagcaaacccctcacagtttctgctgtgaactcaaatgttaatcaagaaatacacgagaataatgctatcttgcctcaagtcactgagaaacaaatttctactacccctccacccaataaccaagtgatgatgccagaatcagtccactccaggaagaaatggaacactgatgaggacaattcaaaaccagcaaaaggatttcgtaagcttctattctttgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 15983 - DNA, 627 bp, Glycine max
  Peptide Sequence Number=SeqID_107668
atggataactggaacacgctgctggcgctcacctggcagcacacctggctggtgctggtggcggtaggttttgccatcctcgtcggcgtgccgctgggcattctgattgtccgcttcaaatggctggcaacaccggtgctgggcatcgccaccatcgtgctgaccatcccgaccattgcgctatttggcctgatgattccgttgttttcactgatcggtcagggaattggcgccctgccggcgattaccgcggtgttcctctattcactgctgccgattgtgcgcaatacccataccgcgctggaaaacctgccgcccgggctgcgcgaagccggccgcggtattggcatgaccttctggcagcgcctgcgctgggtggaaattccgatggcgctgccggtgatttttggcggtatccgtaccgccgtggtgatgaacgtcggcgtaatggccattgcagcggtgatcggtgccggcggcctgggcctgcaactgctggacggcatcagcggcagcgatgtgcgtatgctgatagctggcgcactgatgatctgtttactggcgattattcttgactggctgctgcaccgtctgcagtcggcgctgactcctaaggggattcgataa

SEQ ID NO: 15984 - DNA, 318 bp, Glycine max
  Peptide Sequence Number=SeqID_107669
atgaagggaggagagcataaatatgggtttaacaacaataaacgtgagaagccacagaaggtaaggctagtggatgatgaaactggcgacaaacatgagctgtttgaagtcctaaggatgccatctagatgtgtatttttgaaggtcttcatgttattccttcatcattcaacgtcttcatgtcattccttccccgagagtttcaagatcatggcttctccacctgcctcccctcctcctcctcctccttctgctccttcggacgcatcggcttcgccgtctgccgtgaagcggacacgcaaagcctcacgtctatga

SEQ ID NO: 15985 - DNA, 285 bp, Glycine max
  Peptide Sequence Number=SeqID_107670
atgttccttatattcaacactagtgctttgaaaggacttgatgatactccacaaccgaaatccaaggctgctgctaggtggattgttgttaagtgtaatagacaaaaaggaatcactgaatgtggctactacgtgatgcactggatgtccacgataatcttaggatctttcaggaataattgggagacgtattttaatgaagttagaccattggaagcagagagatttaaggcacttcgcatacagtgggcacaatattatctaaaagttagaaatcaaacatag

SEQ ID NO: 15986 - DNA, 441 bp, Glycine max
  Peptide Sequence Number=SeqID_107671
atgtccaaatcttgtggatttgggatgaccggccctctcgatgagtcgatctcttgctttctcataagggtggacccttgggtacttgtacctatcaccgttttagaggactacacgtcctcgaccaatcagagggctgcacgccctcaccttcagaggactacatgtcctcgccttgagagggctacacgccctcaccttggaggactacacgtcctcgccttgagaggactacacgtcctcaccatcagagggctgcacgccctcacctctagaggactacatgtcctcgccttgagagggctacacgccctcaccttgggtactagttaccctcaccgtcagaggactacacatcctcgccttgagaggactacacgtcctcaccaccagagggctgcatgccctcacctccagaggactataagtcctcgcctttga

SEQ ID NO: 15987 - DNA, 390 bp, Glycine max
  Peptide Sequence Number=SeqID_107672
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctttatggcattattatgaagatggacatgaatctaggctacctcgtctcttaccagatttctatcattgcccaacatgactcctccaggcttggatttccagccttaatcacagctttgtgtaaagctagagaggtcacatcagatttccagccatcagattctagatga

SEQ ID NO: 15988 - DNA, 166 bp, Glycine max
  Peptide Sequence Number=SeqID_107673
atggatgttaaagttgcagaggttacaactttcagcggtggttcaacccgaaaggattgggagaagaccacccaacaggtgtcatttgggtgtgtctcgggaaccgcagagcctttggatttttgtttcgtcaacgatgatgcgccgcagaacaaccactttggag

SEQ ID NO: 15989 - DNA, 444 bp, Glycine max
  Peptide Sequence Number=SeqID_107674
atgtgggcatgggaacgatgtccaaccttggctccaaagaggactccttcccaagtagaaaatatactactggggcacaggtggctgcgacgtggaaaccaacatatcgacaatgatgatgtgagagcttttcgtcgcaagttggatattatgaaacgtcatgagtttgtgtgggagccttacacatcaaccgttatatcattgttgcctcccgtttatttagtcggaagtctcgcgtggctgaagttgcagagacattacaatacatggtgtctcctcaagggaggaatacatggacagttgatgatctcatgccttatgtggaaaaaattacaattttatccgaagagcaagagagagtcattgagccagtgtcacatggtcccgcatcagagcgtcaatttcccgcacaacagtttcacatacttcagtcaagtgttgtaa

SEQ ID NO: 15990 - DNA, 672 bp, Glycine max
  Peptide Sequence Number=SeqID_107675
atggctgtggtgaaggaattttatgctaatctatacagcccagaggaaccagcccctaaacaagctagagtaagaggacatctgattaagatcgatgcagacaacctgaatgaatttcttcagactctagtggtgttagaagagttgaggataaaccaccaggagattgaagccagactttgtattccctgcaagaggtttgttttgaatgttgagggccagccatggaaacttctcagaaaagatctgacgacactggcccagacatggagtgtattctcttactccaacctagctcccacatcccacacctcagatttgaacatggacaaagctacgttggtctatggcttggtgtgtaacatggacatgaacatcggagcccttatctcagatttgacagttaactttagaggggcaaggaaggcaagggctcgactagctgatgttccctcttcttctgctcctccagctccttccacttctactactcctacaccagctcctccaggcctatctgcccaggactctcagtgctttgaagccatgcttcagagtcttcatcaaggacagattttgttaatgcagagcttgcaggtggtatctcctccaggatccactctgttactggaacagttcatggagaagtatcctggcccggggatcctctag

SEQ ID NO: 15991 - DNA, 492 bp, Glycine max
  Peptide Sequence Number=SeqID_107676
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctccgctagctcgctgttgctgcaaagtgggtaataacattacaaaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccg

SEQ ID NO: 15992 - DNA, 720 bp, Glycine max
  Peptide Sequence Number=SeqID_107677
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccttaacaaccctgtcataagccttttcgaaatctatcttgatggtcatgagtccctccttagttctagtgtgatggataacatgcattgcttcttgggccaaaatagagttatcaagtgttcccctccctgggacgaatgcagcttgaaaagatcctatcatgatgtccaagaaaggacgaagatgatgggtaccgagctcgaattcgtaatcatggtcatagctgtttcctgtgtgaaattgttatccgctcacaattccacacaacatacgagccggaagcataaagtgtaa

SEQ ID NO: 15993 - DNA, 249 bp, Glycine max
  Peptide Sequence Number=SeqID_107678
atgacggtgaaaacctctgacacatgcagctcccggagacggtcacagcttgtctgtaagcggatgccgggagcagacaagcccgtcagggcgcgtcagcgggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 15994 - DNA, 606 bp, Glycine max
  Peptide Sequence Number=SeqID_107679
atggtaggggcgtccgttaattggttctcccgatggaaggaaggaggggccgaagttttgtgctcatgtgaagggttcccaaacgtcccgttgatgggaacgaggggttgtattaattataatcttgtacttgccataagacaactaggctaccccatgagaggagtgccgtcggaagagagtattgcgcctttcatcacacgaggcttcagtgaccccaatgcaagaatgcttcaaagagtccgaaaagcatggaatgcggtgcaatggaaggataaggagattagagggagcaactataaagccactagttgtgtttgtacctctactgctctcaacatggatgattacaagtctttgcaaattgaatttgaaattttcaaaaaggaccactatgcagaatgtatgaagttgcaaactgagctttcctatcttaaagttctttttagaaaattaaacaaaggaaagagtgatctcaatcacatgctcaacgtgcaaaagcatactaccgataagactggtttggggtataacaagcaaactacattttctaagaaaactaagtttgtatcctcaaaaggggtgaacccagacaaggtctcctaa

SEQ ID NO: 15995 - DNA, 604 bp, Glycine max
  Peptide Sequence Number=SeqID_107680
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttg

SEQ ID NO: 15996 - DNA, 323 bp, Glycine max
  Peptide Sequence Number=SeqID_107681
tacaacaacttagtcccgtactattaaggactttagaatcaaaccagtttccactgttgaatgaccctaacaaagcatgcatctatgtgatcaaggatctcacaatcactcacaaactcatctcaagctctcagaacggctttcgcttcgagctctcgtctctgcagatcttcacacagcaaaatctctcaaaactctctggaacttggacctttctctctctagaacttcctaaacatgcaaaagcttcaagccaaggccagactctcgtgcatgcagaggcttctcaaggaaaaatgccaaaactcccacaaaaaatctga

SEQ ID NO: 15997 - DNA, 444 bp, Glycine max
  Peptide Sequence Number=SeqID_107682
atgttgcctgaattctcttcgaaagtcattcccaaatctctggctacatcccaaaaaacactctcctgggcctccttattctgtttgtttgatttgcatggaatattcatctcgaagcatgatgatctttgggttaagattctcatctcgaagtatggaggttggagggctctagaggagggaacatcagttaccaatgaatccatatggtggcaggatttaagcagaagcttattcaggatatgggatgtcactctgcaaatgtttgggaatggaagcttgaatggagaagacacctttttgacaatgaggtgcaagcggcagccaatttcttggatgatatctcgcggggtcatattgatcgttggacatcagactgctgggtttggaaaccagaacctaatggccagttttctgcaaggagcgcatactgtatgctactag

SEQ ID NO: 15998 - DNA, 258 bp, Glycine max
  Peptide Sequence Number=SeqID_107683
atggcttctacaagtggagatgctactccaccatctccaaaaaccgcgaggctcatggaggagatgattaaacttgatgaggggtatgaagaagatgggggaggaagaaggaatgagaggtatagggagagaagaaatcatagaagatatggaggtaggcaaagagaggaaatgaatgagggagtgaaggcgaagatccctacttttaaagggacttatgatctagaagtgtatcttgagtgggagatgaaggtctag

SEQ ID NO: 15999 - DNA, 342 bp, Glycine max
  Peptide Sequence Number=SeqID_107684
atgggaggaaggattaagttctttgaccgcgtgttcaatagacattggcgatcgggaacttatatcctcgtttgtcgagaggtggcaccgggagacaagtactttccatcttctagtgggggagacgccctacgtgacctcactcagactaggaggtatgcatggggagctgctggcctcatccacatgtacgatcaccttaatgatgccagtatcaacactagccgacaggttactggttacatcacattgttacagtgttggatatatgagcactttccgtcaattgcagagtgcaatgctgatctggagtacgacgaggtgtcaccacgcagcgcatga

SEQ ID NO: 16000 - DNA, 1251 bp, Glycine max
  Peptide Sequence Number=SeqID_107685
atggtactgactgttgaagagtttgaggagatattaggatgccctcttgggggaaggaaaccgtatcttttctccgggtttcttccctccttgagtaagattgcagctgtggtcggagattcgacaaaagagttggatcgcatgaagcaaactcggaacggcgtagtgggcctgccgcaaaaatacttggaaggcaaggcaagggatatggcaagccaagagaaatgggtctcgtttgaggatatactagctttgctgatctttggggttgtcctctttccgaacgtggacggtttggtggacctagccgcaattgatgctttcgttgcatatcaccatagcaaggagagtccagtggtggctatcttggcgaacttatttgatacctttgaccgaaggtgtgagaagaacagcgcacggattgtttgttgcttacccgctctctgtgtgtggttggtttcgcacctattccaacaagacataagacacccgtgttcgcttcaaagttatcgctcgtgcatcaaaaaaagaagagtcgattgggaccaacatttggctgggataggaggcagcacaatcaattggtttcctcgatggaaggaaggaaaggagggagttcttttctcatgtggggactaccctaatgttccgttgatagggacgaggggttgtattaactataatcccgcacttgccataagacagctagggtaccccatgaggggagcgccaacggaagagagcctctcgccttttcttgtgagagatttcggcgcgcaaagtcttaaggttgtacaaagagtccacaaggcgtggagaagcccgttgaggaaagataaagaacttaggggcatccgtaatggcatcatcggtggctatcacgaatggctaagagttcatacgcgagggttagattggctctccaaattgaaagttgtcaacgaggagaacttcaaagctccggaagaggatgaagaaatccaagctctaaaattagagctagggaaggcaagactcgccaaagaaaaattcaagtcagccgctacaaacatccgaaaagagtgcaccaagttacgagaggaaaacggggccactgcaagagcccttgaacaagaaaccaagagggcccgcaaggaagaacatggtcgagataaattccgaggagcgttgtggggtagcaacaatgagctcaagctccggagagaggaaagagaccagtcacgggtacatggcattatcttaaaggaataa

SEQ ID NO: 16001 - DNA, 498 bp, Glycine max
  misc_feature (30)..(30): n is a, c, g, or t
  Peptide Sequence Number=SeqID_107686
atggaaaaacggccagcaacgcggcctttntacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccgatgttgggacgcttgatatcttatatggcggctttgaaaatgatgactgggcgagtcctttacctagcaacgaagatgagtgcgttcatgctattcttggagaggggtttgccaaaattcttctcttaagtgacaactatccaagcataccagcttctttgcatcctgttattttatcaaagctcatttacttgtatttcactgacgtgtcggaacacttgcacaggtga

SEQ ID NO: 16002 - DNA, 438 bp, Glycine max
  Peptide Sequence Number=SeqID_107687
atgacgttgctacttagcaacattctgcccagcgaccgcaatgccgatctccccctgcagaagtatcagttggtctgtgccgttccgacattgggatcgtgcccacatgacacccagtggacccggaggagcccaacagggccctggggtttccagctctggttacggcctttgtcagtcctacagggtgcccgttccccccagcaaggggtagcgcccacaagacacccagtggacccggaggagcccaacagggccctggggtttccagctctggttacaggcctctgtcagtcctacagggcgcccgtccccccagcaagttcatgccatcgtgacatagggatcacgcccgcaagacactcagtggacccagagaagtccaacagggtcttggagttgccagctctgattatgggcctctgtcagttctacgag

SEQ ID NO: 16003 - DNA, 709 bp, Glycine max
  Peptide Sequence Number=SeqID_107688
cgatgcagttgtgccgcctgtcatccggatgatccaccgtttctatcacgccggcggcccccaggctgcgcagcgcccggctggcgctggccttgtcgatgcaaagccgggccgccacctcggtgacgcccagcggctgctcgctgacttcgatcatcagatggatctgcagcggcgaaaagcgcgagccgttgctctgcttgttcaacatgccgaattctctgaccaaactacgcgccaatgctctgaaatccctgatgatcgcggcgtttccataacggcgacaacgttcgttatgtcaacgtcgggcgcgggttgctcccgcgctgttttatgctcatggagagatcgcatgccaatgaaaaaatcactcgccgtctgttccgttgccctttccgtcactttgctggcaggctgcgcgaccgaatcctcccgctctttggaagtgccgaaagtggcttcctacaacaccacttatcagggcccacgcagccctatcgccgtcggcaaattcgacaaccgatccagctacatgaacggcatcttctccgatggcgtcgatcggctgggcaatcagtccaagactatcctgatcacgcatttgcagcagactggccgtttcaacgtgctggatcgcgccaacatggaagagttgaaaactgaagccggcattaaagggaaggcgcaaacgctgaaaggcgccaactat

SEQ ID NO: 16004 - DNA, 630 bp, Glycine max
  Peptide Sequence Number=SeqID_107689
atggtagaagtctccacagaggtcattgcctccctcgcccagtattatgatcagccgttgagatgcttcacctttggggacttccagctatcacccatggtagaagaatttgaagagatcctgggatgtcctctagagggaaggagaccataccttttctcagggttctatccctcattagctagaatttctaagatagtccaaatctcggcacaggaattagaccacagaaagcaagtaaaaaatggggtggttggaataccgagaaagtatttggaggctaaagcaagaatcttggcaggtaaaggcgaatgggccccgttcatagacattctcgcactgttgatctttggaggagtcctctttccgaatgtggatgggttggtggacctagcggcaatcgacgcttttctcgcctatcatgaccacaaggaaagcccgattgtcgctatgctagccgacctatatgacaccttcgaccgaaggaaatacaccataactaaatgcaccccaaggcatccctatcacaccagatccaaatctagaacgatgggtgatcaagaggagacacatgaacagatgaaagccgacatgtcggctttgaaagaacaaatggcttccatgatgtag

SEQ ID NO: 16005 - DNA, 201 bp, Glycine max
  Peptide Sequence Number=SeqID_107690
atggatgacaaaattggtgatgggatcactagacagaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16006 - DNA, 396 bp, Glycine max
  Peptide Sequence Number=SeqID_107691
atgacggtgataacctctgacacatgcagctcccggatacggtcacagcttgtctttgacgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgatgcagtgtctaccatcagatag

SEQ ID NO: 16007 - DNA, 315 bp, Glycine max
  Peptide Sequence Number=SeqID_107692
atggctaaatatgaccccgagatagtcatggagttctatgcaaatgtctggcccaccgaagagggagttgtggataagcactcttgggtgcggggccaatgtatcccctattatgaagatgctatctaccagttcctggggcatctgttggtcctagaggagaggcaacgaaggtgggtgcggatcatgagcactagcatgaccactttgacacagatctggatgacgcttctcctcaacaacatccttcccagcaaccataattctgatcttccactgcctaaatgccagctggtctacactatcctgacctag

SEQ ID NO: 16008 - DNA, 237 bp, Glycine max
  Peptide Sequence Number=SeqID_107693
atggatcgaagttggatgcaagcatcacgcatcagtgatgagtatgagaatggagttaaacaattcctccaatttactgaattgaatgcaccatctttgcgggagaacccatcaatctctcagactaacccagttgatgtggacatgggaaatcgtatagaagacatgattcgcgatttgggccagggtgcacaactttcacaaggttgtcagtggtattatctctggtcaacttga

SEQ ID NO: 16009 - DNA, 348 bp, Glycine max
  Peptide Sequence Number=SeqID_107694
atgacggtgaaaacctctgacacatgcagctcccggagacggtcacagcttgtctgtaagcggatgccgggagcagacaagcccgtcagggcgcgtcagcggatgcgtaaggagaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcctactcttctcacctga

SEQ ID NO: 16010 - DNA, 186 bp, Glycine max
  Peptide Sequence Number=SeqID_107695
atggactcgggaaggttccaagttagtgtaccaggggtataccaccaactgcttgcccttccgtggcatatccgaggcaaggctcaaagtcggctagattgtggtggggaatttcatgtgtctcccccacagtttaagagacatgtgcatgatcagtttggggttgttggctctcaatgggtatag

SEQ ID NO: 16011 - DNA, 226 bp, Glycine max
  Peptide Sequence Number=SeqID_107696
atgggggttgctgtcatgccccggtgtgcttctccctcatcccacaatgtttggaacgggatggtgcgcagtagttgggagagccgggtttgcctcgacagtcgtgctagcagcggcggcggtggccgtggatgccttggggcacgcttagttatggcgtcggtcctaaagagaccaaatgtgaggagggcggagtacgtgtccaccattgcattagcctttgcca

SEQ ID NO: 16012 - DNA, 135 bp, Glycine max
  Peptide Sequence Number=SeqID_107697
atggcacatcatacccctatcattcaggcacctgattggacaaccctatttgagctaatcggaatggagaaggaagagagagagaagaagccacttcaaggagaagatgagtctagaagaagctcaccaccatag

SEQ ID NO: 16013 - DNA, 345 bp, Glycine max
  Peptide Sequence Number=SeqID_107698
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtataccgcctttgagtgagctggggatcctctag

SEQ ID NO: 16014 - DNA, 360 bp, Glycine max
  Peptide Sequence Number=SeqID_107699
atgaatccattgatgaagaagatcctaggcctacaagctccaatggagcttacatcacaatgccacacgaaaaacacaaaagcagagaaaaatagctaccaaaaatggagatgtgtgcatttctggaaaaaaaaagcttttataaggaaaaaagaagccaggggcatttttgccatttataaattttgctgggtgcacttggcaccactcttcatcttttcatacaccttaaagacacattgggctggactggaatatgcccttcttggagtgataggagatataggagaaaacaggatatttactgggcaaagagatgtttatggaaatttgaaagtctcagatagagttcaagattga

SEQ ID NO: 16015 - DNA, 867 bp, Glycine max
  Peptide Sequence Number=SeqID_107700
atggctaccaaaggttggagctttgttggagcttcaatggtggaggaagaagaagagaatggcaactccctcgcgtttctctgtgcccatcggggccagttttcgaaagtaggcaatatatatatcaaaacgctcaggataaaaccccgagtgtggttcagaggatgtcacacctcccctctagacctcaaccttgccctcgccgcagtcgcatccgctcgattccccttccagcactttaccggcgcggttctgtgggaaacctttttttgtactacgactttgttctatgcgccggcatgggcggtccacgtggctttgcatttgactacaatcatcatcccgttgcggcgactgacgagcgactcagactcttcctcttcctctgttatcgatctgatgagggcagcaaagttcgtgatgttgaaggttgacgatttgatgaattgggctcgttgcagctccatctggcccatgaccttcggcctcgcatgctgcatagtcgaaatgatgcacaccggcaccgctttgacatcatttttaggcccagcccccgccaatctgatcatcgtcagcactctcaccaataacatggctcccgctcttgacaagaccgctccagctggtgaatcagataatgacaacttcccgatcaaacgatacattgcaaaatacactataaatccagctatagcgaatggtttatcacaatatgttggttcggtggagaatgttgcactttggcacttttccatagcatatggcaatctcattcaaaatgagaggagtgaaacagaagtgatatttcccgtgaaaaagcaaggttgcaaatgtcatcaatacttgctgacctatgttggccattag

SEQ ID NO: 16016 - DNA, 467 bp, Glycine max
  misc_feature (395)..(395): n is a, c, g, or t
  Peptide Sequence Number=SeqID_107701
atggcttctagaaagagaaagagcattagtacaaggcccacatctcagtatgacacaaagagattctcttcattagatgcttggaccaaatacactgataatgttatagggagaaacattttacctgagaggaagctagaactatatcacactgagctaaatgactttaaggccgaactagagaggcgtaatttccataaatgcctcaccaatttagtcgatgggagcatagacctggctttggtgaaagagttctatgcaaatttatacagttctgaggatcatccaccaaagcagtccagagtcagaggtcatttggtgaagattgatgctgacagtcacaacacattcctggagacacctgtggtattagctgagggagagactctacccgnctactctagatactgcaggttgcctacagacttcagagagatagaggttgccttatgcatacttggtccagg

SEQ ID NO: 16017 - DNA, 168 bp, Glycine max
  Peptide Sequence Number=SeqID_107702
atgaatcctgaatgtgtttttgccgagatttgttatccaaatctgatgagaatcatgaaactggccaaatacaggctaaaggcccaagtggagaaggacgaaggcctaagtggagaaggacaaaacccccgagtggagaaggatgaaggcccaagtggagaaggatga

SEQ ID NO: 16018 - DNA, 570 bp, Glycine max
  Peptide Sequence Number=SeqID_107703
atgagaaagcgccacgcttcccgaagggagaaaggcggacaggtatccggtaagcggcagggtcggaacaggagagcgcacgaggggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtactcagcgccatcgccgtcggcatggcgctgcgcacgccatatttgcgcgcaggatagttggcggtgctgatgaccccccgctgaacgcggctgccgcctatcgcaatggggatatcccgcagcgccgggttgtcacgcatctccactgcggcaaaaaagcagtggggatcctctag

SEQ ID NO: 16019 - DNA, 231 bp, Glycine max
  Peptide Sequence Number=SeqID_107704
atggcctgcaccaagaaaactgggcagatgatgtctgaggcagcaaaggaaattgctgagaagattgattctttggaggagcaggatctcctgactgttgccattgggcgaccagaacaccctggtcgtatgcatgctgctggagctgcggtgaccataaagcaatactttgaatcggctccacgaacctcccgcacttcttcctccatggctcccgaagaactagagtag

SEQ ID NO: 16020 - DNA, 240 bp, Glycine max
  Peptide Sequence Number=SeqID_107705
atgcaccacaggccacaagacgcactgccaccacctcatcaggcagatcatgctgggtcattaggcatggagcagtatctacagcacttgtttagggctgaggtcgcatggcccggagattggcccgaggcccaggcaggggaggcgcctgcaggatccccaggcgatgcagaggaggcccgcatggatgaggagatgatggatttgctcggtttcttgggagggagcggagccatgtga

SEQ ID NO: 16021 - DNA, 228 bp, Glycine max
  Peptide Sequence Number=SeqID_107706
atgcgtggaagatttatagcacttgtgagcagtgtcagagagcaggaaatttcatgggcccttttcctgtatcttgtagaagcaaagcttcatggtgaatccaagatgatgacaaaggtgatgacaaaaagctcaaagatcaatcaaagaataactcaagtaaatcaaagatcaatcaagaacaattcaagagttcaagataagaatcaagaagaattcatgacttaa

SEQ ID NO: 16022 - DNA, 768 bp, Glycine max
  Peptide Sequence Number=SeqID_107707
atggtcggggattcgacaagagagttggatcgcatgaagcaaactcacaacggcgtagtgggcctgccacggaaatacttggaaggcaaggcaagggatagggcgagccaagagaagtggggctcgtttgcggatatactagctttgttgatttttggggttgtcctctttccgaacgtggacggtttgctggacttagctgccattgacgctttcctcgcatatcaccatagcaaggagagttcagtggtggctatcttggcagatttgtttgatacctttgaccggagatgtgagaaaaacagtgcacagattgtctgttgtttacccgctctctgtgtgtggttggtttcacacctatgccaacaagacacaagacacccgtgtccgcttcaaagctatcgctcatgcgccgaaaaaggaagagtcgattgggaccaacatttggctggaataggaggcaacgcaatcaattggtttcctcgttggaaggaaggcaaggaaggagttcttttcttgtggactaggggttgtattaattataatcccacactcgccataagacagctagggtaccccatgaggggagcgccgacagaagaaagtctctcgcctttccttgtgagggatctaggcgcgcaaagtctcaaggtgatacaaagagtccacaaggcgtggagaagtccattgaggaaagacaaggagcttagaggcatccaaaatggcgtcatcggtggttatcatggatggctaagagttcacacgtga

SEQ ID NO: 16023 - DNA, 216 bp, Glycine max
  Peptide Sequence Number=SeqID_107708
atgaatccggtcaacctgttgatccaaagaaatacagagatagtgtcgcaacgtgcccttcgcgggcaagcgagggcgaggctcacgggtgcgctttccaaaggaggaaagatgcgcggagttgccaccaacgtttatttgtggaaaacgtcgggaaaaccgaaggaaaccggtcaaaatgaaaattctaagttcgggagttgtatttacgcttga

SEQ ID NO: 16024 - DNA, 676 bp, Glycine max
  Peptide Sequence Number=SeqID_107709
atgacatatgacaaagaaatgttagcagaacaatacaacacggcataccaattgctcacagatgagcaaaaaactattgtcgataccattatgtctgtggttaacactcaatcaactgcagtttactttctctatggatatggtggaactggcaaaacatttatttggacaaccttatcatctggtatacgctccaatggtggaattgtttgtacagttgcttcaagtggaattgcttcattactattgcctggtggtcagaccgcacattccaaatttgctataccagtccctgcaacagaaaattcaacatgcaatattcatcaaggcagtgagttagctgaattattaaaggttacaaaactaatagtctgggatgaagctccaatgtgtcataaatttgcatttgaggcactagataaaagtcttaaagaaatcatgcaaaacaatctgccttttggagggaaaattatggtttttggtggagatttccgacagatcttgccaattgttacaaaactaatagtctgggatgaagctccaatgtgtcataaatttgcatttgaggcactagataaaagtcttaaagaaatcatgcaaaacaatctgccttttggagggaaaattatggtttttggtggagatttccgacagatcttgccaattgttccaaaag

SEQ ID NO: 16025 - DNA, 199 bp, Glycine max
  Peptide Sequence Number=SeqID_107710
gtcgactctagaggatccccccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 16026 - DNA, 600 bp, Glycine max
  Peptide Sequence Number=SeqID_107711
atgggacctctccaaatgcaagccttccgtaaggcgtacggaaaaatcttagatttgaccatagcagagatatccacaaaagccattgcatcactcacccaatactatgaccagcccttgagatgcttcacgtttggagacttccaattagtaccgaccgttgaagaatttgaggagattctaggatgtcctcttgagggaaggaaaccatatcttttctccgggtttcttccctccttgggcaaaattgcaattgtggtcagggattcgacgagaggattggaccgcgtgaagcaaactcgaaacgacatagtgggcctaccacggaagtacttagaaggcaaggcgagggatatggcgaatcaagaggagtgggtcccgtttatggatgtattagcattgctaatctttggggttgtcctctttccaaacatggatggtttggtggacctagccgcaattgatgctttccttgcatatcaccatagcaaagagagcccggtggtagctatcttggcagacttatttgacacatttgaccgaaggtgcgaaaagagtagtgcacggatcatctgttgcttacccgctctttgtgtatag

SEQ ID NO: 16027 - DNA, 534 bp, Glycine max
  Peptide Sequence Number=SeqID_107712
atggcagagccatcgaagaagagaaagggatcatcctccaccgctgctgctgctgctcatcgccgccacggaccatctgaagcatccacaacacctattcatccatctttatcatcaccaagatcatccacattgttttcttccaataatcagcgtctacggtacctctctcaattttcttctaggatcatcttagaccctaagtacctagatgtagagttctttaatgatggaacgcttgattgctatcaagtgtttcaaaattctggccttgttgatttcatgtccttaaaactgccacattatcctgaacttgtaaaggtcttctactgcaatttgaaaattcaggatggcattatttcctctgaggtgcatggtattcctatgatcattgatcagtccttattcttttctttaactcatttacccagtcaaggtgcaccttttgagggcaccattgttgatgactggaaatttgattattctagtcatgatgctcgccgcatggtctgcaatgatcaggggatcctctag

SEQ ID NO: 16028 - DNA, 246 bp, Glycine max
  Peptide Sequence Number=SeqID_107713
atggtaggacgtggtagggatcagaaccgtgatgtcctcgaccgcatcacagttgtgctggaaactatagtgcaggaacgtgatgtggagccggcggagtatcggagactcatggctttccgtaagaaccaactgccgaagttcagtggggactatgatccagaaggtgctaggttatggagcataaggtcccttatgcgatgttcatgctccaaggagaagctgagaactggtggaagttcgtga

SEQ ID NO: 16029 - DNA, 597 bp, Glycine max
  Peptide Sequence Number=SeqID_107714
atgaaacaacgttttttagcagtaagctctttattgctttgtattacctgctcagtagaagccaacgcacaacaaacaccaatcgttcatattggagttaaggccggtacaaatttcactaaaacatcttctgcctcttctgacctgagcggaaaatatggaataggatatcaggcgggacttatggcaagagtagactttaaccggatatatcttcagggagaagctatatttaacaaaagaaaaacatcatatgacttaaaagatggaagttcttcgcaattgaaatggaattcaatcgatatccctgttgtagcaggttataagatcgtaagttccaaagattttaatgtccgagcttttgccggaggagtttacagttatggatttaatgataatatttctacctcaaaagcactgcgcgaaggtttaaaaaaattcgataaatccaatattggtattaccggtggaattggtgtggattataaaaacttcaccgttgatctgaggtacgaaacaggactcaccagcatcagcaaagaatttaaatccaaacctcacagcttctcgcttggaatcggatacttcctgttctaa

SEQ ID NO: 16030 - DNA, 213 bp, Glycine max
  Peptide Sequence Number=SeqID_107715
ctcaaacatgatatcaaaattcccaacgttgagaatacttggaattgggctgcaaacatagtgctcaaatttcacgacaatccaacggtgaacgagtccgagatcatcgtttttctgagacaggttaggtggcctgcgggaaaaagagagggttttgggagaagagagaagaaacgaaattgtgaggcagaggaggctgaggagtcagtctga

SEQ ID NO: 16031 - DNA, 552 bp, Glycine max
  Peptide Sequence Number=SeqID_107716
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctggccgccgccatgcacggtcgcggcggcaaactcaagattgcgggcggaagatacgtcttctgccccaaaccagacctctcaaggatcttcttctgaaaggacaagttctcctccgagaatga

SEQ ID NO: 16032 - DNA, 315 bp, Glycine max
  Peptide Sequence Number=SeqID_107717
atgcatgatttcattgataagattgttgatgtcaaagctgatggtaactgtggatatcggtcggttgccggtttattaggtatgggtgaagacttttggtcggtggttcgctaccatcttcttaaagaacttgggaatttctcagaagactatacccgactctttggtggcacgaagagatttgaggaattaagaatgtcactacatgttgatgggttaaccaagcattgttgtgatctagcaattatcatcctcaggcgaagccgtgaccaactccatatattagcagaatgcagcattacaagagcttcgtga

SEQ ID NO: 16033 - DNA, 213 bp, Glycine max
  Peptide Sequence Number=SeqID_107718
atggaactagctttggattaccatatatattgtgctgtcatcccaagagaaggatcaaacattgatgatgcagatgtgctaagatattgcaagaagaatcttgcatctttcaaagtccctaaaaaggttttcattactgattctttgcccaagactgccaccggaaagattttgcgtcgtcttgtggcagaacacattgtctctcaaatttga

SEQ ID NO: 16034 - DNA, 254 bp, Glycine max
  Peptide Sequence Number=SeqID_107719
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagtgttttcccccatcacgacgttgtaaaacgacggccagtgccaagcttgcatgcctgcaggtcgactctagaggatccccagcagaagccatgcatgtctcgagg

SEQ ID NO: 16035 - DNA, 795 bp, Glycine max
  Peptide Sequence Number=SeqID_107720
atggcacgcactaaccgatatgggaagatgacatctgaggcggcaagaaaaattgctgataaaattgactcattggaagaacaagtgacacagggtgagtttgtcccacaaggtcatcaagatatacttaacacggccatagggagaccagatcatggaggtcatgttcgtgcagctgggtctggggtcacaattagtcaatactatgggaagacatcatgtgcctcaactacctcatccatatcattcaccaaagaacagttggctgaaatagtagtaaccattagggaacaagtcaggaatgagattcaagaagaaaagaagcgaagtctacaggcttggaaaaatgagctgaaggatgccatcattactgacatatttgatggagataaggtctcagcaccggctaattttgatttaaatgtgttaggtgcacgcgtgagcacaaaggagagcaatgctgaaattgttgtgaacccgtctagggaagaacatgttggtcgtgtaacaccacctatggggttgtacgtccaaagtcaagattgtacaaagctggtggcgttggtaaaaattcatgatggaccatctaccatacattgcgtagcgtatgcagatgatgtcgtaagggttagcatcgaaaaagtaattgatggtgaagctgaagttccatttgcgacatcagaaattaagtatgtgagagaggcccttaacacattcattgcatggccattgcctttggtaaaactggtatcaaatgaggtagtatactttatgttctgcaaggggatcctctag

SEQ ID NO: 16036 - DNA, 417 bp, Glycine max
  Peptide Sequence Number=SeqID_107721
atgtatcctagccaggaaccctaccttctcttgagagagaaggtggggttcccagtgctcaggtacctcagcaggtacaggatgcatcattcgaggccaccatccctgagccattcatttttgaagcaggtaaggcaggaggatgctactcgagagagatcaccacagatttcaccagatccaccttctccaatggtggatcaatcttctcttcaacagccagtagaccctcctacaccagtgcatgagattccagcagacccgtctacaccattacttgatcttccagaggacccttctacaccagtcttgggattgactaccactcctccggccactcttgtgctacatcttacagatgaggagggcactcaggatgaggacactcaatcacaggacatgtcacaggaattttaa

SEQ ID NO: 16037 - DNA, 156 bp, Glycine max
  Peptide Sequence Number=SeqID_107722
atgtctcagcatatctgtcatacatttgtggattctgcatctgacatgaacagtatgcgagcgggaaatccgatgtgtatgaatcctctagcagtcattcagagatctgagcaatcgcagtttgaattggaaagctacatgaagagttggatgtag

SEQ ID NO: 16038 - DNA, 365 bp, Glycine max
  Peptide Sequence Number=SeqID_107723
atggtggataccttgcctgtattttactatgagaaattagtgggctacatgccttccagcttcgcggacttggtcttcgccggagaaaggatcgaggtgggtttgaagaggggaaagtttgattacgtctccccgataggtgccaacagtaggaggattggaatagatggggcaaagaagaaagagggagatgcccataccgtcacttcaacacttgccatcatccaccttgtggcatggtataaagtgtgccatcttgctaaacctatccaccaccacaaagatagagtctacacctctttggattctaggaagcccaaggacaaagtccatactaatatttacccaaggtgcagatgggatgg

SEQ ID NO: 16039 - DNA, 483 bp, Glycine max
  Peptide Sequence Number=SeqID_107724
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcccccaacagcgagtggagcgacccgctgggcgcgcgcggcatgatccagctggcctcgcgctacagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 16040 - DNA, 639 bp, Glycine max
  Peptide Sequence Number=SeqID_107725
atgggaacaaggggttgtatcaattacaatcccgtcctcgccataagacaacttggctaccccatgagaggagcgccatcggaggaaagcatcacacctttcattgcctggggtttcagtgaccccaatgcgagagtgcttcaagaagtccaaaaggcatggggtgcagtgcaaagtaaagataaggagcttagggggagcagcaacgggatcgccggtggctatcataagtggctgagagttcgaacgcaaaagttggattggctcccaaagctaaaagctgcaagagaggaagaggctgaaactctggaggagagtgaggaagtgcaaaccctaaaggcgaaacttgaaagagcccaagtagtcaaagagaatttcaagtcaatggccatcaaagtctggaaagagtacgatgaactaacggacatcaatatggccactgctgaagccttggaacgagaaaccaagagggcccgaaaggaagaacacgaccgaaacaagttccggggagctttgtggggcagcaacagtgaacttaggctcctaagagccaaaaaggatcagtcacgagtcaaaggcatgatcctgaaagacgagttaaaggcgtgccattggtcgaaaagatgcttgtccgagtag

SEQ ID NO: 16041 - DNA, 72 bp, Glycine max
  Peptide Sequence Number=SeqID_107726
atgtcgtaccacaagggaggagagagtgagagactcactgttaagtgttttagtcttagatttagattgagt

SEQ ID NO: 16042 - DNA, 168 bp, Glycine max
  Peptide Sequence Number=SeqID_107727
atgtatcgctcaaccgggatcaaggactttgctacatatggcattgaagaaaaagcacaggcgagtatggctaaccttactttgttaggcaaaagtctcgtatggccacgactaacaattgttgcatcaacacgtgacaatcgtgagactttaaccctactagcttaa

SEQ ID NO: 16043 - DNA, 282 bp, Glycine max
  Peptide Sequence Number=SeqID_107728
atgtcggctgaaaaatatcattcggggccatttcacgaccgatgtcggctattgagttttctaacctcgatcggtcatctctccatgccgacgtcagctatcatttttttcgatcaatttctgatgagaatcgtgaaactggccaaatacaggctaaaggcccaagtggagaaggacgaagacccaagtggagaaggacaaagcccccgagtggagaaggatgaaggcccagaggcagagacactagcaagactaataattgttgctgaaggcccaaactaa

SEQ ID NO: 16044 - DNA, 559 bp, Glycine max
  Peptide Sequence Number=SeqID_107729
atgaccactgaaattggaattttgcaaaccataggtgaccacatggaatatctaagctctgattctgttgacaaattagaaaccattgaagattcctatttccaatcaattactactaaattccttaattcattgaccacatccggtttgccaactcattctatcaagcttaaaattggaagtcctataatgctcttaaggaacctcgaccaaaatcaaggcatgtgtaatggtactagattagtagtaacaaagctggcaaaacatgtaattgcagctgaaattatttcaggcaaaaacattggcctcggtgtttatattccaagaatgtcaatgtctccttcacaatcaccatggccttttaaacctttgagaaggcaatttccaattatgctttcttatgcaatgacaattaacaagtcacagggacaatcactatccatggttggactttatttgccaaaacctgttttcactcatggccaattatatgttgcattatcaagggtcaactcagcaaaaggattaaaaattatgattcatgataatgagcagaaaa

SEQ ID NO: 16045 - DNA, 930 bp, Glycine max
  Peptide Sequence Number=SeqID_107730
atgaaacgcagactctcatttcaggtaaagctgtttttagcgctggtgtgcttctcctgcctgctgttagttctgctgggaaccatcctgtttcattttattgaccggcagcttcatcacgatctcggccagcgcgcccgggttcaggccagccagattgcgctgatgccgggtctggctgacaaggtggccgccagagatattccgggcatcgcccggctgattcagccgctgcgtgccgaaagcgatgccagctatattgtgattggcgatacccgcgagcagcacctctaccattcggaatctccggagcgcattaatttaccgatgatcggaggggataacgcggaggtattaaagggtaaaaccatcatttccgtgcgtcagggtgggattggcgtgtcgctgcgcagcaaagcgcccatcttcaacgcccagcatcaggtcatcggcattgtctcggtcggctatctgacatcgtatattgccaacattaatgcccgcattctgtggcagtccggactgtacggcgttgcgcttctgctgttgctgtttatgttctcctggctgtttacccgcaatttaaaaaaacagatgttccggctggagccgaaagatatcgctcagctggttttgcagcagcgggcgctattagaagccatgtatgaaggggtatttgccgtcaatgaagagaagcagctgattttaattaaccgcgccgcccgcgaaatgctggatattcgtcaaagtgagaaagagcttatcggcaaaccgctggaagacgttctgcagacatctccgggcttcttatcccagcgttacgcctcggtgagcagcggcagtcatgaccagattgccgtgctgaaccagcgagaggtgatcgtcaaccgcgtcgccattgaggtcgagcccggcgttgaaagcggctgg

SEQ ID NO: 16046 - DNA, 198 bp, Glycine max
  Peptide Sequence Number=SeqID_107731
atggaaggaagtcaagaggttctgaaacgtaagcctcgtgctaagcgcatctttgttcatgcgctaagccgcgagtctcaagcgcttagcgcccaacccttgaatctgaggctgatttggtgcgctgagctggccaaggctgagctaagccaacttcaatttgatctggatttggctaagcgaaagcctaaccactaa

SEQ ID NO: 16047 - DNA, 510 bp, Glycine max
  Peptide Sequence Number=SeqID_107732
atggaggattgcaggattttctccaccgaatctttgaggaggattctgaggattccgctccaattaaagtgttcctcttggtgtggggggttcaacggcaagcaacggcggcttacggtggccaccggtggtcttaggtggtggaaaaatgaggttttagggtttgggtggcattttggagaagaggagagtgaaaaatcatgtttttcacgctcagaacgcatttataatctgcatatttcgcttagcgagcctgtcgcgctaagccgaagtcgacttctctggttggaattgggcttagcgcacctttgggcgctgagcgcaattccctctctggttggaattgcacttaacgcaccattctcgcctagcgagagaccaaacgttgttattttaaaaatcccaactgtcagactatgggtgttacaccactcatcttctcctaccttcaagctcttatccatagcttcctatggtggtgagcttcttcttgactcatcttctccttga

SEQ ID NO: 16048 - DNA, 429 bp, Glycine max
  Peptide Sequence Number=SeqID_107733
ggccctgggattccccgcactgatcacaggactctgccagtcgttcggagtccccgttgcgcctaccaagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatac

SEQ ID NO: 16049 - DNA, 249 bp, Glycine max
  Peptide Sequence Number=SeqID_107734
atgaggggaaggctgcaaaaatggcgatgcgtttggaattgtattgatagcccgagtcagcagctgcgtctattgcacgagggccctgataccgtagaggagcttctcaagaggcatctcgttaaaaacaacaacgaaaacgagttggagaatcggaggcaactcaccagcactcgccgcgaagcgctgagtctctaccgtgacattcttcgggccacccgcgttgtaaggtcatgccgcataaggtga

SEQ ID NO: 16050 - DNA, 237 bp, Glycine max
  Peptide Sequence Number=SeqID_107735
atgcgtaaggagaaaataccgcatcaggcgccattcgccattcaggctgcgcaactgttgggaagggcgatcggtgcggccctcttcgctattacgccagctggcgaaagggggatgtgctgcaaggcgattaagttggtgccaagcttgcatgcctgcaggtcgactctagaggatcccctgggtgcatcttccaagggaggaaaatgtgcggagtcgccaccaatgtttatttga

SEQ ID NO: 16051 - DNA, 399 bp, Glycine max
  Peptide Sequence Number=SeqID_107736
atggaagggttagtggacctagcagcgattgacgctttcctcgcctttcatcatggcaaggaaagcccggtcgtcgccattttggccatgtatgacacgttcggccggggatgtgaaaagagcagcgcaagaattgtttgttgtgcactggctctctttgtgcggctgaaggaaggaagaatcaggattctatctttatgcgaaggatttccaaatgttcccttaatcggaacaaggggttgtataaattataatcctgtcctcgccataagacagcttggctaccccatgagaggagcgccattagatgaaagcatcacgcctttcattacacggggtttcagtgaccccaatgcaaaggtactccaaggagttcgcaaggcatgtgatgcggcgtga

SEQ ID NO: 16052 - DNA, 192 bp, Glycine max
  Peptide Sequence Number=SeqID_107737
atgaagtcaggtgacaggcggagatacccaagcggttctccgtacaaacgatttctgttgaccctgacacgggaagtcaggtggcagacgggggtaccttatggttatccgcacctttcgtcaaccaaagtgaatgagttcgatggtttttactctcgtcatccgaagacattcaagcccgacgtcgcataa

SEQ ID NO: 16053 - DNA, 337 bp, Glycine max
  Peptide Sequence Number=SeqID_107738
cggatgccgggagcagacaagcccgtcagggcgcgtcagcgggtgttggcgggtgtcgggcctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccaggcgctcttccgcttcctcgctcactgactcgctgcgctcggtcgtacggctgcggcgagcggtatcagctcactcaaaggcggaatacggaatccacagaatcaggggataacgcaggacagaacat

SEQ ID NO: 16054 - DNA, 360 bp, Glycine max
  Peptide Sequence Number=SeqID_107739
atggcggcacagctaatccatgatcaagtggagatggagtgcttagagggagcttgggagaccctcgaaggcaatgcgaggtgccgatttcggggcacaatccgattcacggctacttcattggtgcatccagatgaacctgcacgtacgcttcagcgcacggtggagtggatactacccacgcctacaccatatcgtctagtggagccagtccaagtgatcgaagtaacatcgtccgaggaagaccctgaggaggatcttgaggggctacctctcgagcctgctgtggatgctcttgattttctagaggatgatgaggacccagttactgaggtggattctcccgaggaagtcatgtcg

SEQ ID NO: 16055 - DNA, 459 bp, Glycine max
  Peptide Sequence Number=SeqID_107740
atggggatgagaggttgcattaattataatcccgtcctcgccataagacaactttgctaccccatgaggggagcatcgttagaggaaggcctcacaccttttattgcacgaggtttcaatagccccaacgtggaggtggttaaaggagttcgcagggcatgggagatggtgcaaaagaaggacaaagaacttagggtaagtagcaacggggccatcagcgactaccatagcgaagaggtgcaagccctcaaaacggagcttgagaaagcccaagcggtcaaggaaaagttcaagtcaacagccgttaggatccaaaaagagaacgtcgagctgagagacgtcaatatagccaccgccaaggccttggagcaagagaccaaaaggactcgcaaggaagaacacgaccggaacaagttccgaggggatctgtggggcagtaacagcgaacttaaactctaa

SEQ ID NO: 16056 - DNA, 252 bp, Glycine max
  Peptide Sequence Number=SeqID_107741
atgaatgtgttgagtagtgcaacaatcttttgtaaaatcacccatgcatccaacatctttatgattcacatacatagcgactcattaggtgttgagggaagaagcccagagtttcaagaacctctggatttaaggtcaaatccttttcaagggggagggaatgatgcaatcctacccccccaagggtattggatagaagactccaagaagattgggccaaagatgcaaaagaaggccctagggttctcatga

SEQ ID NO: 16057 - DNA, 114 bp, Glycine max
  Peptide Sequence Number=SeqID_107742
atggtgttgaaccacttcaacaagtctgcgtcatcttggactagccatcctttagaaggtattgttaaaaggtcatcaattcctaatgaaatggatgtatccgggatcctctag

SEQ ID NO: 16058 - DNA, 327 bp, Glycine max
  Peptide Sequence Number=SeqID_107743
atggtgggttacacaccttccagctttgcggatatggtcttcgccggcaaaaggatcgaagtgggtttgaaaagaggcaaatttggtcatcctgctttgataaaaactggggcaaatgaagaggttacaatgctaaataaaatggataaatttgatatctttgtccctcatcctctcacaaacgcatctttgcttattcaactttcaccggaatgtgggtgcaagccattgttctgtttgctcaagcgacctgctctccttagtgttgacttccaagaccgttcaatcagagattactcgtcttgcacgttggtgggggtgccgtga

SEQ ID NO: 16059 - DNA, 473 bp, Glycine max
  Peptide Sequence Number=SeqID_107744
cggatgccgggagcagacaagcccgtcagggcgcgtcagcgggtgttgccgggtgtcggggctggcttaactatgcggcatcagagcagattgtactgagagtgcaccatatgccggcgccattcgccattcaggctgcgcaactgttgggaagggcgatcggtgcgggcctcttcgctattacgccagctggcgaaagggggatgtgctgcaaggcgattaagttgggtaacgccagggattgtcatcatcaaaaagggggagattgtggaagcaatgacttccaagattattttgatgatgccaaagaatcaagagttaagcaagttccaaagaatcaggcttcaagaatcaagtctcaaagaatcaagattcaagagcaattaagtttcaagattcaagattcaagaacaatcaagatcaagattcaagagaagaaatcgagaagcaacagtcaagacttcacaagggaa

SEQ ID NO: 16060 - DNA, 251 bp, Glycine max
  Peptide Sequence Number=SeqID_107745
atggaggtcaatggaaaatatctgcacctggacatccactggaactactgcacgcatgtggttgcactcaatttggtggccattgtcgaccaagacccagagtgggttcgttggtttggcctgaaggcccaaagcttggatcaaatgagtttgaacaaaattgtgggggaacccaattcttctggtggtttgggtaaaaggtctagagatggagcttcttctattggatcatcgtcttccttcacaataag

SEQ ID NO: 16061 - DNA, 603 bp, Glycine max
  Peptide Sequence Number=SeqID_107746
atgacggtgaaaacctctgacacatgcagctcccggagacggtcacagcttgtctgtaagcggatgccggggagcagacaagcccgtcagggcgcgtcagcgggtgttgtcgggtgtcgggcctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctaccctggcacaaggtccaagtttcacagatttgataacccccccgccccgcctttttcctcctctgttccagccctctcccatcatattcctacctccctccatgcttccaacatccccttctcccatggtcccactttcgagtgtccattctgccaagactcctccctttccctcctaa

SEQ ID NO: 16062 - DNA, 348 bp, Glycine max
  Peptide Sequence Number=SeqID_107747
atgcctaaatcatctcccaacatgcatgtgaagcaagaagtatcaacaagagtcaagccaaggctattgtgcaagcaatcaatggggcaaaacacactgaataaaatagatgatgatggctcaaattctcaccaaggaaaaacaagggtttcaattcacaaaatgccaagaaactcctatttcaaaaacaattacccattacctgtacataacccaaaattcaaagaggaacatgtaatgttgtacacaaaacataaaaccaaaatgatcgaggccatacccgaatcaaataaacatggaaatgcagtactaggaagtgatcctaggtcgtttcccaatgagcaatga

SEQ ID NO: 16063 - DNA, 567 bp, Glycine max
  Peptide Sequence Number=SeqID_107748
atgcctcctaaggtgtctagttcctccggcagaggagggagatccagtacaaaaggaaaagaggttctattggctctaccagagccaataaccaaaaaggaaactacatcatcttctgggtcacctacccagactgggtcatcaacccagaaaggaaatcttgaagggtcattgacccagataactaccgtcaaacctgagtcatcaactcaggaatccccaaaatcaacaacaacaaaacagactgtggctgactatgcctggtcaatacaaactctcttggccttagaagatataggcctcaccaaagtaccaaaattggctaaaaagacctgggcagaaatggcctcagaatcagacgatgattttgaaacagatctgcaaaaacaaatccaaaaggccaaacagaccaaaactgtctgtaaccaaaaaccaatacaatcattgactcaacaagaatcaacgccacaacccagcaacagttatattgcaaaaaaaaaaaatttcaatgtctcacaaatggaaccagaatactgggacaagaatcctttcaaagcaactgccaaa

SEQ ID NO: 16064 - DNA, 54 bp, Glycine max
  Peptide Sequence Number=SeqID_107749
atggcgccaaatttgatcgaggccgtacccgaatcaaataaacatgaaaataca

SEQ ID NO: 16065 - DNA, 297 bp, Glycine max
  Peptide Sequence Number=SeqID_107750
atgaggggcatcgtgcatgagcctcaaaggactacacgtcctcgccttgagaggactacatgtcctcgccatcagaggactacatgtcctcgccatcagaggactacatgtcctcgccatcagaggacttcatgtcctcgccatcagagggctgcacgccctcaccttcagaagactacacgtcctcgccttgagaggactacatgtactcaccatcagagggctgcacgccctcacctccagaggactacacgtcctcgccttgagagggctacccgccctcgccttgggtactag

SEQ ID NO: 16066 - DNA, 789 bp, Glycine max
  Peptide Sequence Number=SeqID_107751
atgggaagacagaaagcagtgatcaaagcgcgtcgtgaagcccgccgagtgcttcgcagtgactctcgcagtcatcgtcagcgtgaagaagaatcggtcacttcgctggtgcagatgggtgggctggatgcaattggcatggcgcgcgatgtgcgtgaccggtcaccaattgaggccagaaacgatgctcaggcgcactatcttaacgccatagaaacgaaacagctgatattcgcgaccggtgaagctggctgcggtaaaacctggattagcgctgcgaaagcagccgaggccctgatcaataaggacatcgaaaggatcattgtgacgcgcccggttttacaggcggatgaagatctcggtttcctgccaggagacatctccgagaaattcgctccctatttccgaccggtttacgacgttctggttaaacgtctcggcgcttcctttatgcagtactgcctgcgacccgaaatcgccaaggtagagatcgcgcccttcgcttatatgcgcggacgtacctttgagaatgcggtggtgattctggatgaggcgcaaaacgtcaccgctgcgcagatgaagatgttcctgacccgcctgggcgaaaacatcaccgtgattgtcaacggtgatgtcacccagtgcgacctgcccgccagcgtcaaatctggccttgccgatgcgctggcgcgcttcgaagaggatgagatgattggcgtggtgcgtttcggtaaagacgactgcgttcgctcggcactgtgccagcgcacgctgcatgcttacagttaa

SEQ ID NO: 16067 - DNA, 519 bp, Glycine max
  Peptide Sequence Number=SeqID_107752
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccgg

SEQ ID NO: 16068 - DNA, 444 bp, Glycine max
  Peptide Sequence Number=SeqID_107753
atggtcattccacacactttttcgccattcagacacagtcgtgtccgatggcacgcagagactaacattgtcttctgcgcccttttgtcatccagaggcgacgggcccgatgacatgcggagacaaattatggtcattccgcatactttttcgccattcagacacagtcgtgtccaatgccacacagagactaacgtcgtcttctatgcccttttgtcatccagaggcagcgggcccgatgacatgcggagacaaattatggtcatcccgcacactttttcgccattcagacacagtcgtgtccgatggcacacaaagactaacgtcgtcttctgcgcccttttgtcatccagaggcggcgggcccgatgacatgcggagacaaattatgagactaacgacgtcttctgcgccttttgccatccagaggcagcgggcccgatga

SEQ ID NO: 16069 - DNA, 255 bp, Glycine max
  Peptide Sequence Number=SeqID_107754
atgatggacttttctcgtgtcttttatttccttttggtggttctttggccagaatgtggttggcagccagtgtctctgacagatatgattacctcttctgcagttaaaaaagtgtatagaaaagcaaatttatgtattcacccagataaagttcaacagaaaggtgctactcttgaacagaaatacacagcggagaaggtttttgacattcttaaggaagcttacaccaagttcaatgcggaagagctttcttag

SEQ ID NO: 16070 - DNA, 213 bp, Glycine max
  Peptide Sequence Number=SeqID_107755
atgaatggcgttttcggtcatgtgtcctgcacctttgagtttggagccatgcgtagtgattgcttagtgcaattctccattctcaaccctttttcggagccccatgaagaagaaaaagaaggagtagagacgaaagtcgtcatcacggaaagggcaggacagacgaaatcagtgtcctatctttgctttcctcttatccccaatgagaggtaa

SEQ ID NO: 16071 - DNA, 297 bp, Glycine max
  Peptide Sequence Number=SeqID_107756
atggtgtattctaagataaatgcaaaaacatgtcattattgcatgaaaaagggttatacatcatataatttctatgtcagaaggtttgacattcagagaggacaatgcacgtggattccaaaagatttatttgtgaagattaaccccattagacccaacttaaattgggtatgcctaaaagccagagattcactacgatacttggatagtggctgctctaggcacatgatgggtgacaagtccaaactctccgactttgtgtcaaaagatggaggatacgtcacaaaactcagataa

SEQ ID NO: 16072 - DNA, 363 bp, Glycine max
  Peptide Sequence Number=SeqID_107757
atggtgttctttggatatgttaagagttgctgcaccgactatataaatggcaatttgaatccaactgttgaagtcaacatatttggttattcagaggctgcagacgttgtatttacaagtggggtagatgtacttgcagtggggataaatgttacccaccaagttgtactaactgaatttatgcataaggctccagtgccgcctcagagtttgatagtcactgttttcggtgtgtcgagcaccagtagcgcttcgaggccatcaagggatggtctttccacagggagaggcgtgtccagctcagggaagacaactatcctgacttccagggagatatctctcgcagacattgggcacgactag

SEQ ID NO: 16073 - DNA, 276 bp, Glycine max
  Peptide Sequence Number=SeqID_107758
atggctggctcaaacagtatcattcaaggatctttaccggttttcgatggaaaactgtttgatgattggaaggtcaagatgctggcaatctttggcttccaagatgtatttgaagtggtgacatttgggtttgaagatcctggaaggaaagccactgaagaacagcaattggatttcaaacagaatgcagaaacgggattgcaaagctcgatttctcatctaccaatgtgtgaactcaaagattttcaacaagatctcgaaggcctctacctctaa

SEQ ID NO: 16074 - DNA, 267 bp, Glycine max
  Peptide Sequence Number=SeqID_107759
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcttcacgaaccatgtaagcatggtggagttgaggccgaaattgggttctggagagggagcaccaactggggaaggagtgaggaaagtgggggaggaaagagaaacatttttttttaa

SEQ ID NO: 16075 - DNA, 618 bp, Glycine max
  Peptide Sequence Number=SeqID_107760
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaatccttgaaggtgttgatagacaggataataacagaaatgcttctgcctcaacagtctcccatgatactgagtttgcaaattctagatcatcatcatcatcaaacaccaaatccggaaaaccatcacgttttgaattggctgcatttagtgctgcacctgcatctttttttcccagagtctcggataaattcaccggaaatggactcgcgggactgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 16076 - DNA, 106 bp, Glycine max
  Peptide Sequence Number=SeqID_107761
gtttctatccaatgcccttgcggggtaggattgcatcacaatccccagtggagtcaccaactgtcgcaacctacccttcgacgggagggcgacgcgtgactcgcag

SEQ ID NO: 16077 - DNA, 528 bp, Glycine max
  Peptide Sequence Number=SeqID_107762
atgactggaaggcttctttccggttcattggcttttgaaatccacatccttcattatctcattgtgcgtattttgcttccaagatcttcaaaccttgcacaggtttctgaggaagatcttattgtcatgtgggcttttcatacagtcacacttttccttcaacactttaacatccctcttgatttcgaaccttatattccaatcaagagatccttcttaatcggtgccgctgtgattgcaacttttggttaccgtaaagagcatgatgactcttgggtaaaaaagggtgctcaacctattgatgatgaaggacatttaccagttggagaggattcctctctccttcagaggattttggacaggtttgatggtcttcaaacctatgttggtgaaaggtttgatgctctggaactacaagtggatatgcgtttcaacgagatggaatcaaggatcaccaaggttgaaggagatgtcacttacatccgcatatgctttgatctaccaccagcactgccaccatcatcttag

SEQ ID NO: 16078 - DNA, 453 bp, Glycine max
  Peptide Sequence Number=SeqID_107763
atggctaagtttgacccatatattgtcctagaattttatgataatgcttggcccacagaagagggagtgcgggacatgcgatcatgggtgaggggtcagtggattccctttgatgcagacgccctcagccaattcctgggtgaaccgctggtgttagaagaaggccaggagtgtgagtttagtcagagaaggaacagggccgacgggtttgacaaagaggccattgcccagctattatgtataccgggtcaggattttgcccggaccgctgcagggaggcgggtgcgaatcatgcgcaccagtatgaccaacttgacacagatgtggatgacattgctgctcagtaatgtcctacccagtgatcaaaactccgaccttccttttccgaagtgtcagctggtgtatgtcatcctaacacagatgagcatccatgtggctcagttgattgcttga

SEQ ID NO: 16079 - DNA, 267 bp, Glycine max
  Peptide Sequence Number=SeqID_107764
atgaagtcaggtgacatgcggggataccgtatgggacagcaagtcaggtggcaggcggagataccttatggtcatctgcacctttcgtcaaccgaggcgaatgaattcgatggtttttactcttgtcgtccagagacattcaagcccgacgacgcacgagattcttctctgctggacggggggcgatcaagttcaatggcatggggaaatgtcgtggttgtcccattttatcgctttcaagacactgaagttttggggatcctctag

SEQ ID NO: 16080 - DNA, 492 bp, Glycine max
  Peptide Sequence Number=SeqID_107765
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgagcgatgcgccttatccg

SEQ ID NO: 16081 - DNA, 258 bp, Glycine max
  Peptide Sequence Number=SeqID_107766
atgacagttcccaatgaagaaccagctcatgaagtcaattatatggggaaccagctaagacacaatttcaatgcaggtggattctctgtattcctgcatggacaacaatacaaccaacaacagggacaatggaggaatcaccttggaaatcctttcaacaaagaccagggtggaccatccacaaggccacagcaacaagggcctagtctctatgatcggacaacgaagctggaagagactctggctcaatttatgcag

SEQ ID NO: 16082 - DNA, 99 bp, Glycine max
  Peptide Sequence Number=SeqID_107767
atgggtctatccttagtgctcttcatcgtcttgcctttagttttagcattgatggtggatgagggtaaaggaagaaagagaggttgggagggttggtga

SEQ ID NO: 16083 - DNA, 393 bp, Glycine max
  Peptide Sequence Number=SeqID_107768
atgaaagctgcctggaaaagccaactgaggaaaaaggaaaggccttttccgttaattttagatgaacttggtcatgatgctctgcaagtacatcgggtagcccatgcattatggcattacaggcgcaaagttttgaccctagctttgcaaagtcgtgttagtgagattaataaagcagaagatcttgaccttggtattgtgggactcgatactttcagtgaacatggccagatgtcgtacaggatgtcacgacatcacgcttcagaacatgcagattgtatgtgtccgtatgaacagattaaacaagtaaataacacaagagaattgttaacccagttcggtgcaacctcacctacatctgggggctaccaagccagggaggaaatccactaa

SEQ ID NO: 16084 - DNA, 264 bp, Glycine max
  Peptide Sequence Number=SeqID_107769
atgccgggaacagacaagcccgtcagggcgcgtcagcggttgttgccggggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 16085 - DNA, 381 bp, Glycine max
  Peptide Sequence Number=SeqID_107770
atgcgtctatcgatatggactattaagagggctgtcatgcgcttattgatcttgaggatgctgtgttgcttgggcttgatcttgagtttgccggcctgtgctggacccgctaacctgcgtgtcattgggcacggtatgccagatgtggatctggataacgcaatctatgaggtgccggtgaaatccggtgtcacttaccaggacttgattgatagcctgaaatcgatctcggaaggcatgaacttcgtcaatccagccaatttcccgattggtgaccacatgaaacaacgcgggcaggacccgcaaggggtcaaagaagtgcggaccttttgcaatttaagtatgggcactgagattattctcgatcatcccgagttcctg

SEQ ID NO: 16086 - DNA, 558 bp, Glycine max
  Peptide Sequence Number=SeqID_107771
acacttgttagcattgccacacctcttaggcttgagtttattcctcaagtaaaggagttgttggatgagggtttggttcgcaagagcttaaatccttgtgctttgttggtgcccaaaataggtattattaggcaccaaatccctatgataggtggtatgatgaatgtgttgagtggtgcaacactctttcgtaaaatcactcatgcacccaacatcttcatgatttgtgtacatagggactcattaggtaggaacaatcaacatgaaaataaagaaaaaggtatgttttattccattactttccttaactttttaaatagtgatcaagggcttcccatggaccctaagagaataaaggtcattcctgagtggcctactccaccaatgttgaggaaagaatccatgagttttaagaacctagtggatttgaggtcaaatccttttcatggggtagggaatgatgcaatcctaccgcccccaaaggcattggatagaagactccaagaagattgggccagagatgcaagagtagaccctaggagtctcatgagccctagg

SEQ ID NO: 16087 - DNA, 411 bp, Glycine max
  Peptide Sequence Number=SeqID_107772
gtgaaagcacaaattgagaaaaagattgaaccatatgctagatattccaataagggtagaaagaaaattgttatcaaatcgggtgattggggcataaattataatgcatataaaactgctttaccactagactatggtgagagcaacacttttagtgttactgacttgactctttgtgatgtaggtatctttgacatcaattcgagggagaattctccccaagaaggagggtatgatagaggactatccaaggaggaagagtttggcttgggtgggctcaacatggatggaccaatcactagagcaaggagtaagagatttcaagaagagcttgacgagagactaaattctctcatggagggaagagaagaagaagctcaactcattttttttagccaacttttagaataa

SEQ ID NO: 16088 - DNA, 275 bp, Glycine max
  Peptide Sequence Number=SeqID_107773
ttgagcttagctcatcattgggctaagcgtgcatccaccgctaagcgcaacttcagtgtgatagaagaatctggcagagcatcaatatcaaggccgcacgctaagcgcgagatcagtgtgctaagcacaacagttgtcttcagtcaggctcagcacacgattggcgctaagctcaaatccacttactcgcaggattccagagcacaccatagtgcctatttcgggaatagagctctggaggcagcaaaaggagtagcttttgcaaagataccttg

SEQ ID NO: 16089 - DNA, 467 bp, Glycine max
  Peptide Sequence Number=SeqID_107774
atggaacttattgagaatatgggtgctagtgatcatgctattttgcgtgatagaactcatgttcttacaaagagaagcctgttagagctttcttcacaagatgcaattttggcacaaaataagctgctagcaaagcagcttgaatcacttacagagacacttagtaagttgccaactcagttacaagtggctcaacctttccattcagcagttatgcaggttggaggttgcagtatatgtggaggaccgcatgaatctggttgttgcatacccctggatgatgttgcaaaagaagtgaattatatggggaaccagaacagacaaggattccatgcaggcggtttttcaggaggacaatccactaaacctcagaatcaggggcctaacatgtatgaaaggaccaccaagcaggaagagaccttggctcagttcatgcaagtttcaatgtccaaccacaagagcactga

SEQ ID NO: 16090 - DNA, 596 bp, Glycine max
  Peptide Sequence Number=SeqID_107775
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagatagagaaggcatgaccatcaattttctcagagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 16091 - DNA, 249 bp, Glycine max
  Peptide Sequence Number=SeqID_107776
atggaaaaagaaaaacatgtctcctattgtagtcatgacttttgcaagagcctaagtgaagaacttagtgactattatagaggaaggcataggtcacatcctagagctcactcccatatgagagaaaaggagggaaaacctcaagaggctaacattaacctcccatactaccatgggaaggatgtggaagcaatgtcttctaaggttattttgatgatgccaaagaatcaagagttaagcaaagattaa

SEQ ID NO: 16092 - DNA, 204 bp, Glycine max
  Peptide Sequence Number=SeqID_107777
atggagctctcgagatattcaaatggtcataacttttcgctcggatgtacgattcaggcgaatcatatatcgagacgctcgtacttgatcaacggaagctctcgagaaattgaaatggtcataactttcgctcggatgtacgattcaggtgtgtcacatattgagacgctcgaaattgaacaacggaagctctcgggaaattaa

SEQ ID NO: 16093 - DNA, 255 bp, Glycine max
  Peptide Sequence Number=SeqID_107778
atgtgttttcgtgaagaaaatccaaggcgagatacttctgtaacgcttccacttcctacctctattgtccaatcttgtgaatttgggatgaccagccctctcaatgagtcgatctcttgctttctcataagggtggacccttgggtactagtacctatcgccttaagaggactacacgtcctcgccttcaaaggactacacgtcctcgcctttagagggctacacgccctcgccttcacatgtcctcgcctttaa

SEQ ID NO: 16094 - DNA, 219 bp, Glycine max
  Peptide Sequence Number=SeqID_107779
atgtaccctctacttgtaccacaaaggatgtaccgtccaatgtgttgggacaaagaattctcaggcgggaaagagacgaatcaaaagaattctcagaggggtcatttgaattctcttggaaagggagaagagagacacaatagaattcaggcggttagtccttcgttcttttggcaaagggagaagagaatgaaaaagatgaataacacaaatttttga

SEQ ID NO: 16095 - DNA, 381 bp, Glycine max
  Peptide Sequence Number=SeqID_107780
gtgtggatatggagccctctgaaagtgaggacgcgtagtcctctaaaggtgagggtgtgtagccctacaaaggtgaaggcacatgaccctttgacggtgaggacgtgtagtcctttggaggtgagggaatgcagccttttgatggcgaggacgtgtagtcctctcaaggtgagggcgtgcagccctctgttggcgaggacgtgcattcctctaaaggtgaaggcgaggacttatagtcctctggaggtgagggcgtgcagccctctggtggtgaggacgtgtagtcctctcaaggcgaggacgtgtagtcctctagaggtgagggcgtgcagccctctcaaggcgaggacatgtagtcctctagagggtgagggtaactag

SEQ ID NO: 16096 - DNA, 225 bp, Glycine max
  Peptide Sequence Number=SeqID_107781
atggctccggaattacccaaaatatgttttattccactgcgatggcgatatgcatttcattcggctattacagaaccatggttcaacttgatccatgacaaaaatttgacgcccagagatgaggtagctttctactaccgttttcacgagcatgcatgggaactgctcatcaggaaaactattgaatgggacaacaatgacaccgactttgacttcgacgattga

SEQ ID NO: 16097 - DNA, 678 bp, Glycine max
  Peptide Sequence Number=SeqID_107782
gttgatccggccgtgccgggtataggcgaggccgtggcggccggcacgagtcggcatcacgcaatcgaacatgtcgatgccgcgcatcaccgactgcatcaggtcgtcgggggttccgacgcccatgaggtagcgcggcttggtggacggcaggtgcggctccacggtctcgatcatcgcgagcatcaccgcctgcggctcgcccaccgcgaggccgccgatggcgtagcccttgagatcgagatcggtcagcgcccgcgcgctctcgacccgcagctccggcacgtcgccgccctggacgatgccgaacatcgccttgcccggctgctcgccgaaggcgacgcggcagcgctcggcccagcgcaggagaggtgcatcgccttctcgatctccggccgctcggccggcaggcgcacgcattcgtcgagctgcatctggatgtcggagccgagcagcccctggatctcgatggagcgctccgggctcatccggtgggcggtgccgtcgatatgcgagcggaaggtgacgccctcctcgtcgatcttcctcagcgccgagagcgacatcacctggaagccgccggagtcggtgaggatgggtccgtcccagcgcatgaagcggtgcaggccgccgagccgcgccatccgctcggcgccggggcgcagcatcaggtggtag

SEQ ID NO: 16098 - DNA, 1199 bp, Glycine max
  Peptide Sequence Number=SeqID_107783
gtgcttcacattcgaggacttccagctagtgccgactgtgaaagagtttgaaggaatcctgggatgcccactgggaggaaggaagccatatcttttctctggttctatccctccacgacaagagttgccagggccttggaaaatcaaggcaaatgggctttcttttattgacatcttggtgcttttgatctttggagttgtcctctttccgaatatggaagggttagtggacctagcagtgattgacgctttcctcgcctttcatcatggcaaggaaagcccagtcgtcgccattttggtcatgtatgacacattcgaccggggatgtgaaaagagcgacgcaagaattttttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctgggttgtattaatcccgtcctcaccataagacagcttggctaccccatgagaggagtgccatcagacgaaagcatcacgcctttcatcgcacggggtttcggtgaccacaacgcgagggacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaagaatcatcacgggtcaaaggcatgatctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttccccgattgctagccaaggccaaagcaatggcggacacctactccgcccccaaggagatccacggacttctcagctatt

SEQ ID NO: 16099 - DNA, 327 bp, Glycine max
  Peptide Sequence Number=SeqID_107784
gacggggccgagtgcgggcacggctggtatcagctggcccttgccgcgagtcgatctagaggcatcccacgtggtggaatcaacaccctcggcgccaatgccgggagtgcactggcgcgtctaggccgcaccggaggagctgaacgcgcgaactcgggtgctgcggctgccgctccggcggagcagcaccgcgaacgtctcgccctcgtccttgcgacgctgatcgagccggtcgcgtgccgcggccgaatcgctggacggtctactatgctgaaccacgcgccaggagctgccaccgctggcgactggccgcttcgtccgatctga

SEQ ID NO: 16100 - DNA, 255 bp, Glycine max
  Peptide Sequence Number=SeqID_107785
atgagggagctctcacagctggtaattcaacaacaagtatctgatagatgggtatggaaacctgagcctaatggactttattcgacaaggagtgtatataaattgctgcaggggaagccaggattgcagaggtacatgggaagccaggatcgcagagaatgcacaattcaatggaatcaagctgctggaggatgctgtgtttttgcactggacgtggctcagacctatggagaaagatttttctatgcactataa

SEQ ID NO: 16101 - DNA, 610 bp, Glycine max
  Peptide Sequence Number=SeqID_107786
gctcctcaaggacaggctctccactaagggtaatcttttaagaagaaatgtggctatccaagatgttggttgtcctctctgtggtgaagtgcaggaggaagtggcttacccagcaaaccattttgcacaattttgtgacgggtttggtgcaaacataaaccatagcatatggagtggatggtgggtggctctaactagcactatatggcagcataggaatcttttgatctttcaaggaaattcttttgattcatctaaagtcatggaagaggctatgttcttagtttggtcttggctaaaagctaaagagaaaggcttcaacattacttttaaccactggtcttccaacatatcggaatcctttgaacaagctcaagaggttgctcttgtgtgtataaagaacaagctcaagaggttgctcaagaggttggcattaacagatccacttaaactgttacaagaacacaataagggtaagggaaacttcactaaggagaagaagcacagagttgtgacgatgctcgagttaaatatgagataccctagccatgagaagaagcacagacttctgacgatgctcgagtgcgacgaacacgatgctcgaccttag

SEQ ID NO: 16102 - DNA, 1131 bp, Glycine max
  Peptide Sequence Number=SeqID_107787
atgaggagatcagttagtggggtccacacgtgggaaatctgcagaccaagtaacaaaatgagacccattttggtcctttggcacactcacctacaactgggccaacggattccgttttttaaccggtcccgcacaacgtgcagacaaagatcaatgagtagtgtgtggtgtggtccaaaaatgtacgaagaaagtagttgctatgatcccgatgcaatgatggcagagggagcagaagactgcttcccccaaatggtttcagaatcagaggcagttatgtctgctacacccacacagacccacacccacaacacctttgcctactcctattcctgcggagaagatgctgcaaatgcaaatggcccaatagcgatggaacacccccaacaaaatccatacaattatagcaacacccaatttgtggaagagctttattcgaatcagcaatttacttatcacacaccaacaccagatctccttgaccttctccacttgccaaaccctattccaggagataataggacaaacgtctcctctgtgtcctatgacccttacttgcatctcaacctgcaacaacaacaacaacctaccctccgagagttgcttcctcacatgccggctctcagaaatgatttccccttcggcggtgccgctggaggggacgacatacaagacttcggaaatggattggtggacttcactcaacaagaagttgggaaaaggagaggtggaaagaggacgaagcagttcaccagcaccaccactgagagacaaaggagagtggatttgagtagtaaatttgatgctttgaaagaactcatcccaaacccctccaagagtgatagagcatctgtggtgggagatgcaattaactacatcagagagcttaagaggacagtggaagaactcaaattactggtggagaagaagaggctcgagaaacaaagggtgatgatgaggcacaaggttgaaactgaaggtgaatcctccaacctggaccctgcagagtacagtgaaagcttaagaagttcttggatacagagaaaaaccaaagacaccgaggttgatgtgcgcattgttgacaacgaggtcacaattaagcttgttcagaggaagaagatcgattgcttg

SEQ ID NO: 16103 - DNA, 297 bp, Glycine max
  Peptide Sequence Number=SeqID_107788
atgtttcagagatggatcctccttgatgagttagttacaggaaaaaacgagggtagcggtggctccgaggaagccaaagaaaggtgcggtttcgtcgccgctgaaggcagctattttgtgtttgtttggcgagaaacggagatctattgcggtttcgtcgccgctgaattgatgcaaaagaaaagaactatatacattttttacctagggcaatcgggagggaaggaaaggtggtgccgccccctcaccccttctcttattttacctactaacacaaatttaaagcctataaattaa

SEQ ID NO: 16104 - DNA, 984 bp, Glycine max
  Peptide Sequence Number=SeqID_107789
gtcgactctagaggatcccaccttcgccgtgctcttcaggttcacgccgatgtaggtgcgcaccgagtggcccatggcattcatggtgtggtgcgacttgtggcagtggaccgcccagtcccccaggttgtcggcgttgaactcgatagcccgcatctggccgaccgcgacgtccgcagagacctcgaaccactggcgctcgggcgggatccagccgccgtcggtgcccgtgaccttgaagtcgacgccgtgcacgtggatcgggtggttggtcatggtcaggttgccgaagcgcatccgcaccttgtcgccctggcgcgcgaccatgggttcgatgcccggccagacccggctgttgaagcaccacatgttcatgtcgagcatcgtgttgaccttgggcacgtaggacccggcctcgatgtcgtaggcgttcaggagccagacgaagtcgcggtcgacccgccgctcggcgggatcgcgcggatgcacgacgaagaagcccatcatgcccataaccatctggaccatctcgtccgagtgcgggtggtacatgaaggtgcccgagcgcctcaggatgaactcgtagacgaaggtcttgcccggcgggatgccgggctggttcaggcccgccaccccgtccatcccgttgggcagggtctggccgtgccagtggacggcggtcgcctccggcagcttgttggtgacgaagatgcggaccttgtcgccctcgaccgcctcgatggtcggcccgggcgactgcccgttatagccccagagatgcgccttcatcccgggggccatctcgcgcacgaccggctcggccacgagatggaactccttccagtccccgcgcatgcgccacggcagcgtccagccgttgagcgtcaccaccggctggtagtccaccccggtggtcggcacgagcggcggctgcgtcgtcgccttgtccatcgagggcgcctcgggcaggccggcgccctataa

SEQ ID NO: 16105 - DNA, 225 bp, Glycine max
  Peptide Sequence Number=SeqID_107790
atgtggaccaccacgggaaaaataggggaggagcttgccacccagctcgcccaggcgagcaaaggttgcttcctccagaagtacagccttcctggaaggaagggatctggaaggccccaactttctaagaagttacggaaactcacggattgtgcaaaaacacctctttttgacttcctccacattacgaaatttcacggatcgcgcaagcctccttccttttga

SEQ ID NO: 16106 - DNA, 330 bp, Glycine max
  Peptide Sequence Number=SeqID_107791
atggcctcatctaactttccatttcctgagggaaattctattaataggccttttgttttcaatgacgagggttatcactattggaaaactcgaatgcagatatttattgaagccatagatttaaatatatgggaagccattgaatttggtcccttcattcctacaatggtagtggaaaatgcaaccatagaaaaacctagagaagaatgggatgatgatgaaagaagaatggaaaacccggcaagaggaatttctaagaaaagaaagcatacatcacttggaaagataatgacttggattcttcaagtgattcagaaaatcaaatcataa

SEQ ID NO: 16107 - DNA, 63 bp, Glycine max
  Peptide Sequence Number=SeqID_107792
atgaatcgctttttttggacgatggagacctcagccagcctacggcaggctgccacggcgtag

SEQ ID NO: 16108 - DNA, 390 bp, Glycine max
  Peptide Sequence Number=SeqID_107793
atggaacgtgttgacaatgataatcaacatattggcaatgatgatcttagagttttccattgcaaattggatctcatgaaacgacatgaggagccatacacggcaactatgatggcagcgttgcctccaatttgtgtggttggaagtgtagcctggtttgcggtggtgccactgatttgtttccatgttgttgagtggcaccaacccgatagagttttacgacaatttggattgcaacaacctattctcgggtgtccttcgcaaccgcagaatctccatggcataatgctcaaaggaaaacaagatgagaattggttccacctgttggccccaatgattagtcagtggaacaatcgagttgagtttagggtcgacgtttatcctcgatag

SEQ ID NO: 16109 - DNA, 258 bp, Glycine max
  Peptide Sequence Number=SeqID_107794
atgtcattgcctagcgttgttcatgtgtcctccaccttcgagtctggagccccgcgaatgtcattgcctagcgctgttcgccaattctccattctccactttttttcggagccccatgaaggtcattacctagcgttgttcatgcatcctccaccaaaagagtttggagctatgcttcatgaatgcctaagtgtggaccctctagtgcaatcctccattctccacttttttcggagccccatgaatgtcattgcctag

SEQ ID NO: 16110 - DNA, 219 bp, Glycine max
  Peptide Sequence Number=SeqID_107795
atgttttcctggccgaataaatgggaacataccagttttgatgagaatcctgaaattggccaaatacaggctaaaggcccaagtggggaagggcaaaggcccagacttatcaaggtaatccttgtggcgtctacccagacttatcttccttcaccggaagtggcgtctaccctgacttatcttccttcatcggaagtggcgtcatccaaaccttcgtaa

SEQ ID NO: 16111 - DNA, 876 bp, Glycine max
  Peptide Sequence Number=SeqID_107796
gggctacacgccctcgccatcagaggactgcgtgtcctcaccttcagagggctacacgccctcgccatcagaggactgcatgtcctcaccttcaaagggttacacgccctcgccatcaaaggactgcatgtcctcaccttcatagggctacacgccctcacctttagaggaccacacgtcctcaccttcagagggctacacgccctcgccatcagaggattgcatgtcctcaccttcgtagggctacacgccctcacctttagaggactacacgtcctcgccaacagagggctacacgccctcacctttagaggactacacgtcctcgccaacagagggttgcacgccctcaccttgagaggactacacgccctcacctccagaggactatacatcctcgccttgagagggttgcacgccctcacctttagagggctacgtgtcctcatttttcatagtttccttttaacggttcctgggccaccccctaatattggaggagggccaactgtgcaagcacaaccagagagggaggctatcacacagctactatgcataccggggcaagatttcacccgtgccgctgcaaagagacgacaacattctgcccagcgaccgcaatgccaatctccccctgcaaaagtatcagttggtctgtgtcgtcccgacgtggggatcgcacccacaaagacacccagtggacccgaaaaagtcaaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttgtcaagctctaa

SEQ ID NO: 16112 - DNA, 336 bp, Glycine max
  Peptide Sequence Number=SeqID_107797
atgcctaggcaggcgcagggtgatgcacctcaggccacagacgcaccgccaccacctcatcaggctgatcccactgggtcattaggtatggagcggtatctacagcacttggttcgccagcaggcggccaaccaccaggggcaggtgcagatacatgagtgtctctaccagctcggcctcaatcactttagggctgaggtcgcatggcccggagattggcccgaggcccaggcaagggaggcgcctgcaggagctcccggcgatgcagaggaggcccgcatggatgaggagatgacagaccttctcggtttcttgggaggaagcggagccacgtga

SEQ ID NO: 16113 - DNA, 294 bp, Glycine max
  Peptide Sequence Number=SeqID_107798
atgacgactctttgcaaatccagaagaaaggtatcaaagggcaataattgtcaattttgtgaaatcaaaacatttccaaagggattgcctaaagtggaaaacaagcaaaacatacaaagaaaggagctacaagaagcactcagcttcttgaaattgtgcatactgatatttgtggaccttttgatgttagttctttcggaaaggaatgatactttatcaccattattgatgattattcacgttacggttatgtctacttactgcccgagatttcttaggcaatggatgccttag

SEQ ID NO: 16114 - DNA, 493 bp, Glycine max
  Peptide Sequence Number=SeqID_107799
atgagtcatcattcaactagtgttaatgatgagggtactagtcataaggaccctctatctagaatcttagatgagttgagttctctcaagttatggaaagaaaaacaagagagaaaagaaaaaggaaaaaaaagagtggaagaaataagtcaagatgaaagagagaaaataagagaggaagaaagaagaaaaataataaaagagatgaaaagagaaaaacatgcctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaagtctacttcaaaatcttatggctctcactcttatccaaagaaagaccaag

SEQ ID NO: 16115 - DNA, 417 bp, Glycine max
  Peptide Sequence Number=SeqID_107800
atggcgaatttcgaatctgactacacaagaaagttagagaaacctctatcagtcgcaagcttgattccaatagcaatggccccgagttccgcaagattgaccaagaaagctaacatgacaagaccattgtgcgaaatggagacatcgcagatcaacttaaaactgttctctggaggagcttcccaacagatggaggagtgtttcagtcaatcaaaaaatcattataatacacaaactgaaacttctctcatcagcactaattcactaattaatatttattgtcgtgtcttgttaccaataccacaccgtcgttctctctccttcgcatgtgacaccactattagcgtcttcctctctcactccttattagcatgtgacatcgttgccaccttcattctttcttgtgaccacgtgtga

SEQ ID NO: 16116 - DNA, 120 bp, Glycine max
  Peptide Sequence Number=SeqID_107801
atgtgggtgtcaaggaagcggtttccagcagatttcaggcgggaggagaaagagaagagcgatttcaggcaggaggatgacaaagagaagagggagggcaagttaacatcggttttgtaa

SEQ ID NO: 16117 - DNA, 738 bp, Glycine max
  Peptide Sequence Number=SeqID_107802
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcacttatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16118 - DNA, 255 bp, Glycine max
  Peptide Sequence Number=SeqID_107803
atgtggggtgctaataccttccctgtgtgtaaatacaactcccgagcctttcacttaaagttcgtagaccacgtctttttccggtttttccgaagtttacctcaaataaacgttggtggcgactccgcgcgtattcctttcttggaagacgcacccgtgagtcacgcgtcgccctcccaccgaaggcgggatcagcctgatgaggcggtggcggtgcgtctgcggcctgatgtgcatcaccctacgcctgcctag

SEQ ID NO: 16119 - DNA, 387 bp, Glycine max
  Peptide Sequence Number=SeqID_107804
gtcctcaccttcaaaggactacatgtcctcaccttcagagggctacacgtcattaccttcaaaggactacatgccctcgccttcagaggactacacgtccttaccttcggaggactacacgtcctcgccttcagaaaactacacctcctccacttcagaggactacacgtcctcgctttcagagggctacacgctcttgccttcagtgggctccatatccacaccttaatagaatttaaggtcctctgcccggcgccaactgtgcgaatacaaccagagagagaggctatcacgcagctactatgcataccagggcaagatttcacccgtgccactgcaaagagacgagtgcggatcatgcgcaccaacatgaccactcttacatag

SEQ ID NO: 16120 - DNA, 99 bp, Glycine max
  Peptide Sequence Number=SeqID_107805
atgtctaggaatctcgccagatggcggtccttatctttcttggaaggagatctatgcatacaaaatactgacagcaatagcggttatccaattcaataa

SEQ ID NO: 16121 - DNA, 157 bp, Glycine max
  Peptide Sequence Number=SeqID_107806
ggcgagaaagttgctagtgcacaggattttggttggccatcaaagggagaggaccacttcaggtcgtggtttcttttctttccttatttggtggtgacaattctgcatcgttcagatatcaagcttatcgataccgtcgacctcgagggggggcccg

SEQ ID NO: 16122 - DNA, 243 bp, Glycine max
  Peptide Sequence Number=SeqID_107807
atgattattatctcatgtcaatggaaggaaagggtcacaatgcacactgaaaagggtcatgaaaattcaaaaaggtctacaatggtgatgaaggatgaaaggaggatcgccaaagacaaaaagctgttgggaatcattcgaaactctcctgtggttcttcagaaggtgagaaaacttagaagattctgcaatgagtctcactgtgttttcggcaagctcaacctagattactcaatttcctga

SEQ ID NO: 16123 - DNA, 202 bp, Glycine max
  Peptide Sequence Number=SeqID_107808
ggcttcacggtatcaacagggacaccaggatttatttattctgcgaagtgatattccgtcacagtggcttccgtttctatcagctgtccctcctgttcagttacggacggggtggtgcgtaacggcaaaagcaccgccggacattagcgctggcaagtgtagcggtcacgctgcgcgtaaacaccacacccgccgcgcttaa

SEQ ID NO: 16124 - DNA, 391 bp, Glycine max
  Peptide Sequence Number=SeqID_107809
ggatcgcgcccacaagacgcccagtaggcccgaagaagtccaacagggccctggggtttccggctctggttacgggcctctgtcagtcctacagggtgcccgttcccccagcgaggaatcgcacccacaaagacacccagtggacccggagaagtccaatagggacctggggtttccagctctggttacgggcctctgtagtcctaccgggtgcccgttcccccgggcaaggtcatgtcatcatgacataggtaagtatgcacctgcaagacacccagtggactcgaagaagtccaacaaagtcttggagttgtcaagctctaattatgggtttctatcagttctacggagtacctgtcacctccagcaagggcatcaggccccctactaa

SEQ ID NO: 16125 - DNA, 48 bp, Glycine max
  Peptide Sequence Number=SeqID_107810
atggagaattgcactaagcagtcactacgcatggctccaaactcgaag

SEQ ID NO: 16126 - DNA, 555 bp, Glycine max
  Peptide Sequence Number=SeqID_107811
atggtccgtattgagcaggcggcagaggggctggactgcccgcgctcgctgtccaactccgcagcaacgctgtggcatcctgaggcgcattacaactgggtgcgtccggggatcgtactgtacggtgcgtcaccctcaggccagtggcaggatattgccaacagcggcctgaaaccggtgatgacgttgcgcagtgaaatcattggcgtgcagacgctgaaggccggcgacacggtgggctacggcagccgctaccgggcgacgggtgagcagcggattggtattgtggcaggcggctatgctgacggctatccgcgcatcgccccgaccgggacgccggtatgggttgatggcgtccgcacgggaacggtgggcaccgtttcgatggatatgctggccgttgacctgacgccatgcccgcaggcgggcatcggctcaccggtcgagctgtggggtaacgaaatcaaaattgatgacgtggccgccgcggcggggacggtagggtatgaactgatgtgcgcgctggcaccgagagtgcctgttgtgacggtgtga

SEQ ID NO: 16127 - DNA, 930 bp, Glycine max
  Peptide Sequence Number=SeqID_107812
gcgaaagtcttggcaagtcaaggcgaatgggccccgttcattgacatcctggcacttttgatctttggggtggtcctctttccaaatgtggatgggttggtggaccgggcagcgattgatgcttttctcacctttcatgaccgcaaggaaagcccagttgtcactatcttagcagatctatatgacacctttgaccgaagatgtgagaagaacagtgcaaggatcgtttgttgtacaccggccctctacgtatggttggtttcacaccttttccgccaagagtttccccgatggaaagaaggaagaaccgggattcttatttcgtgcggaggatttccaaatgttcccttgatggggacaaggggttgcattaattacaatcccatcctcgccatgagacaacttggctaccctatgagaggggcaccactagaggaaagcctcacacctattattgcacgaggtttcaatagcaccaacgcgggggtttttcagaaggtccgcaaggcatgggagatggtgcaaaagaaggacaaggaacttaaaggcagtagcaacgggcccatcggcggctaccataggtggttgaaagcctacgcacaaggtcttgattggctcccgaatttgagaaccactaagagggtggaggttgaaactctggaagaagacgaagagatacaagtcctcaagacagaacttgagaaagcccaaacagtcaaagaaaagttcaagtcagcagctgttaggatccgaaaggagaacgccgaactgagagacatcaatatagccaccgccaaggccttagaacaagagaccaagagggcccatagggaagaacatggtcggaacaaattccgaggggctttgtggggcagtaacagcgagcttaagctccgaagaaaggaaaaggaccaatcggggatcctctag

SEQ ID NO: 16128 - DNA, 363 bp, Glycine max
  Peptide Sequence Number=SeqID_107813
atggctcaaatacaaccaacaattctcctaatgaatgctctaaattgggcaactgtgtatcaggcttcgggggttggagagtgtaggatgtatactaggcggaaaaaacaaaaaacaagtgttgctgctgcccaaactactaaaaaacaggcaatggttgttggatcttcatcaaggaagcaaaaagcagtccaagaaaatgatgaggatctagatgttgaggagaatattgatgttgaatctgaagaagaagaaatcatggtcaattttgaggcgtctgatggggaagagggagagggagatgctccattaccatatgataacaacgaagatgattatgttgggattggagaagatgattag

SEQ ID NO: 16129 - DNA, 171 bp, Glycine max
  Peptide Sequence Number=SeqID_107814
atgagggccattgaaggaggagaaaattatgccttttttgacatggcagagttgtacttggtactcgatgtggttattcctctgaagttcaaggtgccagattttgataaatacaaatggaatggagaaggaagaaagatgattggagatcccacttcaaggagaagatga

SEQ ID NO: 16130 - DNA, 375 bp, Glycine max
  Peptide Sequence Number=SeqID_107815
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaacccccgttcagtccgaccgctgcgccttatccg

SEQ ID NO: 16131 - DNA, 360 bp, Glycine max
  Peptide Sequence Number=SeqID_107816
atggacccagtcaagtacatctctgagaagcccgctctcacggggcggatcgctcggtggcaggttttgctattcgagtttgacatagtctacttcacccaaaagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16132 - DNA, 866 bp, Glycine max
  Peptide Sequence Number=SeqID_107817
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgcgattcatccaaaaaacacgggaaaacgtgatcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16133 - DNA, 313 bp, Glycine max
  Peptide Sequence Number=SeqID_107818
gctgccgtcccttgtgacggacgtgtggggtgctaataccttccccgcgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccaccgaagggtaggttgcgacacctactccggaccagttcagggcagaggtcgcatggcctggagattggcctgaggcctaggcaggagaggcaccaacaggggcaccagtag

SEQ ID NO: 16134 - DNA, 513 bp, Glycine max
  Peptide Sequence Number=SeqID_107819
atgtttatgccagatacatttctccctgtgaagctgcttggagaatttttggttttccaatacatgctaggaagcctgctgttgaaagattatatatccatcttccaggccaacacagtgttctttatgaggaccatgaaagaaggatacaatattggaaggcttatatgggtcccaccaacgacaggagaattgttttatttgaggatgatgcttactgcctgcaaaggagcaacttcatttgaggatattagaactgttacaaatattcaataccctacatgtagagaagcatgctttgccatggggtttttacaatatgacaaagaattcattgaagcaatcaaagaggcaaaggactggggcacgactaattatttgaggaaattatttgtgttgatgcttttaacaggtgccatcaataaagctgaagaagtttggaaccaaacttggcattggctagctgatgacattgcatatcattatagcaaatcaacaataaatacaaattag

SEQ ID NO: 16135 - DNA, 318 bp, Glycine max
  Peptide Sequence Number=SeqID_107820
atgactcactataatccttaccctcggaagcaaaaaaggaaagaaggaaaatttccaatcaaagagaaagcaaaaagaaaagaaaagaaattcccaatcaaagagtgggggaaagagaaaaaaagagagggaaggaaaatttccaatcaaaggaaaaaagaaagaaaggaaattcccaatcagagagtgggagaaagaaaaaagaaaagaaagaaaattcccaaccaaagaatgggagaaagtaaaaaagaaggaagctcctggtcaaagaaaccagaagaaatgtgcagagaggtctttggaccagacaatatctga

SEQ ID NO: 16136 - DNA, 854 bp, Glycine max
  Peptide Sequence Number=SeqID_107821
atggggacaaatcaaaacggcaaaaggttttatcaagtcaaggttaaaagtctagatgtcactagcctcaaggaattgggacgattgatgggacctctccaaaggcaagccttccgcaaagtctacgggaagattctagatttgaccgtagcggaggtatttacggaagctgtcgtatccctcgcccaatactatgaccagccgttgaggtgtttcacgtttggggacttccaaatgagcaagattgcagctgtggttggagattcagcaaaagagttggatcgcatgaagcaaactcgtaatgacatagtggtcctgcctcggaaatacttggaagttgtcctctttccgaacgtggacggtttggtggacttagccaccattgacgccttcctcgcgtatcaccacagcaaggagagtccagtggaaggcaaggaaggagttctcttctcatgtggggactaccctaatgttccattgatagggactaggggttgtattaattataatcctgcactcgccataagacagctagggtaccccatgaggggagcgccaaccgaagaaagtctctcgcctttccttgtgagggatctaggcgcgcaaagtctccaggtgatacaaagagtccacaaggcgtgtagaagtccgttgaagaaagacaaggagcttagaggcatccgaaacggcgtcatcggtggtaatcatggatggctaagagttcacacgcgagggttagattggctctccaaattgaaagttatcaatgaggagaacttcgaagctctggaggaagatgaagaagtccaagctctcaaattagatctagggaaggcgagactcgccaaggagaa

SEQ ID NO: 16137 - DNA, 297 bp, Glycine max
  Peptide Sequence Number=SeqID_107822
atggccaagtttgatccggatatagttatcgagttttatgccaatgcttggcctacagaggagggcaagtgcgaatacggtcagaggaggaaccgggccaatggatttgacgaggaggccattgctcaactgctatgcataccaggtcaggattttgcccggaccgctgccgggaggcgggtgcggatgatgcacaccaacatgactaccctgacccagacatggatgacgttgcttctcagcaacatcctgcccagcgatcataattctgacctccctctgtcgaagtgtcagctg

SEQ ID NO: 16138 - DNA, 402 bp, Glycine max
  Peptide Sequence Number=SeqID_107823
atggtgaaagttggaacctcttacgtgccgatcaacgtctcattttccaaaagttggcccagcttcccggtatcaacagggacaccaaaatcggatttatttttggagactagtccgtcacatcatcagcttattgcgcaaatgagggttaatttcgagctccagtggcgtatctggtttctatcagctgtcttcctgttcagtgattgttacggggtggtgcgtaattcggcaaaagcaccagccggacatcagcgcggcaagtgtaaagccggggtgctgagtgagctaaccaccacacccgccgcgcttaattgcgttgccgctacagggcgctgcccattcgccatttcaggctgcgcaactgttgggaaacgggcgtcggtgcgcctcttgcattaa

SEQ ID NO: 16139 - DNA, 795 bp, Glycine max
  Peptide Sequence Number=SeqID_107824
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttccgg

SEQ ID NO: 16140 - DNA, 465 bp, Glycine max
  Peptide Sequence Number=SeqID_107825
atgggtgctaccctaatggccacaacctccatcctcctatgctcaggcctagcagcagtgataagcagcacctacagtgtgaagaagccactcaatgatgcagtcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16141 - DNA, 791 bp, Glycine max
  Peptide Sequence Number=SeqID_107826
gcttaccggcgacggcggagcgtattcgcgatctggtgacggtacagggcgtgcgcgataacgccttaatcggctacggcctggtggtggggctcgacggctccggcgaccagaccatgcaaacgccgttcaccacccaaagcctgagcaacatgctatcgcagctcggcattaccgtgccgccgggcaccaacatgcagcttaagaacgtcgctgcggtgatggtcacggcgaagctgccgcctttcgcgcgtgcggggcagaatatcgatgtggtggtctcatcaatgggcaacgctaaaagcctgcgcggcgggaccttgctgatgacaccgctcaaaggggtggataaccaggtttatgcgctggcgcagggcaacgtgctggtgggcggcgccggcgcggcggcgggcggcagcagcgtacaggtcaatcagttggccggcggacgcatcagcaacggcgccaccatcgagcgcgaactgccgactactttcggcagcggcggggtgctcaacctgcagctcaatgatgaagatttcacccttgcgcagcagattagcgatgcgattaaccgccagcgcggcggcggcaccgcatcgccgctcgatgcgcgcaccattcaggtactggtgccgcagggcaatagctcgcaggtgcgtttccttgccgagatccagaatatcaacgttaacgttggcgccatggacgccaaagtgatcatcaactcgcgtaccggttcagtggtgatgaatcgcgaggtgatccttgactcctgcgcggtggctcag

SEQ ID NO: 16142 - DNA, 510 bp, Glycine max
  Peptide Sequence Number=SeqID_107827
atggcccgagttatgttggggaacggttacgaacccggaatgggtttaggcaaagacaacggcggcataactagcctgataaatgccaaaggaaatcgtgggaagtatggtttaggctataagcccactcaggcagatataaagagaaacatcgcgggaaggaagagcggtggtcaaagctcgcggttgagacaagaaagtgaaggaagcccgccctgccacataagtagaagctttataagcgcgggtctgggagacgaaggtcaagtggtcgcgatatacgaagatgatgttccgagtacattggatttggatctttcttcatctgttcctacgtctctacccattctcatccatttgcatgtttacttctttatttctgaaacggcagatccgatgacgagtcccccgaaggtactaatacctgggacccgcctatcaacttcgagcaagaaacgaatcaaacggaagatgaagggaacgaggatgtgggacttcccccagaattag

SEQ ID NO: 16143 - DNA, 623 bp, Glycine max
  Peptide Sequence Number=SeqID_107828
gggcaccactcgaggaagagatcacgcctgtcatttcacgaggtttcaataagaccaacgtggagacacttcagaaggtctgcaaggcatgggaggtggtgcgaaggaaggacaaaaaactcaggggtagtaacaatgggcccatcggtggctaccgtaagtggttgagagcccacgtgcaaggtttggattggctcccaagtttgagaaccactaaaaggaaggaagttgaggcaccggaggatgatgaagaggtgcaggcccttaggacagaactcaagcaaactcaaacagtcaaagaaaggttcaaatcagcagctctaaagatccgaaaggagaatgccgaactgagagatataaatacagctaccaccaaagccttggaacaagagaccaagagggcttgtagggaagagcacggccggaacaagagtgcaagagtagaggaaggccaacatggaggccatgaaagagcaaatgaccacaatgatggaggccatgatgagcatgaagaagataatggaagccaatgcggtgccgttgccgctaccagcgctattgctaaggtgaacccgatgcccccatctggcctcaaccaaatgaatcatccaacctcagctagg

SEQ ID NO: 16144 - DNA, 285 bp, Glycine max
  Peptide Sequence Number=SeqID_107829
atggccctcaatcatacacccgagtcaaaagttacgccgtttgaatttatcaaaagcttctgttgttcaatttcgtgtgtctcgatatatgatgaggacatgaccaagagcaaggacaaggatccacttgaaggacttggaggacctatgacaagggctagagcaaggaaagccaaggaaactcttcaacaagtgttgtccatactatttgaatacaagcccaagtttcaaggagaaaagtccaaggttgtgagttgtaccatggcccaaatggaggaggactaa

SEQ ID NO: 16145 - DNA, 249 bp, Glycine max
  Peptide Sequence Number=SeqID_107830
atggagaaatctgaaaagaaaagttttagtgaaaagaaggtgaagaaggcctacatcacacgagatgacaatgatatggaatcatatgaggattcagaaaatgaagtgataaacctgtgtctaatggctaaaagttatgaaagtgatgaagaggtaacatcttcaaataacaacttatccatttcttttgatgaattacaagatgcatttactgatttacaaagagaatcaatcaaacttgcaaagtaa

SEQ ID NO: 16146 - DNA, 165 bp, Glycine max
  Peptide Sequence Number=SeqID_107831
atgaccctcaggcgtaaggattttcaagtgcaagccattggtcagtttgctcaagcgacctgtgctcctgagtttggacttccaagaccgttcaatcagagattactcgtcttgcacgttggtgggggttgccgtaaaacaatgagtaaagttcaaaacaaataa

SEQ ID NO: 16147 - DNA, 486 bp, Glycine max
  Peptide Sequence Number=SeqID_107832
atgtcttccaaggttattttgatgatgccaaagactcaagagtcaagcaaaatccaaagattcaagaatcaagtttcaataatcaagattcaagattcgagaatcaagtttcaagaatcaagattcaaaaataatcaagatcaagattcaagactcaagattcaagaatcaagagaagactcaatcaagataaggtacatcctttgtggtacaagtagagggtacatctacttggggattgttatactgagaacaagagagggtacatctcttgtggatcagttcaagtggagggtacatccgcttggtttttcaaagagaacaagggatggtacatcccttgtggatctttggcttttaaaggattttacaaggttgaaagaaatctcggaaactgcaggttgcttggggactggatgtaggtacggtttgtggccgaaccagtataaatcttgtatttgtcttcttcttccctatactctttaa

SEQ ID NO: 16148 - DNA, 357 bp, Glycine max
  Peptide Sequence Number=SeqID_107833
atggcgagatctgcgccggatgttgttgcaacagccgacgcaggagtaacccactcagctaaatttttctgccatttcgccaagtatctgttcgcaccaggcctgcaggcgctcgtcgctgagatcgtactgattggtttcatccagggcgagtccgacaaacagctggccgtcggcaatgatcggtttttgactggtgaactcgtatccttcggttggccagtagccgataaacgtcgcccctttcggtaccagtttgtcatgcagcatgccaagtgcatcaagaaaccattcgccgtagcccaactgatcgcccatgccgtacatcgcaatgattttgccgtcgagattgactga

SEQ ID NO: 16149 - DNA, 174 bp, Glycine max
  Peptide Sequence Number=SeqID_107834
atgggggtgcaaatagcacccaggcccacttgggccctccacccccctcctccagaaggctccgaggcgcttccgaaacgtttccataacgttttccgtgaggaatttcgcaaagatttcaaccgttcttcgacgttcttcattcgttcttcatcgttcttcgatcttcaacgg

SEQ ID NO: 16150 - DNA, 153 bp, Glycine max
  Peptide Sequence Number=SeqID_107835
atgtttgagaggttgttattagaatttaaatttggctgccccatgaggaataccttgcacctaggtagcatggaaaatacctttcaacggaatggccccgaggaagcttgcctcaaagaggtccaggaaggacaaggcggccgaaggaactag

SEQ ID NO: 16151 - DNA, 549 bp, Glycine max
  Peptide Sequence Number=SeqID_107836
atgacattgctagttagcaatattctgcccagcgaccgcaatgccaatctccccctgcaaaagtatcagttggtctgtgtcgtcccgacatgggtagggatcgcacccacaagacacccagtggacctggaaaagtccaacagggccctggggtttccagctctggttacgggcctctatcagtcctacagggtgcccgtacccccccggcaaggtcacgtcatcatagggatcgcgcctgcaagacacccagtggacccgaagaaatccaacagggtcttggagttgtcaagctctaattacgggtctctggcatcaggcccccctaccaatcgagctttcatcaagaagtgctgcgcccccaggcaggcgcagggcgaaacaccacaacagcattgggatggccggcagcaggcaacagacgcaccgccatcacctctagagttcacctctgctcatccacaaaaaggtttgagtattgcctacacaacatggccgaccaataggcgaccaagtccaaagccaaatgacgcacctagttgctcatga

SEQ ID NO: 16152 - DNA, 564 bp, Glycine max
  Peptide Sequence Number=SeqID_107837
atgagtaggagggcgcggcggtcgctgcaaaacccagggcgcgagcccgggcggagcggtcgtcggtgcagatcttggtgcctgcccatcctggaaacggctcaacgggaggtagggtcctgcggctggaagagcaccgcacgtcgcgtgttgtccggtgcgcccccggttgcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgatcccgtcggctgtcggtggactgctcgagctgcttccgcggcgagagcgcgtcgtcgcgtgccggtcgggggacggattgggaacgggcccttcggggcctcttccccgggcgtcgaacagtcaactcagaactgcggggcactgcccctcttttcggacccaaggtcggcttcggccggtcgatccgggcggaagacattgtcaggtggggagtttggctggggcggcacatccgttaa

SEQ ID NO: 16153 - DNA, 804 bp, Glycine max
  Peptide Sequence Number=SeqID_107838
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacggcactgccgacggcactgccacccggatcctgcagctgctgcaggaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16154 - DNA, 111 bp, Glycine max
  Peptide Sequence Number=SeqID_107839
atgtgggaaggttgcgacctgatcagtggctccagaatcaaggatctactcatcttggctagtcttgctaacactacaacaatgacatcaaggctttatattgttgagtag

SEQ ID NO: 16155 - DNA, 701 bp, Glycine max
  Peptide Sequence Number=SeqID_107840
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcggttgatgtttgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16156 - DNA, 860 bp, Glycine max
  Peptide Sequence Number=SeqID_107841
atggtgaaagttggaactctacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaatgcacatcagtctttgaaaggccacggattacatataagggttcctgttattctcttgtcacttagatccccctcagttgtgttcctggggcaggcagaactcaccagcacccggtgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16157 - DNA, 824 bp, Glycine max
  Peptide Sequence Number=SeqID_107842
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataatatatggatacaagcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16158 - DNA, 414 bp, Glycine max
  Peptide Sequence Number=SeqID_107843
atggggttagtcttagagctgaatcccaacactttgctactacaaatgatgacaatccatgcctggtgtccatgccttactttggagtcattgaagaaatctaggagcttaattatgttaaattcatttacatggctacaccaccgagctcctatcctcctgaatttcatattctggaagcatcctgtcgcaacgtgcccttcgcgggcgagcgagggcgaggctcacgggtgcgctttccaaaggaggaaagatgcgcggagtcgccaccaacgtttatttgtggaaaacgtcggaaaaaaccgaaggaaaccggtcaaaatgaaaattctaagttcgggagttgtatttacgcttgaggaaggtattagcacctctcacgtttgtctcaaaggacaacagcctattttttag

SEQ ID NO: 16159 - DNA, 342 bp, Glycine max
  Peptide Sequence Number=SeqID_107844
atgattatgaggggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggagggacccattagtgatcaaggggttcccatgaaccctaagagaataaaggtcattcctgagtggcccactccaccaacaccactcattgagttggtgaggaaccatgttccttcatgcaaagatacccaggaaatgggggtgttgaggaaaaaagcccagagtttcaaaaacctcgggatttga

SEQ ID NO: 16160 - DNA, 815 bp, Glycine max
  Peptide Sequence Number=SeqID_107845
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatactcccaagtggtaatatggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16161 - DNA, 297 bp, Glycine max
  Peptide Sequence Number=SeqID_107846
taacctagctcgcctgggcgagctagatggccaccacaccccccgtgttgttgaaaaatgggattccggggcttccgggacacccgtaatgcttccgaagcaacccagctcgcctgggcgagctaaggtcgcctgggtgagctgggcggcaacctcctcccccttttttcctataaataggctgaagggggctgttctaaagatccctcagccccctggctatgtatttcagctcaaatccgtgaaggttttcgtccgttcttcatcgttcttcatccgttcttcgttcttcaacgg

SEQ ID NO: 16162 - DNA, 267 bp, Glycine max
  Peptide Sequence Number=SeqID_107847
atgttaacgtatttcctttataaccttcatcttctcttccacctgaaagtttctgaaatctcattcttgaactcacgacttttccctcacgccgatgatcctcttcttcaagaaacatcgtttgagctcgtggagcatcgattgagtgcaggcgtagggggacatgcagaattgcaccctccagtcaggggagtagccgtcactgcctatcacgcgacagagatgcttgccgatgcggagggcctgggccatgccttgcactgttga

SEQ ID NO: 16163 - DNA, 129 bp, Glycine max
  Peptide Sequence Number=SeqID_107848
atggataagagcttgaaggtaggagaagatgagtggaaggagagggagggaggggggcatgaaatttatgcctcaaataagcccactaatccaagatcaagtcaaagattctccactaagtgtgcttag

SEQ ID NO: 16164 - DNA, 615 bp, Glycine max
  Peptide Sequence Number=SeqID_107849
atggtagtacgagcctttgacggtagtcggcgggaggtgatgggggaaattgacatccccattcagataggcccccacacttgcaatgtgtcaggcgaagaaaatatgttggtgagctgcccctcttccacgctatatgtagaagcagcggaggaatcattggaaacagctttccaatccttcgagatggtgagttgtgcctctatggaaatgagtccattgctaccttgtctctctaatgcggccctaatggtggtgcgagtaatgctcatgcacgcttatgagcccggaatgggtccgggcaaggacagccatgggaatgccgatgtggtcgacattaagggtaacccgtacaaatatgggttggggtatgaaaccgggaaaccgcgaagaaggaatgcaccgtcaagactccgggcagataggacatggcccggtcatgttatccagtgtttcacaagtgccgggataatgttcgaggaagaggtggcggcaatagcagaggaatctccacaagatccgccaagtttcgtgcgaccgtgccatgccaattcccaaatggggaactggcgcgtgatgagccagtcggaagcctataccactgattcaatgtaa

SEQ ID NO: 16165 - DNA, 423 bp, Glycine max
  Peptide Sequence Number=SeqID_107850
atggttctttgggagctgatggtaagacaccaacttcatatgattacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16166 - DNA, 306 bp, Glycine max
  Peptide Sequence Number=SeqID_107851
atggcgtggagccgccggatgctcggcaccacccagcgtattctggtagaaggtacatcgcgtaagagcatcatggagctttccgggcgtacggaaaataaccgcgtggtcaacttcgaaggcacgccggatatgatcggtaaattcgtcgatgtagaaattaccgacgtctacccgaactctctgcgcggtaaagtggtgcgtactgaagatgaaatgggtctgcgcgtggcagaaacaccggaatcagtgattgcccgtacccgcaaagaaaacgaccttggcgtgggttattatcagccgtaa

SEQ ID NO: 16167 - DNA, 345 bp, Glycine max
  Peptide Sequence Number=SeqID_107852
atggccttccagtacccggtcgccatccccggcgtgacgatcgtcaatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16168 - DNA, 770 bp, Glycine max
  Peptide Sequence Number=SeqID_107853
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 16169 - DNA, 654 bp, Glycine max
  Peptide Sequence Number=SeqID_107854
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16170 - DNA, 201 bp, Glycine max
  Peptide Sequence Number=SeqID_107855
atggctgaaagaggaggagaaggaaatagaccaccgaggaggactttgggtgactatgcttatcaacaaggcccaaaacattacaacatcatagcaattcctcctttcagcaataaagtcgtggaattaaagccagcactgcttagtccaattggctcacatccctttgctggaatggatcatgaggatccatacacacat

SEQ ID NO: 16171 - DNA, 591 bp, Glycine max
  Peptide Sequence Number=SeqID_107856
atgaccactcttacatggatatggatgacgtcgctatttagcaacattctgcccagcgaccacaatgccaatctccccctacagatgtatcggttgggatcgcgcccacaagacgcccagtgggcccgaagaagtccaacaaggccctggggtttccagctctggttacgggcctctgtagtcctacaaggtgcccgtccccccagcgaggaatcgcgcccacaagacgcccagtgggcccgaagaagtccaacagggccctggggtttccagctctggttacaggcctctgtctgtcctacagggtgcccgttccccccgacaaggtcacgtcatcatagggatcacgcctgcaaaacacccagtggacccgaagaagtccaacaaggtcttggagttttctacggagttcttgtcacctccggcaagggcatcaggccccctactaatcgagctttcatcaagaagtactgcgtccccaggcaggcgcagggtgaaacaccacagcagcctggggatggccggcagcgggcaacagacgcactgccatcacctctagagttcacctcagctcatccacaaaaaggttag

SEQ ID NO: 16172 - DNA, 393 bp, Glycine max
  Peptide Sequence Number=SeqID_107857
atgtggatggatcggtttgctcttaccttgaacgggagtcaagaacttccccgattgttagccaaggccaaggcgatggcggacacctactccgcccccgaagaaattcatgggcttctcggctattggaataacaccataactaaacgcgccacaaggcatccctatcgcaccagatccaaatctagaatgatgggtgatcaagaggagacacaggaacagatgaaagccgacatgtcagctctgaaagaacagatggcttccatgatggaggccatgttaggaatgaggcagctcatagagaaaaatgtggccaccgctgccgctgtcagttcggctgccgaagcaaacccaactctcttggcaattgcgcaccatcctccctcaaacata

SEQ ID NO: 16173 - DNA, 225 bp, Glycine max
  Peptide Sequence Number=SeqID_107858
atgcatgtagagaaaaatgtctgtgatagtgtcattgggactctccttaacattcaaggcaagatgaaagatggtttgaatacttgtcaagatctagctcagatgggatttgacgatactccacagagtaaatccaaggctgttgctaggtggattgttgttaaatatttcaatgatgccagaccattggaaccaaagacattgaaggcgcttcgcatccagtga

SEQ ID NO: 16174 - DNA, 653 bp, Glycine max
  Peptide Sequence Number=SeqID_107859
cgacaccatcggctcctggaagatcatcgcgattttgttgccgcgaatgccgcgcagggtctgttcgtcggcgtgcagcagcgaacggccgtgaaagagaatatccccttgcgggtagctcactggcggagaaggcagcagccgcaggatggagagcgccgaaacgctcttgcctgaacccgattcacccaccagggccagcgtttcaccgcgctggatctgcagcgtcaggggctgggtcatcttataccgccttgttcggatcaaaggcatcgcgcacggcttcgccaataaaaatcagcagcgacagcagcacggccacggaaagaaaggcggcgatgcctaaccacggcgcctgcaggttgttcttgccctgcagcagcagttcgccaagcgatggggaacccaacggtaacccgaaaccgagaaaatccagtgaggtgagggtggtgatggagctacacagaataaacggcaggaaggtgagcgttgccaccacggcaaactcggcccttaccacaccgaccagcgccatccagccgaacaggacggtgatgcctaatagccaccagaagttgggctgtacgacgctggaaagcaggatgatcagaaacagcgtcggcatgcctgaccagacttcaataatccgctga

SEQ ID NO: 16175 - DNA, 830 bp, Glycine max
  Peptide Sequence Number=SeqID_107860
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaccatcaatgcagatgcgaggaagattgttggctgtgctagccatagcagatccagtaagattcgaatcagcaagtgtgattgttgcattggagaaacgggggatcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16176 - DNA, 285 bp, Glycine max
  Peptide Sequence Number=SeqID_107861
atggcggaggagcaaggtgaattcaggatttacaattccatgactcagcagaaagagatcttcaaaaccaaagtccccggcaaggtttccatgtacgtttgcggagtcactgcctacgacttcagccatctcggtcacgctcgcgctgcggtttctttcgatatcctcttcaggtaccttaagcacttgggctatgagattacatatgtgcggaatttcactgatgttgatgacaaggccatatgtacttatgtagtagcagtagcagtggcgtttcctagttaa

SEQ ID NO: 16177 - DNA, 168 bp, Glycine max
  Peptide Sequence Number=SeqID_107862
atggctcattatggtattcttgaatcatcggatgaggagatcaagagtgctttgcaacattggaggttcttgttcatcaaaagtgcttatgaggagaacaatagtgctttggttcaaatatcggaggttcttgttcatcaaaagttcttatttgcagtgctcttatga

SEQ ID NO: 16178 - DNA, 438 bp, Glycine max
  Peptide Sequence Number=SeqID_107863
atgaggctgctacaacgagcccagctagcagcgaaaactatacgtgcggttagacatagcaatgagcgggtcggatacgggtattgtctccccaatcccttatcccgactcctcaacatattcctataccggtacctgatatccgacgggtttgagtttatcgacgggtttgagtttattgtcccatcctcgtacccgtcgggtacccgtcagattttaagtggcgggcgggttcgggttcggggtcgagacggatctagtaatctcatacccgtatctgtacccgacttttggttatcgggaaaaacccgaacccgtacccatacccgatcaactcgggtattacccgtcaaagtcgggacggattcgggcgggtacccacaaatacgagttttctttgccatatctacgtgcggtgataaatccataaatatctga

SEQ ID NO: 16179 - DNA, 246 bp, Glycine max
  Peptide Sequence Number=SeqID_107864
atgggtaaaaagccacagtcggggcgttctgttgtagtaaaggggaaactgatattgccaagatctccacaagaaagcagaggtggacaagccgccgccaatagaagtggcataagaaagatatcacaggggaagggtcccgagtccacaagagtttggaaatgcagtgggcctctgaggttgaaatacttaaaaagaggcagaaaaaaagagtaccgaatgacgttgaaagagtgtgggaaataa

SEQ ID NO: 16180 - DNA, 1287 bp, Glycine max
  Peptide Sequence Number=SeqID_107865
atgttgggtactgggttgaacttcgggcgcgctcgcggcgaggatcggttctattctccggcaaaggctcgccggtcgcttctaactatggagaatgacaagctgcgtagggcccaaagcgacgttgccgcgtctcgctccgttagagacaaatcggtggattcgggtaaccggataccggagaaccgggtcgggtcggacgaggcaaagaagagtggcgcggttccttcgtgtgaaccggtggcgaaccggttgagtaatctggagcggttcttgcaggcgatcacaccctccgtgcctgctcagtgtctgcctaagaggacgacaagaggactcagggcgtgtggggcggagtttcagccttacttcgttctcggggatttgtgggaatcctttcgggaatggagtgcttatggcgcaggagtgccacttgtactgaatgacaaggatagtgttgttcagtactatgttccgtatctgtctgggatccaaatttattcccagaatgtgaagccaactgtaaagtcaaggcaactgggggaggatagtgacagtgattttagggactcaagtagtgatggtagcagtgatagtgaacctgtacatggaaggggattgaggaatcttccccatctgttagaagaggtgcctcaatggatgggcggattatctttgagagaccaccattcccttccaccagatgggttttctagtgatgatggagaatctgtcaattctcagggttacttgatttttgagtatcttgaacgggaccctccttacagccgtgagcctttggctgataagataatggatcttgcttttcaattccctgaactggtgacccttagaagttgtgatatactaccatcaagttggatatctgtagcctggtatccaatttacaggataccaactggtccaacattaaaagatctcgatgcttgttttctgacataccattctctttatatgcccatgggaggttcacaaagagtccaggctcccatgccacatcctactgagatggacaatgtccataaaatgtctttacctgtttttggtcttgcttcatataagttcaaaggatctctgtggactcctaatggtggacacgaatgccagcggtctcttttgcagggtgctgatgactggttaagactgcatcaaatggccatacttgatgaagttggagttaataacataattgacagaaggaagatgaaaaatggagaaaagatgtttagcactgtccttggtaattttctgtatcgtttccttccgtaa

SEQ ID NO: 16181 - DNA, 150 bp, Glycine max
  Peptide Sequence Number=SeqID_107866
atggccgatggacctggaagaagggatggaatgggtgtttgcggaatcacaattcagaaagtgaggaggggagaggaagagaaaggaggtaggggttgtagggagatgagaattgagagaaggggggtgaaaatagcagcacgcttatag

SEQ ID NO: 16182 - DNA, 507 bp, Glycine max
  Peptide Sequence Number=SeqID_107867
atggcgtcgcctggtttcttttcattcggaagattttggccaccgtttcagggacagggagggatgaggcagcaacttgatccctcggctcacacaatgaagtcccatggatcagcacttgcaaggaaacacgttcgtgattggcttatattgctgcttctcatagtaatagagattgtcctttttgtcattcatccatttaaacgctttgtaggaagggacatgatggaggacattagatatcctatgaaagaaaacacggttcctgtatgggctgttcctttatatgcggttctgttgccgatggccgtgttccttctcttctatatgcgcaggagatgtgtttatgatttgcaccacagtattctaggtttgctatttgctgttctgataactggggtcttcaccgatgcaataaaaaatgcagttggcaggcctcgaccagacttcttttggcgttgtttccccgatggggtagaggtaggcaaattaagtgctactgtataa

SEQ ID NO: 16183 - DNA, 282 bp, Glycine max
  Peptide Sequence Number=SeqID_107868
atgcagggaccaagaaataacaaagacccaaaaggagaatttgaattgggaaattgggtagtgttcaagttgagattttggtactggaattgtgggatttgcaccacagtctcaaactcttgttgttatgcttcatgttggttgactcacctcaagtgtgtttgtaacacttcgcacttcggagtgttggtcgtgggtggcgaagcagtggttgatggagtcgacaatggcagtgacgtttgcggcgacggagggggagaggcaactagagaggatgtatag

SEQ ID NO: 16184 - DNA, 1500 bp, Glycine max
  Peptide Sequence Number=SeqID_107869
atgacggcggtgcatattattcagaatgcgacttctatgtcaaagtttttacaaactctcatcaatcatatagggttttgtgtgaaggggcgcgagtgtaacatagggggtatgagtgtagggatcgtgaagagactaggtggcattgtaataagttcaaaggacatgaaaggcgaatcttctgctttcaccatgatcgttgcactctcaatggctgagatttgttcgtcttatccaacttctggtgggctttattattggagtgccaagcttgctgggcccagatgggcaccctttgcttcctggattactggctggttcaatattgttggccagtgggcagtgacaacaagtgtagattattcacttgcacaacttattcaggttattattctccttagtactggtggcaaaaatggtggtggatatgaggcctctaaatatgtagttattgcttttcatgggggaattctgttcctacacggtgtaataaatagtcttcctatctcattgttatcattcttaggacagctggcagctatttggaatgttttaggcgtttttgtgcttatgattgtcattccatctgttgcaacggaaagggctagtgccaagtttgttttcactcacttcaatgcagaaaatggggaaggaatcaacagcaaaccctacatattcctcttgggacttctaatgagtcagtataccctaactggatttgatgcatcagctcacatgacagaggaaaccaaggatgctgataggaatggtccaaaaggaattatcagcgctgtcgggatatccattgttgttggatggggttacatactaggcattacctttgcagtcactgacatcctttaccttttgagtgaagataatgatgctggtgggtatgctattgctcaagtattttatcaagcattcaagaaaagatatggccatggaactggaggcattatttgcttagtaattgttgctgttgccatatttttctgtggtatgagttcagtaaccagcaattcaaggatggcttatgcattctctagagatggggccatgccattgtcatcattgtggcacaaagttaacaagcaggaggtccctatatatgcagtttggctttctgttttcatatcattttgcatggcactgacatctcttggaagcatagtagcatttgaggccatggtgtccatagcaacaattggcctctatattgcttatgccttccctatattcttaagggtgaccttggcacggaaacactttgtcagtgggcctttcaacttgggccgttatggtgtcgttgtgggttgggttgctgttctttgggtgctgaccatttctgtactcttctccttgcctgtttcctacccaataaccattaagacacttaactacacccctgttgccgttggatgtttgcttattcttgtagtttcttactggttaatcagtggtcgccgttggtttaaaggccctataaccaatatataa

SEQ ID NO: 16185 - DNA, 630 bp, Glycine max
  Peptide Sequence Number=SeqID_107870
atgcataacaaggacgcttgctctccctcctccaatggcggattcggaggcggcgcctccgccggtcaaattccgtcaaccggcggcctctacagttctctgtactcggcactgtcgaacgagaaccttccatcgctctccgcgagctgcagcaacggaagcggcggtggcgtttcgatgtatccttactcggagtcaattcagaagcaccaggacatggtgaaccgtcaaagcatgtgtctgaatcgcctcgttgaaacttcgaaggaggtggaggctctgagggaggagaatggcctgctccgagccgcgaacaaggagctccagaagcagctgcacctcgttatccaggcttcgctggagaatcactacggcggcggcgacggaggctcctccggccagacgcaaccgactctgttcaatgttttgcatggcttccgcggcctccacattggggaagggaataaagagaattatgcagattggaataacaataatctcaatatcatgaataataataacagcaacaataaggagctgcaggagatttcggaggagagtccaacgagcgtgattgagaataacaacgtggtggaagtggagaggttctcgctccctaagagcatttct

SEQ ID NO: 16186 - DNA, 1176 bp, Glycine max
  Peptide Sequence Number=SeqID_107871
atgatgtcgtcgcagaatgagaataggtcgttggaggaagctggaccctccggctcctccgatggaggggtaggagtgaattggctctgcatgagccctaagcgagatcacaaccccgaaaactatgacgaccttcaattcgagttcaatcctaatctcttcgcctctctcgagcactatttgcctcctcatatgctcaacctctcacgcgatgttaagcttcactacatcaggaacattcttcttcgctatttgcctgagaatgaccgcaactggattcaaaagctgagggaatacaggctaaagatcatattgaattatccatcgttgcataaggagatatttactatggatgctgagaactttttcgtaccatcatttctcagagcaattaaagaaaacacagaagcgaattttagaagtataatggctgaaccttgtaaaggagtttatacatttgaaatgcttcaaccgcaattttgtaaaaaactgatgtctgaggtggatcattttgaaagatgggtccatggtaccaaactcaaaatcatgcgtcctaatgcaatgaataaaaataaacatggtgttatccttgatgattttgcctttgaagccatgcttgacagatttatgtgtgatttcatacgtcctatatctcaagttttctaccctgaacttggtggatcctcattggactctcaccatggttttgttgttgaatatggaattaataaggatgtggaacttggcttacatgaggatgaggcagaagtcaccttaaatgtttgcttgggaaaagaattttctggtggagaactgttcttccagggtgttcgatgtgatgcacatgtaacatcaaatgcgcaaccagaggaggccttcaattattcccatgttccaggacacgcaattcttcatcctggtcgtaaccggcatggtgctagacctacaacatctgggaatcggatgaatttaattctctggtgtagaaggcatagttctggtcaattacttagtgcatcagccttcatgttgtcacacagttcggtgtttagagagttgaaaagatatcagagagatttttatagctggtgtggagaatgcaaacagaagaaggcggagagagtgtgtttgtcagttatggccaccaaacaggaattactgaagagcgaaatataa

SEQ ID NO: 16187 - DNA, 2112 bp, Glycine max
  Peptide Sequence Number=SeqID_107872
atgaagtcattttgtcatgggtacggagtcattgccagctataagttcaaacttgcacattcggaagataatacttctagcaatatgagcttgcagttggataacttttccaacattttagaaatgaatatagatgtgagtgacgtcgtagggctccaaataggatgggttgggatatattatgaggaagctttagctgcgctcaatgttgcacccttgagccagcattttgataagtcctggatagttcacgtgcagttaaaggcggcactgttttatgcggaagcttgttataggtatggattggagctgcatgataaagaggagatagcagaggagattgcacgactgcggagtgctgttaatgtgctgactgaggcgaagaagagctctaagggtgctgcagcgcaaattctagatgcaattggaaagttagaggccaatattaaccggaaccttgaaagggcagtcaaggagaatgatagggtttacctcatgagagttccttcaccaagttcattaccgcctcttccggcattttctatggttaagtccatggtgatgaatgagatgctagatgcaagcaaggagaagatgtttgctagtcttgttccagacaacagtgcaaaagccctctcccggtatactgaaatggtagatgacgttataagaacacaagctgaaaagttgcagcaagctagtgagttaacccgagttaggcttaaggaaatggagctgcccgaatccattcttgctttggaaggaaattttactctaccaacaagtctcaaagaagatgtggaggctgtgcagatcagtggtggccctgctggtttggaagcagagttgcagcaacttaaggacctaaggagggtgaatcaagagttgctggtccagactgaggaattgttgcagaaggaagcaagggaagattctcaatttagaagccaatttggcacaaaatggaccaggcctcaatcaagcactttgaccaagaacttgcaggataggctaaacaggtttgcaggtaacttgaagcaagctgctgagagtgatggtaggattgagcgttctgttagagaacattcatcactcatgtcgatccttgatgcccgtccgattgaatctgcacttccaagcttggcaaggccgattatgtcttttgatcaaaatgaagatgctattgtggggtctctcaagcaaagcttgaggcaactagaaactctaggagctcaaagggctggtcttgaagatatgcttaaagagatgaaaagaaaggatgatatattaccaaagttgatgacatccaccggttcttatgatgatctcttcaagaaggagatagcaaaatatgaccatatttgtgaagaaatagctcaaaatatcgaggcgcaagagcaattgttgctgcagatccaggctcaaaatgatgagttctctgttatcttcaatcttgaagattacaaagcttcacgtgaaaaagcctacaagcagattgaagctgccatagcaaaatttagagaaataaaggacaacatcaatgaagggttaaaattctatgttacgctgcaggatgcaatcacaaatgtaaagcagcagagcaacgactttgtgatgacgcggaacatccagtgcagggaaatgattgaagatgttcagagacaagtggctggtctgagtttccaggataacaaaaacacaggtgtttttaacagcaactacccttcagtgggaagccaaaatcaaagatccaatacacaaacagatcctcctcgtccccaaacaccttattatcagcagcagccagttgagcagccaccaattcccacctatggccatcatccccctcccccatatggtagtcctgcacaacatcatcagcctccacctccataccacattccaccatcatcaactgcgccatacccacccgctcaggttcatcatcagccaccgccaaaccatgagtatggccaaccagcatatcccggatggcgtggtccatactacaatgcacaagcacaacaacctggttctgttcctcggcctccttataccattccatctccataccctccgcctcaccaaagtggctactataagcagcaatag

SEQ ID NO: 16188 - DNA, 1215 bp, Glycine max
  Peptide Sequence Number=SeqID_107873
atggtaaagcctcaaacaacaattcacgtcaccctcgctgtaacaagcctgcatcaaggtcatgtaagtgacctcgtccgggggcacgttctccgccgccatttcgaggagcgaggcgagcgcgtcccgggttcgccccactctgcagtagcccttgacgagagtgttgtagctgacgacgtcgggttggtggatggatttgaagacgcgctcggcggagtcaatgagggaggcgttgaccagggcgttgaggagggagttgaggatagagagcgtggggtggagattgtggttcttcatttcgcggaggagccagaggagttcgtcgacgagggcggcggaggcgagggtggaggcgagggagtgggcggcggggagggtgagggggaggttggcgcggcggagggcggagagggcgccgcggagggaggaagggtggtggaggaggagcgggaggagggagacgtggcagtcgagggagtgggagtagttcggttgcgtggcggcccaggagaagaagcgtgtggcgacgagggggtcatagttagtgttagggttagggttggggagggagcggagggcgtgggcgacgaaggagggggagaggatgatgaggaacttgcggcagaaggagtcgaggttggactccatggagggggacccatcgaggagggagaggatccgtgggacccacggggaggggtttcggggcgccgaagcggcgacggcgacgtcggagaggtcgcagaagggatgcaccacttcgcggggagggaggaggggtgtgctgaacgcgcgtcttcgtgcattgtgagagaaaccagttatgttgctcaggatgagcagtggaagtgtgggtactgtgattttgtttctgagtgtcctgcatataatggggggaggaagaagaagcctaaagcacgtaaaaacacgttgctccaccggtttaggaacaagagaggcttgttcgtcactgatgttaccaagacagaatggtgtgaaaggcaaatggagttttttcttttctctgaagagtggaagaacattgaagccaagaaaatggattttggaggaggaaggaggaacaatgaagccatcaaagctggtgaagatgatatggcaatgaaacttgttaacttcataaatggggtgaaccaatttctgtttgatcggttaacacatgagcttccaatactgagttttgctttgcactag

SEQ ID NO: 16189 - DNA, 366 bp, Glycine max
  Peptide Sequence Number=SeqID_107874
atggtatatatgctttttgaagatgataaagtctttgtggaagaggtgagagttgagacaagaaataatggaaagttagagatatgcagattggagacaagccttggatgggaacacgtggattttgcccaagtacaaagtttctacacagccttaaaaaaacttcgtaccccattgcccagagactcttcgctatgcgaaggtggtatgggagagggatgttgtacgcagccttacccttgcatatgcaaagaggctgtttccggattcgaacccatgaccaacaggtcaccaaggcacaactttaccgctgcaccaaggctcgccctcagtttctacacagccttattttctaaaaatgcttag

SEQ ID NO: 16190 - DNA, 2538 bp, Glycine max
  Peptide Sequence Number=SeqID_107875
atggctagtggactggaaacaatttgtggacaggcttatggaggccaacaatatcaaagaattggaatacaaacatacactgctatattctctctcattttggtttctattccggtgtctctcctttggatcaacatggaaaccatactagttttcataggccaggaccctctaatttcccatgaagcagggaagttcacaatttggcttgttccagcactttttgcatatgcaattctacagccgttagttcgatatttccaaatccaaagtttgcttcttcccatgtttgcaagttcttgtgtcacactcattattcatgtacctctttgttgggccttggtattcaagacaagtctgagtaatgttggtggagcattggctgtgagcatttcaatatggtcaaatgtgatttttcttgtgttatacatgagatactcttctgcatgtgcaaaaacccgcgcaccgatttctatggagctgttcaaaggaatgtgggagttctttcgtttcgctatcccttcagcagtaatggactcttaccaaatccacaacttgaaacttcagttctgtccgtttggtatcctcaacaccattgcaactctctatacgataccctttggaattggtgcagcagcaagcacaagggtttcaaatgaattaggagctgggaattcacatgctgcacgtgttgccgtgttagcagcaatgtctcttgcagtaattgagacaagtatagtaagtgcaacactcttcgcctgccgcaatgtttttggttatattttcagcaatgagaaggaagttgttgattatgtcactgccatggctcctctggtatgtatatctgttatactagacagcatacaaggtgttctaacagggattgctagaggttgtggatggcaacatttaggggtttatgtcaatctaggggccttctacctttgtgggattccaatggctgccttattagcatttttggtgcgattgggaggaaaaggactatggattggcatacaaagtgccttgaatggtggtcatttgagttactattcttgctttctggtcttctaccaaatccagaacttgaaacttcagtcttatccatatgtcaccacaacaatctacacaatcccagaagcaattggctcagcagcaagcactagagtttcaaatgcattaggtggtggaagtccacaattggcacaagtgtctgtttctgctgctatgactcttgcagcatccgcggccattctggtgagctcaatcatatttgcttgcaggcaggttgtaggttatgcatttagcaatgagctggacgtggtggattatttcacagaaatggttcctcttttaagtatatctgttatactggacaccttacatgataccctctcaggtattgctagaggatgtgggtggcagcacagaggagcatatgtaaaccttgacgcttattatgttgtgggaattccaattgctgctatattgggtttctgcctacaattaagaggaaaaggcctttggattggaatactgactgatatgggcgtaagattgaagaaagagaaagaacagctgaatcttctccttggttcccacctcactactatccatgaaaccctctcttcatctgaatctctttcttaccctcccaaagtcacctgggacgatgtgattaagattacagtaggtgccggccctaccttgtcttcctctgttcattcatctctcaagcaagtcgttgatgaaggaaacggtctcttcatacggctgactagatcatcatgcttcaacccactactcgacacctttagtcctgactggtcccattctaaagacctgaaaatatcagtaccacatttggttggtgctgtctgggaagcctgttctgcccttaaaaagactccttccacaaatattacagcaattgggcgaggaatgacacaagtagctgtttcagtgaaggatgttcttcgtgagatgaaagaattgaaacctgtttcatgtgatgatcaagttgatgaagctgctggtgagggttgtgcagaagcagcatctgagccacatgatgataattcaagtgaaggtgatctagggaatgacctgtcaccagaagagatgaaagtggctgaaagagcaattgaggttgtctctaatacgctttcagttagaaaagtacttattcactccatcataggcttgcttaagctggaaaaaccaaatgacaacagcggttttataaattcgctggagaagttgttgcagttgtgtcaggaacttggtcgacagattgatgagattggagcttgtctttatcccccacaagagattcctgccataaatgcagctttggaggaaattcacagcattattgatgctgtgcaagttgaggtaggagaacttctaggcgcatcagatgtatttctggaggcatgcaatgatttgaggagttcactgagacagcttgcatctgaactaagaaactctagtactgctgatatagaagccagagtggaaaatataacattaacctaa

SEQ ID NO: 16191 - DNA, 225 bp, Glycine max
  Peptide Sequence Number=SeqID_107876
atggaggaggatgagggattacaaatgaaaatccctcctcacgcttatagtttggtgatttgtgggctgtgtaagcaggggaaggttttggagggttgtgctgtgtttgagagtatggttaggagaggttgtaaggctcataaggctgtgtatactgcgataattgacggttatgccaagagtggggacttggattcggcaatgaaattttttgagaggatgaag

SEQ ID NO: 16192 - DNA, 324 bp, Glycine max
  Peptide Sequence Number=SeqID_107877
atggaagataatcttccggaaatagctaggcagttatgcatggagcatcaattgctattctcaaaagcggcatcatttgatgacaactcccaatttatggtggccatcctaaaggaatgtggattagcacataaaacagtaatttttgttctggatgagtttcacctgtttgctcagggtaaacagagattactctatagcttgctagatgcaatgcaatcaataacatcacaggctgttgtacttggcattagttgccgtctggatgcagatcagctgttggagaaaaggattactgatgcacatcctgacattaccaattga

SEQ ID NO: 16193 - DNA, 552 bp, Glycine max
  Peptide Sequence Number=SeqID_107878
atggctaacaaatctcaagaagagcccaagactgctcctgagcctgatcggtggtacaatctcacccttggaccttccttcaaagatgaatcctctaacaaatactgcactctacgatatgaatttaagccagcttcagttgataagactaagccagggttgctacgcaagaccaaagagaacagggtttctgtggaatttcagaacaaccaaataggaaagcccaaggtgacatttgaggggaatagtgaggaatataaggaaaatgatgctgtattgttctttgatggtgagacacttcgattggagcggcttcatagggcagtaaagcaactgcggcatctacgaatgccaggtgaatctgcaggtgctgcatctacagttgtggctgctccatctggacctgctttagatcctcgatcatcccctgttgggaagtctgtaaaacctgcacctcttggcaggagctcatttctggctgtgccaatggaaatgttccatcatgaatatcataatgcatatcctcttggtatcataatgatacaaagctaa

SEQ ID NO: 16194 - DNA, 1191 bp, Glycine max
  Peptide Sequence Number=SeqID_107879
atggctgctctcacaaagactgttggtgtgtttccaaaggaacgggcaattgtagatagagaacgtgctaaaggctcctattccttgggcccctatctgttctcaaaattgttggctgagattcccattggagcagcatttccattaatgtttggtgctgttttgtatccaatggcacgtcttcatcctactatgcaaagatttgggaaattctgtggcattgttactatggaatcttttgctgcatctgctatgggtcttactgttggtgctatggttccaaccactgaagcagcaatggcagtaggcccctctctcatgacagtttttattgtatttggagggtactatgtcaatcctgagaataccccaatcatcttccgttggattcctaatgtttctctgattagatgggcttttcagggactttctatcaatgaatttagtggtcttcaatttgaccatcagcattcatttgatattcaaactggagaacaggcactagagcgtatttcctttggaaaaagtaggattagggatacggtgatagcacaaaatagaatactgctattttggtattgcaccacctaccttctcctcgagaaaaacaagcccaaataccagcaacttgaaagccctattgaccacagcaaacctcatttaaaacttgaggagctcaattctgaacaagttgatcagacaattgaagctccgccagtcagtcaacttgattccaaacagcccctcgagtcacctgaagtagatcttgttggctcttttgtccttgaagtcaaattgttgcagcgtagttcaccacacaagttgttcagtgatggcaccaccactcgtaggagtttaatctatgcatcaaaaagagacccttttgggcaccattatgatggaaatttggtggatgagaacatgatccttcttagaatgcgaattcgtgagattgagatggtggaaatgaagggtaaagctacttcggattggagcgtatgggagaagaagtattttgctgagaattatggttcggatgtatgtgaagcagttggattgttgcaaagagtgttaatgaacaccagaccttcttttgcattgggtatgctagctcttgtcatgctaagcatgtccatgtcaacgttgcaagttgggtttcatttaatagaatttgccaagggaatcatatga

SEQ ID NO: 16195 - DNA, 75 bp, Glycine max
  Peptide Sequence Number=SeqID_107880
atgaagacacaaggtgaagaaggactatgtttacacagtaccaaggctgtggacaaggatcatggcaccatctaa

SEQ ID NO: 16196 - DNA, 2127 bp, Glycine max
  Peptide Sequence Number=SeqID_107881
atggattcagtgcctgctgatgtgtctaattcacatactattaatgacccgtcgaagtcacctccggctaaagagactgacagacaagcttctgcttctgtagcctccgggcaagataattctccacatgaggcatcacctaggctatctcccacgggcatatcatcctgggccaaaaacttgaaaatttctcagccattttctggctcccaagacgactcatcaagtggaaatgttgggaaatcaacttttgcacgcatcacaagtaatttcggattgaggttgtctccaaagtctcctgtagaagatgacagttccagtgaaacagctggacaatctaatttgtttggaactattacgaaaggcctggtcgactcttctaagaatgcagtgaaagctgtgcaggttaaggcacggcatgttgtttcacagaataaacgcagataccaggaaggaggttttgatttagatatgacatatatcactgaaaacattattgcaatgggattccctgctggcgacatgagctctgggtttttcggctatgttgaaggattttacagaaatcacatggaagaagtgattaagttttttgaaactcaccataaggataaatacaaagtttataatctttgttctgagcggttgtatgatgcatcattgtttgaggggaaggtggctagcttcccatttgatgaccacaattgcccaccaattcaactgattatatcattctgtcaaagtgcttactcatggttgaaagaagacattgagaatgttgtggttgtccactgtaaggctggaatggcaaggactgggttgatgatttctagtcttctagtgttcttaaagttcttcccaactgctgaggaatcaatggattactataatcagaaaagatgtgttgatggaaagggacttgttctgcctagtcagattaggtatgtcaaatattttgaacgagtcttgacttactttaatggtgaaaacccacctgcccgcaggggattccggcttcacagatgcccttactggattaggccctctataaccgtctcagatcacagtgacagaaggaaggccgttcgtcgccggagctcgtgccttgccggggctcgtcgcgaagtcagccttcgtcttcgtgtaaggggtgtcgcgggcggcggcggctgggtgtgcggactgcgggtgtcgcctgtcgcggcggctgggtgcggcggggtgagggaggacgcagaggtgcgggagggacgcaggggctattctgaatcaagggctttggcgctaagtgcgcctttggacttcttcgtgggtcttttttgtgctaagcgtgagtgggcagctaatatgaaggatttctgtgacttgagctttcacaatttgcagccagaagatttttggtttggtgcaccaaagaagggagtgatggtctttgccttgccaggagagcctggtcttacagagttggctggggacttcaaaatccattttcatgaccgccaaggagatttttactgttggttaaacacaactatgacagaaaataggaaagtattgaacactggtgatctggatggctttgacaagagaaaattgccttcgccgggatttatggttgaggttgtgctcgtggactataatggcaatgttgtaacttctaaaattgaaactactacaaaaaaatcagatgagagttcaagtaacaatcctgccagtcccaccccagtggaaaggagcacccctgcacagaatgcagacaaagaatcagatagtcatgataaagatgatgtgttttcagatggtgaggcagagcaatctgcttcttcaagaagcaagcaaacaaaagcaccttctcaagcagttgaaaaagttaaaaatgacaccagagtctccgaatcaagcagagtttcaaatgaaattgcaaatttatcacatgcaacagaacaagtttccttgggaaacaagagctctacgccaattcgtcatgctagtgagccaagaactaacgttgaaggaaaaacagtgtccagtctcgaggtgcccagcacagaaagtgagtttaaggccatggctgcagatgcttctgtttttacctttggagatgatgaagactacgaaagtgattga

SEQ ID NO: 16197 - DNA, 750 bp, Glycine max
  Peptide Sequence Number=SeqID_107882
atgaaacgtggagcattattgtcagtgcttgcgttcgccttcgcggcggcgatctgggcggcgaacggcaacgacaacctcgtcccgcctaggcgggaagtgtacggcaatggccgaatattcgacatcagtcaccggtaccaacccgagatgccggaatgggaatcgaataacggcattgggcagttcctgtggcttcccaagagcatgaagaacggttccctcgccaacaactccgaaatgaaactcccaacacacaccggcacgcatgtcgacgcccccggccacgtgttcgaccactacttcgatgccggcttcgatgtcgacaccctcgacttggacatcctcaacggacctgctctattagttgatgttccaagagatagtaatataactgctcaagttatgaagtcgttgaatattccaaggggtgttgtacgtgttctcttccgaacgttaaataccgacaggcggcttatgtttcagaaggaatgggacacaagctatgtaggattcacagttgatggagctaagtggctagtggataacacggatatcaaacttgttggaattgattacctatctgttgcttcttatgattacttgattccatctcaccttgtttttctaaaagacagggctttgaagcttgatgatgttccagcaggattatattccgtccattgcttacctcttaggttggctggtgctgagggatcaccaatacggtgcattctgattaaaaattag

SEQ ID NO: 16198 - DNA, 2199 bp, Glycine max
  Peptide Sequence Number=SeqID_107883
atggaaaagtgcacattagtatgttacaaggttatagaagctgcttctgatatgttaatgctcacactgctcttcacttcgaaaatgcccaagactgatttcctcaaagctgttgcaatattagcaacagctgcaactggggcagtggcaattaatcattcttgggtagccactaatcaggatcttgctatggcattgctatttgtaataggatatgcaggcatcatatttgaagaatctctagccttcaataaaagtggagtgggactgttgatggctgtaagcttatgggtgatacggagtattggggctccatcaactgatatagctgtttcagagcttacacatgcatctgcagaagtcagtgaaatagtgtttttcttgcttggtgcaatgaccattgttgagatcgttgatgctcatcaaggatttaagctggttactgacaatataacaacccgaaacccacgccttctcctctgggtgttcagttctagacaacctgacatccaccatagttatggtttctctgttgcggaaattggtgcctccatcagagtaccgaaatattctccaactattttgaggtttggatacaccttatcaaatcctcaggtggttgatttggattctgttgacaggattcttggagctgttgttgtaatagcagcaaatgcggggggtgcatggactcctattggtgatgttacaactactatgctgtggatacatgggcaaatatctacagttcaaacagtgaaggatttgtttgtaccttcagccgtttctctagctgttccactggctctaatgtccctgacaagtgaagttaatgggaagggacaaaattctcccaatgtcttggcatcggaacagattgctcctcgaggacagcttgttttctctgtgggtttaggagctttgatttttgtcccagtattcaaggctcttacaggtttgcctccatacatggggatgctgcttggactcggtgtgctttggatcctcacagatgctatccattacggtgaatctgaaaggcagaagctaaaagtaccccaggctctctcaaggatagacacccaaggagtactattctttctgggaattctattatccgttagcagcctggaggcagctgggattcttcgggaaatagcaaactaccttgatgcacatgtgccaagtagtgaactgattgccagtactattggactcatatctgcagtaatagacaatgttccattggttgctgccacaatgggaatgtatgatgtcacttctttccctcaggattctgagttctggcaattgattgcattttgtgctggtactggtggatccatgttaattattggctcagctgctggagttgcgttcatggggatggaaaaggtggacttcttttggtacttacgaaagattagtggctttgcttttgcaggttatgctgctggtatcgttgcctatttagctctccataaactcaacatctccctaccaactctagcagagatcggtaccacaataatcatcactattgtgattgttgccataattactgttattatcaccaccaacatgatttacacagttgtcgttaacaacgatgatcatgacgacgatgatggtggtggtggtggtgttggtagtgaaagtaatggcgataacatttatggtgataataatcatgacgatggtaatgtggcgacaacagttgaaatggggatgatgatgatgatgatgatcgccataactgtctccatactcttgggaaatgttcagagcttcgacggcggtagtttgtgtgaagagctcattatcccctccggttacccctgctccgagtatacgattcaaaccaaggatggtttcttgttaggtcttcagcgtgtgtcttcttcttcttcccttcggcttcggaaccatggagatggaggccctccggaattagccctgtatgatgttgcggaaatgatcaattacattaattcagtaacaaactcaaagatatttgtagttgggcattcacaggggacaattatatctttggctgccttcactcaaccagagatagtagaaaaggttgaggctgcagctcttctatctccaatatcatacttggatcatgtcagtgcacctcttgtacttagaatggttaagatgcacattgatgaggtatttcttagtttgttctag

SEQ ID NO: 16199 - DNA, 378 bp, Glycine max
  Peptide Sequence Number=SeqID_107884
atggcagggcttggaccagagctcttcaatgttctgaagactccattcacctctctgataatactaataccattcttacttggtgaagaactaaacagtggccgtgcttctgacacaggaagagaagaagcaaacaaggaagcaagaagaaaaagagtgagcaaagagacagacttgagtcttgtgtccatgttgaatgaagctgatcaagctcgaccacttgagataaggaagttagaaagcactagccagagaatgtgggcaatgcttcattcagggccaagctctggtgggaaaggccataaatctgagactggggaagccccaattccaggacagcttaaacaatctgttccaagccctggagttggacactaa

SEQ ID NO: 16200 - DNA, 149 bp, Glycine max
  Peptide Sequence Number=SeqID_107885
ggttatgccagagcctgggcaattgcccagggtagccgggccttgaaaccgcctatgtctggggcaattatggttgaagctcaagtttatgtcattagtgggactattgctaattggtatttctccaaggaacatcaaactcttagagt

SEQ ID NO: 16201 - DNA, 3060 bp, Glycine max
  Peptide Sequence Number=SeqID_107886
atggcaacagctaacaggcacagctatgagcttctcctactccaccgacttctgctttactttgtcgtctcatgctcattatcgttatcttgggcagtgcaagatggtgaacgggttatggtgcgcaacaccccacagaagaactggtggaaaccaagtttaacaaatgcagaagatgatgatcctcctccaaggcccttgaaggttacttttgctgaacctgcaactcactggaccgatgccatccccattggtaatggccgtctcggtgccatggtttggggtgccgtaccctcagaagctctccagctcaatggatccaatatggtttgggacttgagtcccaatttgaagtatgggattctagttgaggtttatgaggccttagactctgcatctagaatggctagtttttgtgaggacacactttggactgggattcctggagactacaccaacaaaagtgctccgcaagcactggctgaagtcagaaagctggttaatgatagaaaattcgctgaagctacggcagcagctgtcaagttgtctggagaaccttctgatgtatttcaacttctcggtgatatcaagttagagtttcatgattcccatcttaattattcaaaagagtcatattatagggagctggatttggatactgcaacagcaaaaataaaatactctgtgggtgatgtggaatttaccagagaacattttgcttctaatccggaccaagtgatagtgacaaggttatctgcaagcaagcctgggtcattatcatttacagtgtattttgatagcaaaatgcatcacgattcaagggtaagtggccaaaatcagataaaaattgaagggagatgtcctggcagtaggatccgaccaagagtgaattcaattgacaatccacagggaattcagttttctgcagttcttgatatgcagattagcaaagataaaggggttatacatgttttggatgataagaagctaagagttgaaggttcagattcggctattttgcttttgacagcttcttcttcctttgatggcccatttactaagcctgaagactctaagaaggatcctgcttctgagtccctcagtagaatggtgtctgtgaaaaaattttcatatgatgatctttatgcacgccacttggctgactatcaaaatctatttcaccgtgtctcattgcaactctctaaaagctccaagactggttcaggaaaatctgttttggagggaagaaaattggtttcctcccaaactaacatctctcagaagagaggtgatgataccattccaacttcagcaagagtcaaatcttttcaaactgatgaagatccttcctttgtggagcttttgtttcaatatggtcgatatcttctaatctcttgttcgcgtcctggaacccaggtggcaaacctacaaggtatctggaacaaagatgttgagcctgcatgggatggtgctcctcacttgaacattaatcttcaaatgaattattggccatcccttgcttgcaacctacacgagtgtcaagagcccttatttgatttcatttcctctttgtcagtcattggtaaaaaaactgcaaaggtgaactatgaagcaaatggttgggttgcacatcaagtttctgacatatggggtaaaacatcaccagatcgaggtgaggctgtttgggctttatggccaatgggtggagcttggctttgtacacatttatgggagcattatatttatacaatggacaaagattttcttaagaataaagcttatcctttgttggaaggatgtacaacatttttgttggattggttgattgaaggccgtggtggattattggaaaccaacccatccacttcaccagagcacatgttcactgcaccagacggaaaaactgctagtgtgagctactcatcaaccatggacatttcaatcataaaagaagttttctctatgatcatttctgctgctgaggttttgggaaggcataatgatactattatcaaaagagtcaccaagtatcagtctaaacttcctccgacaaaagttgctagagatggttccattatggaatgggcagaagattttgtggacccagatgtacatcatcgacatgtttcacacctttttggactgtttccaggacatacaattagtgttgagaaaactccagacctctgtaaagctgtggaagagatgatggtccagggtggtcaacaacttggaaagcttcactgtgggcacatcttcacaatacctgatcatgaaagggattttgaaggtggactttacagcaacctgttcacagcacatcccccttttcagattgatgcaaactttggtacatttattctcatttctgaggaaggagggtgtagttttgctgttgcaaaaacagttaagcttaaatatcatgaaactcctgcaattgcagaaatgcttgttcaaagcacaacgaaggacctctacttgcttcctgcattgccacgcgacaaatgggcgaatggttgtgtgaaaggattaaaagctcgtgtgcaagattgtgaacgggttatggtgcgccacaccccacagaagaactggtggaaaccaagtttaacaaatgcagaagatgatgatcctcctccaaggcccttgaaggttacttttgctgaacctgcaactcactggaccgatgccatccccattggcaatggccgtcttggtgccatggtttggggtgccgtaccctcagaagctctccagctcaatgaggacacactttggactgggattcctggagactacagcaacaaaagtgctccacaagcactggctgaagtcagaaagctggttgatgatggaaaattctctgaagctacggcagcagctgccaagttgtcagtagatccttctgatgtataccaacttctcggtgatatcaagttagagtttcctgattcccccatcttaattattcaagagtcatattatagggagctggatttggatactgcaacagcaaaaataaaatactctgtgggcgatgtagaatttaccagagcattttga

SEQ ID NO: 16202 - DNA, 741 bp, Glycine max
  Peptide Sequence Number=SeqID_107887
atgaaagaagaagagctctcaagtgagtgttttgctctctttcgtacccttgctaatcaactccttccaaaaagcacaggttcaggtctcactggtttacctccatacatcggaatgctgctcggacttggcatgctttggatcctcactgatgctatccattatgatgaatctgaaaggcagaagctaaaagtgccacatgctctgtcaaggatagacactcaaggagcactatttttcttgggaattgtattatctgttagcagcccggaggcagcaggtattcttcgggaaatagcaaattactttgatgcacatgtcccaagtagtgaactgattgcaagtgctattggactcatatctgcattaatagacaatattccattggttgctgccacaataggaatgtatgatgtctcttctttccctcaagattctgagttctggcaactgattgcattatgtgctagtactggcggatccatattggttattggctcagctgctggagttgcgttcatggggatggaaaaggtggatttcatttggtacttacggaaggttagtggctttgccttagcaggttatacagctggtattgcttcctatttagtgcttcataatctcaacatcttgcaaccatctctagcggaggctcctttcctttcatgtttcataaatcaagaattcggacttcattccaatccattgtcatggtatcaaaagcagcatagtttgtaa

SEQ ID NO: 16203 - DNA, 2718 bp, Glycine max
  Peptide Sequence Number=SeqID_107888
atggcgtggacttacttcgtgccatttcatccgaaggataaatcagtgctcaccgagttgatacaagagatagaacctctggatgttagccacattcagaaggatgttccaccaactacagcagatgccatgaagaggactatatctggtatgctgggcttgcttccgtctgatcaatttcatgttgtcattgaggccttgtgggaacctctctccaagttactgatttcttcaatgatgactgggtatacactacggaatgttgaatataggctttgtcttgagaaaaaccttgatatgtttgaaggagatatagagaagccaaaggcagagagtatgaaagtggacttacaagggttgatgcatgacagtgtaaatgcaattgagtttggtaaaaataagaatttgtcttccaaagttgaaaagcttcatgaggaagctgacattcaagagcttggtgaaatatctgctgaagctcaacaatatatttttaatttgcaatctcgtttgtcttctatgaaaaaggagctgcatgaagtaaagaggaaaagtgctgctcttcaaatgcaacagtttgttggagaagaaaagaacgatttattggattacttgagatctcttcaacctgaacaggttgctcagctttcagaatttacatcccctgagcttaaggacactatcctctctgttgtccatggtctcctagctactctttctcctaagatgcattctaaaccttccaccatgtcagaaaatacaacagttggagcaacaaatgctgggagtgaggattgtgctgaggttcttgagaactctgctcttcaatttcagcctattgtctttcccaccacccaaaggttaaagttcaaacccattgttgctcttcttcactctccctcttcgtgttccattgcagaccccaccaaccttgccaccctcctacaaggcaacattccacgttctcaccttctccaaatccatgcacgcattttctatcttggcgcacaccaagacaacctcatagccacgcgcctcattgggcactacccatcacgcgctgctcttcgcgtctttcaccatctccaaaacccaaacatcttccctttcaacgccatcatcagagtcctcgcccaagatggtcacttttttcacgctctttccgtgttcaactatttgaaacgacgttcactttcgcccaacgacttaaccttctctttcctctttaagccgtgctttcggaccaaagatgtccgttacgtcgaacagattcatgcccacattcagaagataggtttcctctctgacccttttgtctgtaatggcttggtctctgtgtatgccaaaggctttaacagtttggtatctgcccgtaaagtgtttgatgaaattcctgacaaaatgctagtcagctgctggactaacttgatcactggttttgctcagtctggtcacagtgaggaggttttgcagcttttccaagtgatggttaggcagaacttgcttccccagagtgatactatggtcagtgttttatccgcttgttctagccttgagatgccaaaaattgagaaatgggttaacgtttttttagaattggttggtgatggagtgagtactagagaaacttgccatgattcggttaacacggtgctggtttatttgtttggtaaatgggggagaattgagaagagtagagaaaattttgaccgaatttctacgtccggaaaaagtagtgtggttccttggaatgctatgattaatgcatacgttcaaaatggttgtcctgtggagggattaaatcttttccgcatgatggtagaagaagaaaccactagacctaaccatatcacaatggttagtgtgctttcagcctgtgctcaaattggtgatttgagttttggtagttgggttcacgggtatctaatatctctaggacacagacacactattggatcaaaccaaattcttgccacatctttaattgacatgtattctaaatgtggcaatttggataaggcaaagaaagtttttgagcatacagtctccaaagatgttgtcttattcaatgcaatgatcatgggtcttgcagtatacggtaaaggagaggatgcattgagactcttctacaaaataccagaatttggcttacaacccaatgccggaacatttcttggtgctttaagtgcatgcagtcactctgggttgttggtgagaggacgccagatattcagagaactgaccctttccactactcttacattggaacattgtgcttgttatattgatctccttgcaagagtaggatgcatagaagaagctattgaggttgtgacttctatgcctttcaagcctaacaattttgtctggggtgctttgcttggaggctgcttgctccattctagagttgagttggcccaagaggtttccaggaggcttgttgaagtagacccagataattctgcaggctatgttatgttggctaatgcacttgcatctgataatcaatggagtgatgtctcggggctgcggctggaaatgaaagagaagggggtcaagaagcaaccaggaagtagttggattattgtggatggagctgtacatgaatttcttgttggttgtttgtcacatcctgaaattgagggcatatatcatacattggctggattggtgaagaatatgaaagtagcaagccattttaaccttgtgtgctgttgttag

SEQ ID NO: 16204 - DNA, 1842 bp, Glycine max
  Peptide Sequence Number=SeqID_107889
atggtggctgccatttcggaagacccattgacctcttctaatggcaccatccccagaagaccaaagggtaggcaagtttcttcaaggtacatgtctcactcaccttcaccttcttcaaccacaactacaacaacaactacttcaacttcaacttcaacatctacaacaagttcttcttctcgtcgattcccttcccctcttctctcgcattccaccaattcctccacccctttgctcccaaagcgttcccaatcggtggaccgccgccgcccgcgcccggcgacgccgcttcccgaggcggcgaagcttctcgtgacttccactaggagcctgtcggtttcttttcaaggagaggccttttcgctgcccgttagcaagaccaaggccgccagcgccaccccgacgccgaggaaggccgccacgccggagagacggagggctactccggtgaaaggggagaattcccggccggcggatcagcaccggtggccggcgaggacccggcatgtggatcatctctccaagagtgtggatataattgataataagaagaaggttgttggaaatgggaatgggaatgggtttgggaaagtggtgagggctttgcagcaatcaatggtggtggagggtgagaagagaagagcttcttttgatgggttaggagggttgagtttggatttggggaaagctgagttgctgaagggtaatattaatgctaataatcataataagtcttcattggcttctgatctcactgcttctgatactgatagtgtttcctctgggagcacgtcaggagcacatgactcttctggggctgccaagggcactaaggagcctcgtggcattgttgtgtctgccaggttttggcaggaaactaacagcaggctgcgccgccttcaggatcccggttcgcccttgtcgaccagccctgcttctaggattggggtgccaaataggaatgctcagttgaaaaggtataatagtgatggtcccatgttgtcgccgcgaaccatggcttctcctgtcagggggaatgtgaatgctcggcctgcttcgccgagtaagctttgggcgggatcatccccgtcaaggggggttagtcctgctagggtgagaagcacggttgctagttctatcaatagtggttcgggtaacacaccctcgattcttagcttctctgctgatgtgcggagagggaagattggggaagatcggatatttgatgcgcatacgttgaggcttctgtataaccggtatgtgcagtggcggttcgtgaatgcaagggcagatgctacgtttatggtgcagaaactgaatgctgagagacatttgtggaatgcatgggtaacaatctcagaactccggcattcagtcatacttaaaagaatcaagcttgtgttaatgaggcaaaagttgaagttaacttccattctaaaaggacagatttcttatttggaggaatgggcccttctggatagagatcactccacttctttgcttggagcaactgaagctttgaaggccagtaccctccgtcttccagttgttgaaaaagcaatagctgatgtaccaaatctaaaggatgctttggggtcagcagttgatgtgatgcaggcaatggcatcctcgatatactctctttcttcaaaggtggaagaaactaactgcttggtggcagaaatcctaaaggtgacctcaaaagaaaggtttttgcttgaacattgcaaggagtttttgtcctcgttagcagccatgcaggtcaaggattgtagcttaagaacgcatatgttacaactttctcgtgtgccaacttccagctgcctgacaacacgtgtgtag

SEQ ID NO: 16205 - DNA, 582 bp, Glycine max
  Peptide Sequence Number=SeqID_107890
atggcaaagcccaaacttgaaccatcaaaactggctttgcggaaaggagaaactgctgagagcacaaaagacaccagaacaaggtactttaatgagcaagctgacaacagttcaggcacattcatcagcgcatcagaagacaaatctggcatcttagacttggttgagaggaagattgctaaagttacaatgattccaaggacccatggggaaatattcaatatattgaagtatgaggttggccagaaatatgattctcattatgatgcgttcaacccagatgaatacggctctgttgagagccaaaggattgcttccttcttgttatacctatcaaatgtagaagcgggaggagaaacaatgttcccttatgagggtggtctgaatattgataggggttatgattaccaaaaatgcattggtttgaaggtgaagccacgacagggcgatggacttttattttattcattgttaccaaacgggaaaattgataagacttctcttcatggaagttgtccagtgattaagggggagaaatgggtcgcaacgaagtggattgatgatagagagcaacactactag

SEQ ID NO: 16206 - DNA, 342 bp, Glycine max
  Peptide Sequence Number=SeqID_107891
atgcttcttcaaaaaaacccactttgttatctcaacctaaacctcccaaacaccccccatctatggcgggagccacaggcagaaccctcctcaccctctccctctcttcctcctcttccctcacgcgcctctctctcatccccaaaccctcctcctcttccgccgcctccgcccctctggtccgtcgccgtcgccacgctggaaaccaccgccgcgaagcactcgatcttccttgagaggctccggtcccgacacctccgggaggccgcgaaggctggtcccgaactgaggaagaaggcgaaggtcaccgccaccaccgctgaagcccgccgccactgctga

SEQ ID NO: 16207 - DNA, 1749 bp, Glycine max
  Peptide Sequence Number=SeqID_107892
atgaaggttgctgcagaaggctgcaacttactgttattgttcattacctcttacctttcactgatctcagcagttaatacacaaacttactggtgttgccattgctttgaaaacaaccagtgtttggcagaacctcggagagcacagtatggaggaggcattatagtaaatccaggatttgatcacaacatagagggttggacagtatttggaaaaggagcaatcaaggagcgaatatcgaatggaggcaatagattcattgttgctcacaacagaacacatccattggatagtttctctcagaaggtccaacttaagaaaggaatgctatacaccttttctgcttggcttcaggttagtgaaggaagtgacactgtgtcagttatgtttaaaacaaaaggaagcaaaatggtacgaggtggccaagtgatagcaaagcatggatgctggacccttctaaaaggcggcatagctgctaacttttcaagccctgttgaaattctttttgagagcaagaattcaaacgcggaaatatgggctgataatatctccttacaaccattcaataaaaagcagtggagatctctacaagacgccagcattgagagggtacgtaagaggaaggtgagattccaaataagtcatgtaaacgaaacagcattgataggagctaaagtcatcaccagaccaataaagttaaacttcccatttggatgtggaatgaaccatcatatcctcacaaacaaagactaccagagttggtttgtctcaaggttcaaattcacaaccttcaccaatgagatgaagtggtatagtacggagaaaaagcaaggcgaggaaaactacactatcgcagatgccatgctgaaatttaccaaagagaatggcatttctgtgagaggccataacattttctgggacaatccaaaacttcagccggaatgggttaagaatctatcacctgagaaattaggagaagcagcagctgaaagaatgaaatctgtggtttcaagatacaaaggagaactgattgcatgggatgtgatgaatgagaatctccacttccacttttacgaggacaaattcggtgaaaatgcctctgcagcagcatatgcaacggcttacgagcttgatcaagagccgaagttgttcctgaatgagtttaacaccattgagtatagtggggatgaggcttccagcccagccaaatatataaaaaaacttcaggagattctgtcatttccaggagtttctggaatgtcagcagcaatagggttgcaaggccatttcgctagtggccagccaaatcttgcttatatgaggtcaggtcttgatcttcttgctacaactggacttccaatttggctcacagaagcaagtgtggatccacaacctagtcaggcagagtacctggaagagatactaagagaggcatactctcatcctgctgttgaagggattataatgttttctggtccagctcaagctggtttcaacgccacgactctagccgatgaaactttcaaaaacactccagctggagacgttgtggacaagctgattcaggagtggggaactgggcctaatattgccacagcagataacagaggaattgtagatatttcactgcaccatggagattatgatgtaactgttacacatcctctaatccactcccctataactctgaatctatgtgtaaagaaagatttttcactggaaaccattcacgtgaaaatgcgggcataa

SEQ ID NO: 16208 - DNA, 249 bp, Glycine max
  Peptide Sequence Number=SeqID_107893
atgaagcaacaaactgttggggaattcgaggggagtaaacaccggatagatttacaccggtggaccacgagccaccgcataagggaacttgacactacacttcaacccaaaaccttaagactcagcctccccctcgagcggaagtcatccacgagtatagcccatcaccgtcatcttactcgtctgagccggtcaccaagtcgaaccatcggctctgataccagttgttggggaattcgaggagagtaa

SEQ ID NO: 16209 - DNA, 1110 bp, Glycine max
  Peptide Sequence Number=SeqID_107894
atggggcaggttgtgtcaaccgaggctaaagcaatgtataatgtggacttggctggtttgacattttgcagtcccaatgtgaatgtgttccgtgaccctaggtgggggcgtggccaggaaactccaggggaggatcccttggtggtgtctagatatgctgttaagtatgttcgtggcttacaagaagtgaaggatgaagcaagtgctaaagcttataggcttaaggtttcaagctgttgtaagcattatactgcttatgaccttgacaactggaaaggcattcatcgcttccattttgatgcaaaggtgacaaagcaagacttggaggatacggaccagcctccgttcaagagttgtgtgagtgaagggattcctacgtgtgccgatccagaccttctcaaaggagtaataagaggacagtggggtctagacggatgtattgtttcagattgtgattcagtggaagtctattacaacgcaattcattacaccgcaactcctgaagatgcagtggctcttgcactgaaagcagtaaacttggaaaaagtagatgtagcaactgtagaccaggccttggtgtacaactacatagtcataatgagattgggcttctttgatgaccccaaatcacttccatttgcaaaccttggaccatctgacgtgtgtactaaagacaatcagcaactggctctagatgctgcaaagcaaggaatagttttgctggaaaataataataatggaacttttgccttatcccaaaccaacattaaaaaaatggctgtgattggaccaaatgctaatgccaccacagttatgattagcaactatgccggcataccttgccgctacactagccctttacaaggactacagaagtacacatcttccgtaaattatgcacctggttgtagcaatgttaaatgtggtaatcagagcctcattgcatcagcagttaaggcagcagcctctgctgatgcagtggtgttggtagttggattagaccaatctattgaagcagagggcctggatagagagaacctgagtttacctggttttcaacagaagcttgtgaaagatgttgcttctgctaccaaaggaaaagttatttaa

SEQ ID NO: 16210 - DNA, 834 bp, Glycine max
  Peptide Sequence Number=SeqID_107895
atggtttcgttgtgggttgattgtagtcccaagagatatagaagggatagtaacagagtaacctcagatggaggagatcggagaaacccaccacatcattctaggcgtgaacccttcgatgctgctcccaagaaatcaaattcaaatgatcatcatgagaatccgccccaacatttgtctcaaccaccaagatctcgctcttatcatcagcacgatgaacggggtagtactgggcaggttggtcgaagcagtggtcaaagggaagctggtggaaaagtctttactcagagtaaagagaataatgaaagtcaaagtacagagcaaaaagatgagaaatcacaggtgaaactggatgacaatttacagaaaagagatggttttgctgaaagaaaagatgctccacctactatgaggaaaatgcgtgcatttagggagaagattcctgcagattcagcagatgctaatccagcttcaatggtggaagtaaagtcaagccatactgcccatcctccggaaaggaatgaaaggaaggaggaaagaagcagcaatcctcatcatctggatagacctgagaagcaaattgcagaggacagaacacccaataagactgaagctagaagggatggtttttcatcaagagcaaggtatgggggcagtggaggcaatagcaattacaggggaagagataaaattaatggaaggcaaggttatcgtcctattaagatgcgaatggagaagtggaaacatgatttgtatcaagaggttaacaaggatcctattccaaagaatgaggatgaccagattgcgaagttagaagcactattggcttcataa

SEQ ID NO: 16211 - DNA, 480 bp, Glycine max
  Peptide Sequence Number=SeqID_107896
tcttccggaattcttccggatgaaccacttcttccggaaagttcccggaagaggttttccggaagtcttccggaagaagtgttcttccggaagacgtttggttacttccggaagaacacttcttccggaaactttccggaaaaggttcttccggaacttccggaagaacccctaacgggtcttccggaagacgccgtcgtcagccttttgcgccattttttccggcgtcctctcgtcttctcccctctcgtcttctaccctaaggttactatcctaagggtagggagggagactaacctgttcgcggagaagaagaaaaccttgccttgggcgcgccttgcggagaagaaggaagttcacgaagaagataagaagaaccaggttcacggaagaggaagagaagacgaagctgttcgaacaaacagtgtcttccgggagggccccaacaataatctaaacatgcacgcaggaagatgttaa

SEQ ID NO: 16212 - DNA, 420 bp, Glycine max
  Peptide Sequence Number=SeqID_107897
atgacccctactcatgatgccctgctatataacaatgggaggtggaacatgtcacgccaaaatgagtttgttggttactcgttcacaggaaaatatcccaaaaactttgacattcccaccggatgtaccatggatgaactgaaagatttgatcaaacaaattgcgcttcgtgggattcccccttatggtattgatgaaacacaaatggtaaggcgattgtttttttggaaactaagtcaccatgagtattcagaaaaatttataaaattcaaaataattgaactcaaaaccaacgacgtcgtgatgaatgtgttgattgaatctaactactggaaaaagattgggccaatagaaattttagctgttttcagtaaacctgtatcggaaatggaagacgagttgtccttgtcgcaaaattag

SEQ ID NO: 16213 - DNA, 612 bp, Glycine max
  Peptide Sequence Number=SeqID_107898
atgtgtgtgcattttttcaactttgatcaattgagaattaaacttcaaagttcagacttctttagaggcactaaatttcatgctcttctcttcctctcccttcattcatcttctcctaccttcaagctgttatccatggtttcctatggtgaagcaaaggactccattgatgaagaagatccatggcctacgagctccacatggagctacatcataagcactcctgtgtgcggagccaatgggtcccctttgatgaagatgccattaatcaatttttggggcatccgttggtcttggaagaggggcaacattgcgagtttagtcagaggaaaagccagacctcgggattttgaggaggccataggccagctgctgtgtgttctaggacaggactttgcacagagtgtgacggggagacgagtgcagatcatgcgcactagcatgaccaccctgacacagatctggatgacattgcttctcaacaacatcctccacagtgatcataattctgatcttcccttgccaaagtgccagttggtctatgccatcttaacccagggatcacacctctcaggcacccagtggacccggagaagtccaacaaggcactag

SEQ ID NO: 16214 - DNA, 234 bp, Glycine max
  Peptide Sequence Number=SeqID_107899
atgaccataatttgtctctgcgtccgtttatcgacacgactgctactcctgaatggaaaagtttgtcatggcccgccgcctcctgaggatgacaaaagggcgcagaatgaccataatttgtctctgtgtgccatcggactacgactgtgtctgaatggcgaaaagggtcagtatgacagagattgtggggtggccgacaaaagcgaggctcttgctcctacgtatcctcaatga

SEQ ID NO: 16215 - DNA, 316 bp, Glycine max
  Peptide Sequence Number=SeqID_107900
ggcttcccggtatcaacagggacaccaggattatttttctgcgaagtgatctccgtcacaggtatttttcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 16216 - DNA, 463 bp, Glycine max
  Peptide Sequence Number=SeqID_107901
ttggaacctcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcccaaatgcagaaatcataccaattgcatgctga

SEQ ID NO: 16217 - DNA, 705 bp, Glycine max
  Peptide Sequence Number=SeqID_107902
atgtcctctcgggggaagaaaaccatatctttcatccgggtgtctcccctctttgagcagaattgcaactgtggtcaaggattcagcaagaggtttggaccgcataaaacagactcggaacggcatagcgggcctaccacgggggtacctagaagacaaggcaaggggtatggccaatcaaggagattgggtcccatttatggatgtgttagctttgctaatttttggggtcgtcctctttccaaacgtggatggtttggtggacctagcagcaatcgacgctttccttgcctacaccatagcaaggaaagtccggtggaggtagaacaatcagttggttcccccgatggaaagaaggaaagaggagtccttttctcatgtggagggtacccaaacattccgctgataggaacgaggggttgtattaactacaatcctgcgctcgctataagacaactagggtaccccatgaggggagcaccgatggaagaaagcgtgtctcctttccttgtgagggatttcggcgcgcaaaatttcaaggctatacaaagaatccataaggcatgggaaaccccgttaaggaaagatcaagaacttaggggcattcgtaatggcatcattggtggttaccatgaatggctgatcaagcttatcgataccgtcgacctcgagggggggcccggtaccagcttttgttccctttag

SEQ ID NO: 16218 - DNA, 662 bp, Glycine max
  Peptide Sequence Number=SeqID_107903
aagatgggccgaatgtgaagacgaatctgttcgccaaccatgagggatcagctatgaatgcaattgaggcgtgcagtttgcaaaggcctaagtatttaaaggacatcacaacctctaggaggtttatttttgaagccctacaagatgtaggcatgattcctctcggtgggcataagggggatccttgcttgatgcatccggtagacaagaaaagtcccaagaagcccaagcctttggtgatccatttcaccagagatgcggctccccaaaatcatcgaggcccttcaacgttgtcaggtagtaaacctgtccccttcccttataaaaacagcaaggtagtcccatggaggtacgctcctcagaagccgagcgagaagaaggaagaggccactgatattgactcattttctgccaaagtaaccaatatcactagactaagcggcatgacctgcagcggctgcatctttgcagtgcctaacctgccggtacgacctgcgaatgtcaaaggaaaagcaaaaatggtcgtggaagaggccaatgaagcaaactccaccctagatgaggatgttccaactgggaggtttgctaaaagaggggaaggtctcgatagaaaagaggtatccttggaggaggccaacgagttcctctatctaatccaatag

SEQ ID NO: 16219 - DNA, 360 bp, Glycine max
  Peptide Sequence Number=SeqID_107904
atgaccatgattacgccaagctcgaaattaaccctcactaaagggaacaaaagctggtaccgggccccccctcgagcatatacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcataa

SEQ ID NO: 16220 - DNA, 393 bp, Glycine max
  Peptide Sequence Number=SeqID_107905
atgcaccaagacaaaaagattgtgctcaagccattgagtccacaagaagtgtgtgaggatcaaaagaaaatgagagaaaaacttcttcaagggaaaagagaaaaagaaaaagtgagcaaaacacttgagagtgagaaaaagagggaaacacttgagaggaaaaagagtgaacaaaagaagagtgaaacacttgaagtgagggagagctatttagcgacaaaaagattttcaagacatgtttccatcaaatgtgccaagtggactaccactgatgcaatcctccctaggaagggaccaatcactagaaccatgagcaagaggctccaagaagattgggctagagttgctgaagaaggccctagggttctcatgaaccttagggtagatttctga

SEQ ID NO: 16221 - DNA, 851 bp, Glycine max
  Peptide Sequence Number=SeqID_107906
atggtgaaagttggaacctcttacgtgccgatcaacgtctcattttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagaaaattggctggggcaagagaaaaagctgttgtccaaatgagagatcatggctgcttgggccaaggtggcgtagtagaggacttgctgatggatggggtggaagaagtgaaagggaaaaaaagaatcaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16222 - DNA, 276 bp, Glycine max
  Peptide Sequence Number=SeqID_107907
atggtgaaagttggaacctcttacgtgccgatcaacgtctcatttttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 16223 - DNA, 510 bp, Glycine max
  Peptide Sequence Number=SeqID_107908
atgactagaggaaatctatctgacttacaaccctttgatcctgagatagacatgacatttcatagattagttaggcatcatttagtaccttttgagcatcctgagcattctgttattggtgattttgagcattatagttttgagcattctgattttgaatattctaagaacatggcacaccctccaccccgtgagaggactctaagggaattggctgcacctgatttcacctatgaaagcttgtgcatccaataccttgatgaggatgtcccatatgttcttaaaactggactgatccatttgctttcaaagtttcatggccttgcaggtgaagacccacacaagcatttgaaagaattccatattgtcttctccaccatgaaaccaccagatgtccaggaggatcacatatttctgaaggcctttcctcattctttagagggagtggcaaaggattggctatattaccttgccccaaggtccatcacgagctcggatgacctcaagaga

SEQ ID NO: 16224 - DNA, 312 bp, Glycine max
  Peptide Sequence Number=SeqID_107909
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccatgcgtttccccctggcggctccctcgtgcgctctcctgttcctgcctttcggtttaccggtgtcattccgctgttatggccgcgtttgtctcattccacgcctgacactcagttccgggtatgcagttcgcttctag

SEQ ID NO: 16225 - DNA, 366 bp, Glycine max
  Peptide Sequence Number=SeqID_107910
atgatttcgagattgagtcaagaacaattcaagaatcaagagaaagattcaagagaaagtttcaacaagaagattcaagattcaagattcaagaataatcaagatcaagattcaagattcaaagattcaagaatcaagagaatacttaatcaagataagataaagagtacatcaacttgggttgttgtgactgagaacaagagagggtacatctcttgtggatcagttctagtagagggtacatccactaggttgttcaaagagaacaagggagggtacatcccttgtggatctttgcttgtaaaggaatttacaaggttgaaaagaaatctcaaggaccgcatgtcgcttggggactggatgtag

SEQ ID NO: 16226 - DNA, 833 bp, Glycine max
  Peptide Sequence Number=SeqID_107911
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggagactacgaagagcacagatgccactgttctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatgggccgc

SEQ ID NO: 16227 - DNA, 765 bp, Glycine max
  Peptide Sequence Number=SeqID_107912
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacacactgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16228 - DNA, 165 bp, Glycine max
  Peptide Sequence Number=SeqID_107913
atgaccaccttgacccagacgtggatgacattgatgctcagcaatgtcttgcctagcgatgataactctgatctccctctaccgaagtgtcagttggtatatgccatcctgacacggatgagcgtccacgtggcccaggtatgccacccaccaggcaccctctag

SEQ ID NO: 16229 - DNA, 241 bp, Glycine max
  Peptide Sequence Number=SeqID_107914
agggctacacgtccttccttttagagggctacacgccctcccctttagaggactgcacgtcctcctcttcagagggctacgcgccctcaccttgagaggattacacttcctcgtcttcagaggactacacgcccttgccttcagaggacttcacgtcctcaccttcgtagtgttgcacgccctcgccttcataggactttacatttgtgccttcagagaactcaaggtcctccgcccttaa

SEQ ID NO: 16230 - DNA, 480 bp, Glycine max
  Peptide Sequence Number=SeqID_107915
atgatgagggaagcagtatcaaatcaatgctttacaagctttttggtggggaccaataaggtgcctgtggatgttcttcaatacgctgacgatacgatattctggtggagggaccttcgaaagatatatcaacggcctgagttcagtattattcagcagcagatgtcagcctacagactattgaggactagcaatccaattccggaggccaacatcttaaagactatatggaagctgaatgtacccccaagggctgcaattttctcttggagacttattttagatagattgcctactagaggaaatctccttcgaagaaatgtgcagatgcaggataattcatgccctctgtataacagatggaagacttggtggatagccttaacttggtctatatggaagcatcggaatgaggtcattttccataatgcacaattcaatggaatcaagatgctggaggatgttgtgtttttgcactag

SEQ ID NO: 16231 - DNA, 255 bp, Glycine max
  Peptide Sequence Number=SeqID_107916
atgctcaatggaatgtctcagaactcccccatgataagcacatgtcacgctggggttgtatcttctgggaaatggaggttgagaaatctttgttgggcttatgactgccattgcattatcgagcaaataggggagaacgacaatcacaacatgggtttctcccttttctttttccctccatttgccccaggcctcctatcaccagaattcatcgaagcagccttaagcaacataaacactactcttgatttctaa

SEQ ID NO: 16232 - DNA, 153 bp, Glycine max
  Peptide Sequence Number=SeqID_107917
atggaaaagcttgagaggattcagactgatgttgagcatggagctaagagcttgttggccttggatcttcttcatcactggagtcctttgcttcttgaagatcaacagcagtggaatggagaaggaggaaagatgattggagacgccacttga

SEQ ID NO: 16233 - DNA, 830 bp, Glycine max
  Peptide Sequence Number=SeqID_107918
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaatggttgccagaggatgaagaagagagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16234 - DNA, 657 bp, Glycine max
  Peptide Sequence Number=SeqID_107919
gaaagcccggtcgtcgccattttggccatgtatgacacgttcgaccggggatgtgaaaagagcggcgaaggatgtcccatgagaggagtgccatcagacgaaagcatcacgcctttcatcgcacgaggtttcagtgaccacaacgcgagggacagagagcttaggggaagcagtaatgagatcatcggcggctatcataagtggctaagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttccccgattgctagccaaggccaaagca

SEQ ID NO: 16235 - DNA, 377 bp, Glycine max
  Peptide Sequence Number=SeqID_107920
cccgggtggaggaatcatccaaccttagatggtcgagtcctacacaacaacagcaacaacaacaaccttatttccagaatgctgctagctcaagcagaccatacgttcctctaccaattcagcagcaacaaccccagaaacagcaaacagctgaggttcctctgcaatcttcccttgaagaacttttaaatcaacaacagtcccagaattttgatagattaccttctcaatatgtccagaatcccaaaaatgtgagtgccattacgttgaggtcgggaaagcagtgtcaagaacctcaactgcaacatcttcctcatccacaaatgaacctgcccaacttcactctactccagaaaaagatgatgacaaaaatttaa

SEQ ID NO: 16236 - DNA, 655 bp, Glycine max
  Peptide Sequence Number=SeqID_107921
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttgcatcggtgcgcaacttaatatccgtggtgttcaaggtgtcgagttttggaaaagatggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16237 - DNA, 615 bp, Glycine max
  Peptide Sequence Number=SeqID_107922
gagaagccaagaagtggctccattcattcaaaggtaacagtctgaagacgtgggctgcagaagggaaagcttctatttcatcatttcaacaattccctgataaatccttgagtgaagcattagagaggttttggggtttgttgagaaagactcccacacatggactcccacaaaccaagcagttgttagatgcttcagcaagagggaagataaaactgaaaacccccaaagaggcaactaaactgattgagaatatgtttgtcagtgatcatgctattctacgtgatagagtgcatcaacccaccaagaagagcttattggagttatcatcacaagacattgttgtaccatttatggtggtgctcatgaatccggccattgtattccttttaaagaacgaacggaggaagtcggttacatgggaaatcaacaaaggcaaggataaaatcaaggaggattctcaggtttccaacaaggtccctacaatcaacaaggacaatagagatcacaccctgaggactaccaaactggaagaaactctggctcaattcatgcaagtgaccatgtctaatcataagagtactgagtcagccctgaaaaaccttgagattaaag

SEQ ID NO: 16238 - DNA, 435 bp, Glycine max
  Peptide Sequence Number=SeqID_107923
atgaagcacttcactgacaccctcatcagtgccaacataaaagcaacaaaaaacaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16239 - DNA, 333 bp, Glycine max
  Peptide Sequence Number=SeqID_107924
atggtagcatggcccgggacccaaccttctcttcacagggaagatgaaggtcccacagcccaggtacctcagcatgtggaggatgagtcatctgaggccaccatcccagagccatttgttataagagaagaggcagaggagaaacaggtgagacaggtagctgctgccacacctgagcgatcccttaaggctacttcagagccttctgcacaaagggaggatataccctcacctcatcacgcagtagacccctccactcctcttctagagatgccagagggcccgactacatcagtcctggctatggacacttctcctccagctactctatga

SEQ ID NO: 16240 - DNA, 145 bp, Glycine max
  Peptide Sequence Number=SeqID_107925
tttttcttcctcatccctcttatctgtagaagcaagcttcatgatgatgaatcaagttaattcaagtagttttgaagatgacaaagatgacgacaaaaagcccaagagaatgatttcaagattgagtcaacaagttcaagatcaa

SEQ ID NO: 16241 - DNA, 207 bp, Glycine max
  Peptide Sequence Number=SeqID_107926
atggatgagtattacaaagagatggagatttccttgattagggttcgaattgaggagtctcaagagggagatccaagacattgtagagttgccccattatgcctctttggacaatctcattcatcaatctgtcaaggtgtagcagcaattaaaaaggaagcaaatatacaagaagtccccctatggctcttcaacttgaaaagataa

SEQ ID NO: 16242 - DNA, 117 bp, Glycine max
  Peptide Sequence Number=SeqID_107927
atggctccaaacttgggtggaggacacatgaagaaaacgcatattcaggggctcgcaaaaagattgagaatggagaattgcactaagcaatcactacgcatggctccaaactcgaag

SEQ ID NO: 16243 - DNA, 411 bp, Glycine max
  Peptide Sequence Number=SeqID_107928
atggataacaaagagggagtgcaagaacagatgaaggccgacctatcgaccttaaaagatcaaatggcttctatcacggaggccatgctaaagcttcaaaaaactatagaagataatgctatggcgaccgcttccaatacagctagggaagcggaaccggtgctacagcccgcaataaacttgggccgagacagaaacacgacaggtttcaatcggaggtatagtcctcaagcctacccttatggtttgccttcggacttcactccccgtaccgcttcagacgatttgagccaagcccctaccttcgagggacaactccctcctcatgccaactatcctctgcaggaagatgatgaaggagatgcccatttaggccctctacttcccctcaaggaaccagcccctccatga

SEQ ID NO: 16244 - DNA, 129 bp, Glycine max
  Peptide Sequence Number=SeqID_107929
atggaagagatacatgcagaagaagatgaagaacaaggaattaaaagctctttgcttcttgaagatcaacatcagcggaatggagaagaaggaaaagtgattggagattccacttctaggagaaaatga

SEQ ID NO: 16245 - DNA, 765 bp, Glycine max
  Peptide Sequence Number=SeqID_107930
atggaggccatgaaagaagagatggccacaatgatgaaggccatgatgagcatgaagaagataattgaggttttatcagtttctgggctgcatgccctcacctttagagggctacacgccctcgccttcagaggactgcatgtcctcgccttcatgggattgcacgtcctcgtcttcagaggattgtacatcctcgcctttagaggactacacgtcctcgccttcagagggctacacgtcctcgccttcagagggctgtacatcctccccttcagagagttacacgtcattgccttcagagggctgcatgccctctccttcaaagggctacacgcccttgccttcagaggactacacgtcctcaccttcagaggagtacacgtcctccccttcagagggctacaggtcctcgccttcaaaggactacagaggactacacgtcctcaccttcagaggactacatgtcctcgccttcagaggactacacatcctcaccttcagaggactacacgtcctccccttcagagggctacacgccctcaccttcagaggactacacctcttcgccttcaaagggctaaacgtcctcgccttcagaggactacacgtcctcgccttcatagggctacacgccctcgccttcagggggctacacatcctcaccttcagaggactacatgtcctcgccttcatagggctacacgccctcgccttcagggggctacacgtcctcaccttcagaggactacacaccatcgcctttag

SEQ ID NO: 16246 - DNA, 621 bp, Glycine max
  Peptide Sequence Number=SeqID_107931
taccctggtcttcagagcactacactcctcgccttaacagagggctacactgtcctcaccttgaagaggactaccgtgtcctcacttgtcagaggactagcatgtcctcaccttcagagggctagcacgccctcgccatccagaggactgcgtgcctcaccttcgagagggctacatgccctcgccattcagaggactgcatgttaccctcaccttcagaggggctacatgccctcacctttagaggactacacgatcctcaccaacagagggctgcacgccctcaccttgagaggactacacgactacacatcctcgccttcagaggactccattcctcaccttgagaggactacaccctcgccttcgagaggactacatgtcctcaccttcagagggctacacgccctcacatttagaggaccacacgtcctcaccttcaaagggctacacgtcctcgccaacagagggctacacgccctgacctttagaggactacatgtcctcgccaacagagggctgcacgccctcaccttgagaggactacacgccctcacctccagaggactatacatcctcgccttgagagggttgcacgccctcacctttagagggctacgt

SEQ ID NO: 16247 - DNA, 264 bp, Glycine max
  Peptide Sequence Number=SeqID_107932
atgactcgcccacccggcaacgccaactttggtgccggttccaacgcgacgaggaactttccctcaaggccaattccagaattcaccctgatcccaatgacatacaaagacttcttgccgtccctcatcgccaaccagatggctgtgatatctcccgggaagatctaccaagctcctttcccaaagtggtatgaccctgacgcaacttgcgcataccatgggcaaaactccgggccactctaccaaaagatgcctggcccgtaa

SEQ ID NO: 16248 - DNA, 323 bp, Glycine max
  Peptide Sequence Number=SeqID_107933
aatgcactaactatgttgcaggaagtacatacacttttgacttgctttatgaggtacaggctgaggaaccttcttcttctcctaccctgaagcacaagaaagccattggatggactttagcagacattcctggtattagcccatctacctgcatgcataggatacttttagaggatagagctacgccatccaagtgggatcagcttatccccaagagagtgcagaacaactggcaagtttgcattgattataagaggctgaaccaggaggatgtcatttggcctatgcaacgcccccggtaccttccagcggtgtatgcttag

SEQ ID NO: 16249 - DNA, 288 bp, Glycine max
  Peptide Sequence Number=SeqID_107934
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagtgttttcccagtcacgacgttgtaa

SEQ ID NO: 16250 - DNA, 174 bp, Glycine max
  Peptide Sequence Number=SeqID_107935
atggatgagtggagtgatagcttgggtcatggatcggtgtatggattccttgagtctcaatcaatacacaatgcgaaggacaaacgtgggcaatgtgaagaatatattggaaaatggcttaaggaatcgcaacgacaagtgtacttaggagcttatctgaatcaggcccattga

SEQ ID NO: 16251 - DNA, 648 bp, Glycine max
  Peptide Sequence Number=SeqID_107936
atgtcgagtggtagtgatgcttctgcgtacgaagagcccattcccaagatagacacaacctctgttcacactgagggggttctacaacgatattcaaactatccacccagagctgatcagaatcttttggtgaaaggctcaattcaaaatgtgctggctggtgaagatgatgccgtgtctcagtttggcattgccaacaagatcatgtttaagcaagccaacaggaagcagaccaaaaggcaagaacggaagtctaaggaggaggcagaaatccttagaaaggagcaatggacaaagaaaaagcatgagcctgcacccgtgtccaatgtctctagcaggcgtctaagggctactacttcaaagagaagtccaaagaagcaagctgtggatggatgtgttaggacaataggtggcgttgatcatactttcaaatctgtacctggtcttgagaatctcatcattgccaccttcaccactaaagcctctgtcatcactactgtcgcaacctacccttcggcgggagggcgacgcgagactcgcgggaagcgtgttccacgaaaggaatacgcgcggagtcgccaccaacgtttatttgaggaaaacgtcggaaaaaccggaaaagacgtgatctacgaactttttaagtga

SEQ ID NO: 16252 - DNA, 1101 bp, Glycine max
  Peptide Sequence Number=SeqID_107937
atgcttgccgcccagctcgcccaggcgagctcagctcgcccaggcgagcagggttgcttcctccagaagcaaccgccttctggaggaaccttctggagggcccaaatgggcctgggtgctatttgcacccccatttttactaagttcaccccctctgctggtaacggttgtaacgaggaagaacgctccactttcccttttcgcgaaaactacaaccttgcataccctagtagagggccagatctgcaactaacattcaggctttcctcctacgacgtcaaaaacctcgagaaagtttgttcggtgttggttggtgttgcaaatggcaagtgcctcagggttaaggcagctgtgaggagtcatgtaaaatctggtcatcacttccaggaagtccctatttggaaaaggaagattaagttagttgtatcatgtttatatgaatatgggatgatctggattattaaccttgttgagttgacatgttcggggaacaagctgaagaagtgcaagaagtggaacaatgacagagatctgaaaagcattgtccatggggctgaaattgtgggtgctactatgagctttggattacagttaccaaatgacagagtgatagtttgtcaaattggaagcagacatggaagtcttgacttgggcagcaatgattacatgaacaattacttccgtccccaggtctacccaacaagccgcatttatagccttaagcagtatgcacaatatgcagaagctgtgattgaagagttatctctgaatttagtggctccactagtgacatcatggactgaggaaaatccagggaggcatttttatggttgtggtctatacaaggatataggtaggaaagggtgtaatatttttcagtggcatgatccagttggcaacaatcgtcaaaagaagatcattgtagccttgatgaaggaggttgatgaattaaagttgagggaaaaggatttgcaaagcaggatcaaaattgatgcaatcctccttaggaagggaccagtcactagagccatgagcaagaggctccaagaggattgggctagagctgttgaagaaggccctaggattctcatgaacctcagg

SEQ ID NO: 16253 - DNA, 435 bp, Glycine max
  Peptide Sequence Number=SeqID_107938
atgggtagtgtaccaaaatgtaataactttaaaaaattagcccatttgttaaataggtcctacgcatcacatggcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16254 - DNA, 336 bp, Glycine max
  Peptide Sequence Number=SeqID_107939
atgaattgcgttttcgttcatgtgtcctccacccacgagtttagagccatgcgtagtgattgcttagtgcaattctccattctcccccttttttcggagccccatgaattgggttttcgttcagcacatccccctttcgccagctggcggaatagcgaagaggcccgcaccgatcgcccttcccaacagttgcgcagccggaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16255 - DNA, 465 bp, Glycine max
  Peptide Sequence Number=SeqID_107940
atgatcaagaagattaaggtgaaagttaggggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaagcctcgattttattttaagattaatgaagctggtgcaaaacggtattgcaaattgagtatgggaagaaaatgggctgcaaataggcaaagcttatggaatgaattcaacgatccaaccaaaacaagagatgaaatcataaaaaatgtgccgataggcatagataaagatcaatgggctcgttttgttcattatcgtcataaaccatcaacattgctaattatatga

SEQ ID NO: 16256 - DNA, 939 bp, Glycine max
  Peptide Sequence Number=SeqID_107941
atgacgatttccctgcatacccagactggcgcccctaacacctcagcggcgaccagcgtatccccgctggagcagtcaggctcctcaaaaacgaaattttccaaaaatagtaccgacatttatcagtcagttactgacagtatcatcgcggcactggaggccggtgttaagccttggtcatgcccatggcagcgcgtaccgggcatgtcaggattaccttcaaattatgcgactggcgctgcatacagcgggatgaatatcatgttgttgtggagcagtgcgtcagaacagggattcaatgattcacgctggatgacctacaaacaggcaaaagcggagggcgggcaggtacgcaagggagaacacggcactaccgccattttctataccacgctggaaaaggaaactgacgacggagaaactgactatatcccgattctgaagacgttcaccgtgtttaatgttgagcaaattaatggtttgcctatgagtgacgaagccgttttcccagcagggacttttgagccgttgccgcctgcggaggcgcttttccttaacagtggtgcaaccatcattgagaagggacagaatgccttttttgcaccatcaaccgacgaaatccatttaccggaacgtcgtctttttagcgatgctgccaatttctacgctacgggcctgcatgagttaattcactggtgtggggcaaaaagccggctgaaccgtgaaatgaaagggaagtttggcagtgagagttatgcttttgaggagctgatcgccgagttgggaagcgcgttcctgatggcggatttggggattgtcggagagagtcgtggtggtgttaaaggtataacctccctacgaatttttcgtggcactgtgtgtcaggaaaaattcgcaggctgcgggggcgggcggcaaagagcccgctcatcactttag

SEQ ID NO: 16257 - DNA, 204 bp, Glycine max
  Peptide Sequence Number=SeqID_107942
atggcagagtcaggcctagaagagtcagagtgggctcaagcgcgctatgaccaacttaaccttattgaagcaaggagtagaatcgtctcaggccacggtcagaagtcaagacaaatcaatggcagaaatcaaccaaggtacacagggacggatgcgagtggggctagggtcacgaccgaccaatcgttgcccttcccgggctaa

SEQ ID NO: 16258 - DNA, 501 bp, Glycine max
  Peptide Sequence Number=SeqID_107943
atggctgaagtaaatgaggtgcaagagctgatgaaggccgacatggaggccatgaaagaacaaatggtcacaatgatggaggccatgatgagcatgaagaagataatggaggtcaatgcggctgcacgattgcacgccctcgactttagaggactgcacgtcctcaccttcagagggctacacgccctcgcctttagagggctacacgccctcgccttcagaggactacacgtcctcgccttcagaggactacatgtcctcgccttcagaggactgcacgtcctcacctacagagggctacacgcccttgccttcagaaggctccgcgccctcgacttcaaaggactacacgtcctcgccttcagagggctgcacgccctttccttcaaagggatacatgtcctgaccttcagaggtctgccggccctcgccttcggagggctacacaccctcgcttttagaggattgcgccttcaaaggactacacgtcctcgcctttag

SEQ ID NO: 16259 - DNA, 426 bp, Glycine max
  Peptide Sequence Number=SeqID_107944
atggcacaccctccaccccgtgagaggactctaagggaattggctgcaggtgaagacccacacaagcatctgaaagaattccatattgtctgctccaccacgaaaccaccagatgtccaggaggatcacatatttctaaaggcctttcctcattctttagagggagtggaaaaggactggctatattaccttgctccaagcaacatggagagaagtatgatagatgttgctagtggtggagcccttggagaaatgacccctgctgaagccaaaaatttaattgagaaaatgacttccaactcccaacaatttagtgccagaaatgatgccattgtcattagaggagtgcatgaagtagccacgaattcatcttcatcaggtgagactaagaagcttgaaggtaaactagatgccttggttaacctg

SEQ ID NO: 16260 - DNA, 273 bp, Glycine max
  Peptide Sequence Number=SeqID_107945
atggtgaaagttggaacctcttacgtgccgatcaacgtctcatttcgccaaaagttggcccagggcttcccggtatcaacagggacaccaggatttatgcgtaactcacaccccgccgcgcttaatgcgccgctacagggcgcgtccgctttcgccagtcggaaacctgcggcactgcttaatgacggaacgggcgatcgagtgcgggcctcttcgcgtattacgccggcgctagggcggatgtgtgatactggcgattactatgttgggtaa

SEQ ID NO: 16261 - DNA, 414 bp, Glycine max
  Peptide Sequence Number=SeqID_107946
atgccaatctctccctgcagatgtgtcagttggaatcgcacccacaaagacacccagtggacccggagaagtccaacagggccttggggttttcaactctggttatgggcctctgtagtcctacaaggtgcccgttcccctggcaaggtcacgtcatcatggcatagggatcgcgcccgcaagacacccagtggacccaaagaagttcaacagggtcttgaattctacggagtgcctgtcgcccccagaaagatcatcaggccccctactaatcgagctttcatcaagaagtactgcgtccccaggcaggcgcagggcgaaacaccacaacagcctggggatggccggcagcgggcaatagacgcaccgccatcacctctagagttcatctcagctcatccacaaaaaggttag

SEQ ID NO: 16262 - DNA, 117 bp, Glycine max
  Peptide Sequence Number=SeqID_107947
atggggaccaccaagggggaggagcttgccacccagctcgcccaggcgagccaggttgcttcctccagaagcaaccgccttctggaggaacatcctggaaggcccaagtgggcctga

SEQ ID NO: 16263 - DNA, 875 bp, Glycine max
  Peptide Sequence Number=SeqID_107948
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcatactgattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16264 - DNA, 318 bp, Glycine max
  Peptide Sequence Number=SeqID_107949
tttgtgtgggagccttacacagcaactgttatatcattgttgtctcccatttgtgtattcggaagtgtcgcatggcgaaagacaaagatgtttgttgacccacaaaatgcaaacacagctacattggctgaagttgcagagacattacaatacatggtgtctcctcaagggaggaatacatggacagttgatgatcttgtgccttatgtggagaaaattacgattttatccgaagagcaagagagaatcactgagcctgtgtcatatggtccagcatcagagcgtcaatttccagcacaagagtttcacattctttag

SEQ ID NO: 16265 - DNA, 204 bp, Glycine max
  Peptide Sequence Number=SeqID_107950
gggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 16266 - DNA, 462 bp, Glycine max
  Peptide Sequence Number=SeqID_107951
atgtccccgcactccatcctctgtgggccaagcattagcctaaaactccaggactacctcagggtcaaacttagccatgggagtagccagcgacgtccaatgtcttcaagctatctcctcctgaaaatcggtgtactcatcgtccctgagctggacgcgtctctctcggtggaacaaccatcctttgatggcctcgaagcgctgctagtgcatggcgctccggaaacggagactatcaaactcgggggcggcactggtcccttcagccatagcgtccctcctagatctcttcgcagaaatctttttcggagccatttcttgttggagatgaataatagagcaaaatggaatcaaaacgtgaaaaatggtgacctacgggctgcaaaactcgtgaatcccaaaccttccccctccccctttttaacccccttcatgcagaggttgctcgcccaggcaagctaa

SEQ ID NO: 16267 - DNA, 471 bp, Glycine max
  Peptide Sequence Number=SeqID_107952
atgaacttaatcactgttatcaaaaggaaagatcacactttacggtgcccttaccaaacctgtgctagagctggagtaatgggtgaagtagaggaggtacaagaacaaatcaaggctgacatggaggccatgaaagagaaaatggccacaataatggaggccaatatgagcacgaagaagataatggaagccaatgcagtcgcagttgccgctaccagcactgctgctaaggtgaacttgacgcccccatctaacctcaaccaaatgaatcatccaacctcatatatggtaggtaaagatttgggaagtacgggcggcccccatgatgtgcaaattcaaaacgagcacgccttctcgccatatggcttgcctcccaactatacaccacccaatgtggcgtacactcccgatgaggatgtcaataactccgctcccatactcattgagagccgacaacctcatcatgcaaat

SEQ ID NO: 16268 - DNA, 124 bp, Glycine max
  Peptide Sequence Number=SeqID_107953
atggtgaaagttggaacctcttacgtgccgatcaacgtctcattttcgccaaaagttggcccagggcttcccggtatcaacaggatcaagcttatcgataccgtcgacctcgagggggggcccg

SEQ ID NO: 16269 - DNA, 348 bp, Glycine max
  Peptide Sequence Number=SeqID_107954
atggaggataggcgaagagcgctagggaatcaattcgcggggctgcagactctcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggagcggagatttcctggaagatgccatga

SEQ ID NO: 16270 - DNA, 185 bp, Glycine max
  Peptide Sequence Number=SeqID_107955
atgaacagtaagaaagtagcttattgcttgaagccaatcaagcttatcgataccgtcgacctcgagggggggcccggcggtttgcgtattggggcgctagcggagtgtatactggcttactatgttggcactgatgagggtgtcagtgaagtgcttcatgtggcaggagaaaaaaggctgcaccg

SEQ ID NO: 16271 - DNA, 245 bp, Glycine max
  Peptide Sequence Number=SeqID_107956
tgatctccgtcacagtggcttctgtttctatcagctgtccctcctgttcagctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 16272 - DNA, 389 bp, Glycine max
  Peptide Sequence Number=SeqID_107957
atgaacaaggctagagtgaagggtgaacttgcttatcaacacttcaaggcttcaaggtttctagaccagccctcaagagcaagaagaagaataagttttgctgctctaaactcccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 16273 - DNA, 608 bp, Glycine max
  Peptide Sequence Number=SeqID_107958
atggagtgcatggacaatattgcttgtgtaccatcatgtaatgatatcacctggaatgtgctatgtagcggcatcatagtgcggcaatatactctggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 16274 - DNA, 240 bp, Glycine max
  Peptide Sequence Number=SeqID_107959
atgggtctacgaataagattggagaatggagaattggctaacagcgctagaatggagaattggcgaacagcgctaggcaatcaattcgcggggctccagactcgatggtggaggacgcatgaactagcgctaggcaatcaagtcatgggtctacgaataagattggagaatggagaattggcgaacagcgctaggcaatcaattcgcggggctccagactcgatggtggaagacgcatga

SEQ ID NO: 16275 - DNA, 237 bp, Glycine max
  Peptide Sequence Number=SeqID_107960
atgactagcgctaggcaatcaattcatgggtctgtgaataaatttgagaatggagaattggggaaccgcgctaggcaatcaattcgcggggctccagactcgatggtggaggacgcatcaatagcgccaagcaatcaatgcatgggtctccgaataagattggagattggagacttggcgaacagcgttaggcaatcaattcgcggggctccagactcgatgttggaggacgcataa

SEQ ID NO: 16276 - DNA, 123 bp, Glycine max
  Peptide Sequence Number=SeqID_107961
atgcatatgacagaaaatggtcctaatggagaggaaggggaggcaacaaaaacacaacagcagattgtagaaagtatggatcaggagtatattaaaggaggccgaaatttcttttatacataa

SEQ ID NO: 16277 - DNA, 282 bp, Glycine max
  Peptide Sequence Number=SeqID_107962
catggacaacaatacaaccaacaacaaggacaatggaggaaccaccctgggaatcaattcaatagagaccagggtggaccgtccacaaggccgcagcaacaagggcctagtctctacgatcgtacaacgaagctggaagagactctagctgaatttatgcaggtttctatgtctaaccagaagagcacggagtctaccataaagaatctggaagtccaagtgggacagctcgcaaaacagttggcggataggccgtcaagcagctttagtgctaacacttag

SEQ ID NO: 16278 - DNA, 186 bp, Glycine max
  Peptide Sequence Number=SeqID_107963
atgatggaagcaatgatgagcatgaggaagatgatcgaggataacactgctatagttgttgatgcgagtcaaggaggcgagacagtgaaaaatgcatatgggcctcatcatgttcagattcagagcaaacattccttcccaccatacgagttgcctcctaattatacactgcctactgtcgtataa

SEQ ID NO: 16279 - DNA, 143 bp, Glycine max
  Peptide Sequence Number=SeqID_107964
atgacgccacttccagagagggaagataagtcaggggctcttattaaggcataccacaaagatagagtctacacctctttgggttctaggaagcccaaggacaaagtccatacaaatgtctacccaaggtgcagaggggatgg

SEQ ID NO: 16280 - DNA, 893 bp, Glycine max
  Peptide Sequence Number=SeqID_107965
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccaaaagtggaagatcaatatgttcagtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16281 - DNA, 440 bp, Glycine max
  Peptide Sequence Number=SeqID_107966
atggcagaagtctccacagaggccattgcctccctcgcccagtattatgaccagtcgttcaggtgcttcacttttggggacttccagctatcacccatggtggaagaatttgaagagatcctaggatgccctctagggggaaggaaaccatacctcttctcaggattctatccctctttagctagaatttctaagatagtccaaatctcggcgcaggaattagaccacagaaagcaagtcgaaaatggggtggttggagtaccgagaagatgtttggaggcaaaggcaagaatcttggcaggtagaggcgaatgggccctgttcatagacatcctcacacttttgatctttggaggagttctctttccaaatctggatgggttggtggacctggctgcaatcgacgcttttcttgcctatcacgaccgcaaggaagccgg

SEQ ID NO: 16282 - DNA, 767 bp, Glycine max
  Peptide Sequence Number=SeqID_107967
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16283 - DNA, 132 bp, Glycine max
  Peptide Sequence Number=SeqID_107968
atggtcaaatgtcgggtcggatccaaaggtagagaccaatcaaggtacttagggatcgaattcctgcagcccgggggatccactagttctagagcggccgccaccgcggtggagctccaattcgccctatag

SEQ ID NO: 16284 - DNA, 531 bp, Glycine max
  Peptide Sequence Number=SeqID_107969
atggctccgagaaagttttccgcaaagagatctaggaaggacgccgtggttgaagggactagtgccactcccgagttcaacagccatcgtttcaggagcgctgggcaccagcagcgtttcgaggccatcaaagaatggtcattccaccgagagagacgcgtccaactcagggatgatgactacacagatttccaggaagagatagctcgccggcgttggacgtcgctggtcactcccatggcaaagtttgacccagatgtagtcctagagttttatgccaatgcttggcccacggaggagggcgtgcgggacatgcggtcatgggtaaggggccagtggattccttttgatgcagacgccctcagtcagttcctgggagacccgctagtgtcagaggaaggccaggagtgcgagtatagtcagagaaggaaccgggccgatggatttgacgaggaggtcattgcccagctgttatgcataccggacgtggatgacgttgctactcagcaacatcctgcccagcgatcataa

SEQ ID NO: 16285 - DNA, 621 bp, Glycine max
  Peptide Sequence Number=SeqID_107970
cacacccgtgagcctcgcctcgcttgcccgcaagagggcatgttgcgacaggaggtgtttcaaaagaaggataaagaactcaggggaagtaacaatgggcccatcggtggctaccgtaagtggttaagagcccacgtgcaaggtttggattggctcttaagttggagaaccactaaaagggaggaaggtgaggcaccgaaggaagacgaagaagtcaacagcgagcttaagctctggagagaggaaaaggaccaatcacgagtagacagtttgatcttgaaagatgagttgaaggtttgctcaaggtccaaaagaaacttgtctcagcggttatgcggaacagagaccaacatgttagctatcatcagcaactaccaagaagaactaaatctagctacggcccacgagcatagagtggcggacgaatatgcccaagtgtacgcagaaaaggaggctagaggaagggtgatcgacacgttacatcaggaggcaacaatgtggatggaccgatttgctcttaccttgaacgggagtcaagaacttccccgattactagccaaggctaaagcgatggcaacacctactccgcccccgaggagatccacagacttctcggttatt

SEQ ID NO: 16286 - DNA, 498 bp, Glycine max
  Peptide Sequence Number=SeqID_107971
atggtgaaagttggaacctcttacgtgccgatcaacgtctcattttcgccaaaagttggcccagggcttcccgctgttctcctgttcgtactgaaagggtgtgttatccgtaattcggcacaaagctaccagccggacatcaggggcaagtggcgctccctttcgccagtcagggaaacctgtcgtgccaactgcattatgaatcggccaacgcgcggggatcgaggcgggcctttgcgtattgccagggcgaaagggggagtgtcatactggcgttactatgttggcactgtgagggtgtttccagtgaagtgcttcatgtggcagaaaaaaaggcgcacggtgccagcagaatatgtgaatacgatatattccgcttcctcgctcactgatagtggtcgaattggagctgcggcgaccgcggaaatggcggccgctctagaactagtggagatttccccggaagactgcaggaattcgatacatttcaaggaatga

SEQ ID NO: 16287 - DNA, 183 bp, Glycine max
  Peptide Sequence Number=SeqID_107972
atggaagcaaaagcgcaaaaatggtggcctaggggtgaaaatccgcaaatcccgtgggtgtttgcatttttgaatgagggaggagagttttgggtggagaaaaactccccctccctcatttttatgtttccaggctgtcccccagctgcgctttccgcttgtctagtgctgggcatgagatga

SEQ ID NO: 16288 - DNA, 474 bp, Glycine max
  Peptide Sequence Number=SeqID_107973
atgggcccatttttgtcaaacccgaaaagatccctcgtgggaggatgtgtggaaaaaagcacaagccatccaaaagcaaaacaccgcccccacgtgttgtctcgtgggggttatgattatttagaacagaagttcatggatgagaagacaaagaaaaaactagaggaagctactcattcaggaagcactgatggtgtcattaacccttcatctcccatcagacgacacgtgaaatggaagatggcccgcaccaagaaaactgggctgatggcgtctgaggccgcaaaggaaatcgctgagaagattgattctttggaggagcaggcatcacaggaacaccctggtcgtgtgcgtattgctagagccggtgtcaccatcaagcaatacttcggatcagctccacgaagctcccgcagttcctcctccatccctcccgaagaactcgagcagctcactcaacaaatcacggactag

SEQ ID NO: 16289 - DNA, 579 bp, Glycine max
  Peptide Sequence Number=SeqID_107974
atggtcattgaccaatccctcttctatgatttgacccaattgtctagtgatggtgtaccatttgaaggtgcactgcatgatgattggaaatttgatttttttgtgcataatgtccgccggttggtttgcaccaaccaagcggatatgatcggaaggctgcttgtcggttcattggctcttgaaagccgcatcctccattatctaattgtctgtatcttactctctagatcttcaaaccttgcacaggtttctgaagaagatctaatagtcatgtgggcctttcataccggccgacaaattgattgggcacatctagtccggtactgcatgcataaggcattgcaattaaatgctcctttgccctatcctcacttagttacctggttccttcaacattttaacatccctcttgattttgaaccttatgttccaatcaagagatctttcttgatcggtgctactgtggttgcctcctttggttaccgtaaagagcgtgatggctcttgggtaaaaaagggtgcacaaccaaatgatgctgaagggcacttaccagttgaagaggactcttctctcctttag

SEQ ID NO: 16290 - DNA, 186 bp, Glycine max
  Peptide Sequence Number=SeqID_107975
atggaggttgaggaaccttggttggggttatggctaccattgaattatcgagtggatatgggatcaagtttagcatatgacaacggaatttggggtgaaccctacaagctttttgctgcaaaattcctttttgttggtggtcttcgtcattggaagtgcggtagacaggctttgtggttgatttag

SEQ ID NO: 16291 - DNA, 270 bp, Glycine max
  Peptide Sequence Number=SeqID_107976
atggaggttgatgaaccttggttagggttatggctaccattgaattatcaagtagatatgggagcaaggatggcctttgtggataactgggcggtgggtaaggagaagactcactttgatcatttcgccggcgaagacccaaatccgcaaagcttgaaggtgccacttgagctgccaggttctccatctttgggcgtattcttcgaaagatccgtgccccccttttgcacatgttctgtagttgcatcctatccgaagccattatactga

SEQ ID NO: 16292 - DNA, 586 bp, Glycine max
  Peptide Sequence Number=SeqID_107977
atggctaagcatcagaagagcttcaaagctaagaagcttcagaaatggaggatggctttgcaacaagtagctgacttgtctggctatcatttcaaagatggagattcatatgaatacaagtttattgggagtattgttgaggaggtctctaggaagattaatcgtgcttatttacatgctgtggattatccatttggtcaatggtcacaagtgatggaggtaaggaagcttttggatgttggatcccatgatgttgtccacatcatagggatccatggaatgggcgggttaggaaaaacaacacttgctctggcagtttataatttgattgctcatcattttgataaatcttgttttcttgaaaacgtgcgagaagaatcaaataaacatgggttaaagcaccttcaaagcatcctactttcaaaattacttggtgagaaggacatcaacttaacaagttggcaagaaggagcttcaatgatacgacataggctccgacgaaagaagattctcttaattttagacgatgttgacaagcgcgagcaattaaaggctattgttggaagatctgattggtttggtcccg

SEQ ID NO: 16293 - DNA, 177 bp, Glycine max
  Peptide Sequence Number=SeqID_107978
atgtggtatcatggagaccagtcagggtcacagtgttttgcgagaatgctccaaccatatgggatcaacataggcttaaaggagcactcaaatcgggtgactcccaaggcctacactccgaagagtccgtcagggcctctccctcatgattcaggttcaacccagaaaacattttag

SEQ ID NO: 16294 - DNA, 1196 bp, Glycine max
  Peptide Sequence Number=SeqID_107979
atggcgaatcaagaggagtgggtcccgtttatggacgtattagcattgctaatctttggggttgtcctctttccaaacatggatggtttggtggacctagccgcaattgatgctttcgttgcatatcaccatagcaaagaaagcctggtggtagctatcttggcagacttatttgacacatttgaccgaaggtgcgagaagagtagagcacggatcatctactgtttacccgctctttatgtatgggttggtttcacacctattccaacaagacataaggcatccatgtccgctccgaagccatcgttcatgtgtcgagaagaggagagtagattgggaccaacacttgggctggggataggaggtagaacaatcaactggtttccacgatggaaggaaggaaatgagggagttctcttctcatgtggggactaccctaacatcccattgataggaacgaggggttgcattaactacaatcccgtgcttgctataagacaaatagggtaccccatgaggggagcaccgacggaagaaagcctctctcctttccttgtgagagattttggcgtgcaatgtttcaagattatacaaagagtccataaggcgtgggaaagcccgttaaggaaagataaagaacttaggggcattcgtaatggcatcattggtggttatcatgaatggctgaaagttcatacacgagggttagattggctctccaagttaaagattatcaacgaagagaacttcgaagctccggaagaggatgaaaaagtccaagctctaaaaaccgaactaggaaaagcgagacttgccaaagaaaaattcaagttggtcgctacagacgttcgaaaagagtgtgccgggttacgagaagaaaatgcagttaccgcaagaacccttgaacaagaaaccaagagggctcgcaaggaagagcatggccgtgacaaatttcgtggagctttgtggggcagcaacaatgagctcaagcttcgaagggaagagagagaccaatcacgagcacatagcatggtcttgaaagaggagttagctgcttgctcaaggtccaaaagaaacttgtctcagcgtttatgcgagacagagaccaacatgttagccatcgtcagcaagtaccaagaagaactaaatctagccacgacccacgagcataaagtggcggacgagtatgcccaagt

SEQ ID NO: 16295 - DNA, 794 bp, Glycine max
  Peptide Sequence Number=SeqID_107980
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcacctgttgaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16296 - DNA, 258 bp, Glycine max
  Peptide Sequence Number=SeqID_107981
atgcttagcaaccatgtcaactttagtgcaactcctttatgtgcaatttcgggaaggacttcccctggtaactcatcgcataattcatctcaatgtaagaagctaggtctaaccacaacacgaccattgactctaatgttgagatgcagtgcatcatcttcgagtgtgatggtgcactcaccctatggatcaattctatactatttgattagggcaatatgttggaacccggtagacgataataatggaagtgattaa

SEQ ID NO: 16297 - DNA, 315 bp, Glycine max
  Peptide Sequence Number=SeqID_107982
atggtcattctgcgccctttgtcattcaggagtagtaagtcgagtgataaatgcgcagagacaaattatggtcattctgcgccctgtcattcaggagcagtgagtcgagtggtgggcggagacaaattatggtcattccgcacaccttttcgccatccagaggcgattgtgtccgatggcacgcagagacaaattatggtcattttgcacctttccatcgaggcccgatcgtgtccgatggcgcacagagacaaattatggtcattctgcgccttgtgtcaaccaagaggaatgaattcggcagtatcaggatga

SEQ ID NO: 16298 - DNA, 249 bp, Glycine max
  Peptide Sequence Number=SeqID_107983
atgcctaaaattattacacacaaatggaagtttggtaacctattggaggctcccaacacacttcaaatgaaaggcatttttgttacaaaatttgaaagcaatgaagtgcttctcagtccaataaatcttaaggtggttggacccttgcttcttgactcaaattcttcaagggatgacaccaatcctcctttccatgtggagcttgtaggccttggatcttcttcatcaatggagtcctttgtttcttga

SEQ ID NO: 16299 - DNA, 600 bp, Glycine max
  Peptide Sequence Number=SeqID_107984
atgagtcatcattcatctagtgttaatggtgagggaaggcataggtcacatcttagacctgactcccataggatagaaaaggaaagaaagcctcaagaggctaacattaaccttccatacttccatgggaaggacaatgtagaggcttacttagattggaaaataagggtaaagcatcaacttaaaagaaagtctactttaaaatcttatggccctcactcttatccaaagaaagaccaaggtcaaggcatcttaggggcgacaccttctaagtccaaagatgataaggggaagacaatagaaaaaaatctaccccaggaagaaggacaacctttaatggttaaggaggagtgtaaggaggtaaatgtctcctccaagagtgatcaaggagttcccatggaccctaagagaataaaggtcattctagagtggctcactccaccaacaccactcattgagttggtgaggaaccatgttccctcatgggaagatggtgtcgaggaaagaagcccagagtttcaagaacctctggatttgaggtcaaatccttttcaagggggaagggatgatgcaatcctaccccgcaagggcattggatag

SEQ ID NO: 16300 - DNA, 213 bp, Glycine max
  Peptide Sequence Number=SeqID_107985
atggaatttccggaagagtcactcgtcagagcagaggaagggaattcggaactcaatcaccaagttaaccttcccattgtctatgccagcaacaaaggaagagcagtggagcttttcttccttgttttgtgcgagttaagaggtaaagtcagtgtgagcaatgtcggttattctttttttccttggaccggtagggaagtaatcgaggtgtaa

SEQ ID NO: 16301 - DNA, 774 bp, Glycine max
  Peptide Sequence Number=SeqID_107986
atgtcctcgcctttagaggactacacatcctcacctttagagggcaacacgccctcgcattcaaaaggctacacgcccctcacctttagaggactatacgtcctcaacctcaagaggactacacgtcctcaccttcagaggactacacgtcctcgccatcagaggatgcacacgccctcaccttcagagggctacacgtcctccccttcagaggacaaaagtccctcaccttcagagggctacacgtcctcgcctttacagggctacacgtcctcgcattcagaggactacacgtcctcgccttcagaggactacacgccctccccttcagaggactacatgtgctcacctttagaggactacacgtccttcggcttcagaggactacacaccctggcctttagaggactacacgtcctcaccttcagaggactacatgtcctcgcctttagaggactacacgtcctcacctttagagggcaacacgccctcgcattcaaaaggctacacgccctcacctttagaggactatacgtcctcgccttcagaggactacacgtcctcgccttcagagggctacacgccctcaccttcaaggactacacgtcctcgccttcagagggctgcacgccctcaccttcagagggctacacgcccttgcctttagaggactacacgtcctcaccttcagaggattacacgtcctccccttcagaggactacatgtcctcagctttagtggactacacgtcctcggcttcagagggactaaac

SEQ ID NO: 16302 - DNA, 291 bp, Glycine max
  Peptide Sequence Number=SeqID_107987
atggagaggaccactttaggtcgtggtttcctttcttttcttgttttcttggtgacaattctgtattgtttagatattgtctggttcaaagacctttctacatatttcttctgttttcttccgatctttgattgggaatttgtggttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagatgtaatttacgaactttaa

SEQ ID NO: 16303 - DNA, 702 bp, Glycine max
  Peptide Sequence Number=SeqID_107988
atgcagaactatcaacatgcaaagatatctaattctgcaaaagccaggatcaacaggaaacgtatcatgcagcagaagcgacatcctcatgctcagtcatcttcacaaccaacaactaattgcacttccgaatatgatatcattacgtctgattcatcagaaagtgtaaattctgaatccacacaaggttcgagctctaattttttaactgtctatgaggattgccaatctccaactaatcagcctgtaatcaacactgaaggatattctgatcttggtgatcaactcatgcaatgtagatattgtaatgcacaaatgtggtatgatgaaagaatatcaaaagataaaaattgtcagagtccaaggttcaacttatgctatggagatggcaaagttgaattgccattattacaaaatccaccccaatatctccaacgacttctatttgatgataatacaattgatagtaaaaattatcaacataacttacgagcatacaacatgatgtttgcctttacttctgctggaattaagctagacaaaacagttaataattcaagaagacctcctacaattagaatacagggccaaccatgccacagaataggcagtctattaccaatgcctggaaaaaacccaaatttgcacagctatatatctttgacacagaaaatgaagtgcaaaatagaattaatgccatga

SEQ ID NO: 16304 - DNA, 264 bp, Glycine max
  Peptide Sequence Number=SeqID_107989
atgttgttcgctcctggctggaatgtatgcacgaaccccccgttcagtccgaccgctgcgccttatccggtaactatcgtcttgagtccaacccggaaagacatgcaaaagcaccactggcagcagccactgccagttacctcggttcaaagagttggtagctcagagaaccttcgaaaaaccgccctgcaagggggttttttcgttttcagagcaagagattacgcgcagaccaaaacgatctcaagaagatcatcttattaa

SEQ ID NO: 16305 - DNA, 378 bp, Glycine max
  Peptide Sequence Number=SeqID_107990
atgaatgacggcgacatgaccatcgagaagcagggtgtggcgctggtagttgacccgatgagcctgcagtatctggtgggtggatcggttgactacaccgaagccagaactcaccactcaatcgtcaccaggcgtgccgtttcacggcgtgatgcatcgcggtttattacgctttgtgtcacgcgcggctgcgcgctgaaatgccggccgcagtcaacagatggcagcgtctgctcactcgggcgtgagatatcgcagcgggagaaaatcgttagcgagacggcgatagagcccgtggtggttgccgcaccgatcggtgcagccacgatcagccctatggccagcagcagcgctctggtcatggtgaaatcctggtga

SEQ ID NO: 16306 - DNA, 219 bp, Glycine max
  Peptide Sequence Number=SeqID_107991
atggtgagaagtatggttagtcattcttctttgccagagtcactttggggagaagccttaaagaccacagcttacatccttaatagtgtgccaagtgctaaaagcaaaaagtgggaaataacgaagaaaaaaagaagaaatcagaaaaggcccagcccagagctcgcgcttagcgcgcaacacgcgctaagcgggctaggaagcacaagtgctaagtga

SEQ ID NO: 16307 - DNA, 655 bp, Glycine max
  Peptide Sequence Number=SeqID_107992
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggccttttcgctattacgccagctggcgaaagggggatgtgctgcaaggcgattaagttggggggggcccggtaccagcttttggtccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaagctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16308 - DNA, 459 bp, Glycine max
  Peptide Sequence Number=SeqID_107993
gcatgtcctgccattgagggactagttgctggaacaggactaagtcctctgatcgcatgttcgatagacactggcgaatggggacttttgtcgtcatttgtcgagcggtggcaccgggagacttctagtttccatctccctatgggagaggtatgtgatatctatgagcgccgatgccaggcaggacattggacagttgcggctcgcgcatttcttcttcatcttctgggttgcactcttttcgctaacaagagtgcaaccaatgttcatgttgtgtttttggaggcccttcgtgacctcagtcaaactaggagttacgcatggggagtaactacgctggtgcatatgtacgaccacctgaatgatgcttctatcagcactagtcgacagcttggtggttacatcacactgttgcaggatatacgagcactttccctcagtcacggagtccactactga

SEQ ID NO: 16309 - DNA, 996 bp, Glycine max
  Peptide Sequence Number=SeqID_107994
atggccgttgagccgtggaacttcccgtactaccaactgatgcgcgttctggcgccgaacctggcggcggggaacccggtcatcgccaaacacgccagcattgtaccgcactgcgctgagacctttgcccatctggtacgcgaggcgggtgcgccggaaagggcgtggaccaacctgtttatctcgtccgatcaggtggcgaacatcatcgctgacgatcgcgtccagggtgccgcactgaccggttccgaaaaagccggtagcgtcgtggccgcacaggcggcgaagcacatcaagaaatccacgctggaattgggggggaacgacgtcttcgtggtactggatgacgccgacctcgaaaaagcggtgaagacgggggtcagtgcgcgcctcaacaacgccgggcaggtctgtaccgcggcgaagcgctttatcctgcatgaaaagattgcggatgccttcctgactaaattcaccgaggcgtttaagcaggtgaaaatcggcgatccgctggacgaaagcaccacgctgggaccgctgtcgtctaaagatgcgctggaaacgctgaccaaacaggttaacgaggcggtgaaaaacggtgcgacgctgcactatggcggtaaacctgttcagcgtgacggcagcttcttcgagccgacgattctgacgaatatctctcgcgacaacccggcgtatttcgaggagttcttcggtccggtggcccagatgtatgtggtgaaaagcgacgacgaggccgtcgccctggcgaacgattcacactatggcctgggtggggcggtattcagtcaggatatcgagcgcgcgaagaaaatggcgtcgcggattgagaccgggatggtgtacatcaactggctcaccgataccgcgccagagctgccgttcggcggcgtgaagcgctccggttatggacgcgagctgtcggatctggggctcaaagagtttgtgaaccagaagctggtggtggtgcgtaaataa

SEQ ID NO: 16310 - DNA, 219 bp, Glycine max
  Peptide Sequence Number=SeqID_107995
atgtgtctaccggggaaggggaaggaaacactgggttcaacaaaaatagaaggaaatcactcaaagtgtattaacctcacacagggcaaggtttatggtgagttgggactttggctcaaggcttgtagaacggatgacatgatatatgtcagggtgttggtctggttcagggataaaaggaaatgtcccacattatttccataccacgggatcctctag

SEQ ID NO: 16311 - DNA, 156 bp, Glycine max
  Peptide Sequence Number=SeqID_107996
tttgtcagaaggttgaccaagtctgctcactttattcccattaatatcatattttccttggagaagttgacctccttgtatattagtgagattgtcaggagaattataagcaattgggcatcgatccggaattgggctgaaccgtcttggacttga

SEQ ID NO: 16312 - DNA, 907 bp, Glycine max
  Peptide Sequence Number=SeqID_107997
cgtgcaccgtccgcacaccatcagcgttaatgcattgggtaacgccatgaacatggggcagacgctggccgtttacgccacgctgtgccgtgaaaaaggctggccgtttatctttcccggctcgccgcagcagtggaacggtctggccgatgtcaccgaagccggtttactggcggaacagctgctgtgggcgaccagtgctgaaggggctgccaatcaggatttcaacgcggtgaacggcgatgtcttccgctggaactggctgtggccgcgtctggcagactatttcggtattgaagctgcagactatccggcgcagatgatgccgctggaaggacgcatgcaggaagccgcagcggcctggcgtgagatcgctgcgcgctatcaactgcgtgaagcggacattgataaactggcgtcgtggtggcacaccgatgcggatttgggccggccgatggaggcgtttaccgatatgagcaagagccgcgatctgcacccagcgccggccaagcaatacggtcagcacgatgatgctcacgatggccgccaggtgctgcagcaaatccagcgcatgcagatgcaccggatgacagaacgccagcaggcttaccgccatgcaggcgacgcccaggcccgccatggccagactgcgggccggatagagtgttcgcgtccggcgcagactgaggatggtcagcagcagcatcggcagactcaccaccagcaggaaaacaaagcacggcagtgtgtcgtgctgctgcagcggcgtggccgtttgcagcagactgctggcgctcaatcccagccacagcaggcccggcggcaacaacagctttgcgctgatgccgcgccgccctgcaatgctgagttcaaaaggcgctgcgcatcgccagcagcccgaggataa

SEQ ID NO: 16313 - DNA, 423 bp, Glycine max
  Peptide Sequence Number=SeqID_107998
atggtgaaagttggaacctcttacgtgccgatcaacgtctcattttcgccaaaagtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctga

SEQ ID NO: 16314 - DNA, 2070 bp, Glycine max
  Peptide Sequence Number=SeqID_107999
atggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctga

SEQ ID NO: 16315 - DNA, 824 bp, Glycine max
  Peptide Sequence Number=SeqID_108000
atgttcgttcgattcaccgcccgctgtaccgaagcgcttcaccagccacgcggagcagaggatgccgctcatcgaacctatcgacaggccgaacagcacgatgcccatctcagcggtagagacggacaaaatatcgcgaatggcgggcgtacgcgtggcccaggaggccatcagcaggcccggaataaagaagaacataaacagcgcccacaggcggagctgcagggctttacgggaagaggtttgcgtcatcggggttgcaccagaagtacatcaatagcgacaacactagcaagtttgtgtacatttgtacacaaaccacgtgaggaatttatgagcagaccaccgaacgatccgcatcgccgggagaagatcctgcaggcaacgctcgataccattgctgaacacggtattcacgccgtcacgcaccgtaaaatcgccacctgcgccggcgtgccgctggggtcgatgacctactattttgacggaatggagccgctgctggaggaggccttcacgtggtttacccggcagatgtctcagcagtaccgggatttcttcgcgggcgtcaccggcccggagatggcgtgcgaatccatcaccaccctgatccacagttcgcaggtgacgacgccgcacaacatggcgctgatgtatcagctctacgccttcatgcaccgcagcgcggcgctcaaaacggtgatgcaggactggatgaagatgagccagaccacgctggagcagtggtttgacccggtcaccacccgcgcgctggatgccttcatcgaagggatgacgctgcactacgtgactgaccgggcacc

SEQ ID NO: 16316 - DNA, 198 bp, Glycine max
  Peptide Sequence Number=SeqID_108001
atgctgcaggtcgactctagaggatccccccagacccttgagtctggcaggtaccaaaatgagacttttcacagtctcggccggaagacgctgaaatctccagggaagtctcagtcggaagacactgacatctccagggaaggtgcagatgacgacgttagtcactgcatgatatcgggctttgagtcttacggataa

SEQ ID NO: 16317 - DNA, 660 bp, Glycine max
  Peptide Sequence Number=SeqID_108002
atgccggaaacggcgacccgcattggcgagaaactctcgctaaaagagctgggtcgggattacaaagccgtgctgaagaatggccgctttgtggccggtgcgctggcgacagggtttgtcagcctgccgctgctggcgtggattgcgcaatcaccggttattatcatcagcggtgaaaagctcagcagctacgagtacggtctgttgcaggtgccgatttttggcgcgttgattatcggtaacctggtgctggcgcgtctgacgtcacgccgcaccgtgcgctcgctgattatcatgggcggctggccggttgccgcggggctgattctggcggcggtggcgaccgcggcgtcctcccacgcttatttgtggatgacggcggggctcagcctctatgcctttggaattggcgtggcgaacgccgggctggtgcgcctgacgttgttcgccagcgagatgagtaaagggacggtctccgcggcgatgggaatgctgcagatgctgatttttaccgtcggtatcgaggtgagcaaacatgcttacgcgttgggaggcaacggtctgttcagtctgtttaacctcgccaacggcgtgctgtgggttggcctgatgatggtgttcctgaaggacaaacgcgtcggaaacgccctgcaaccttaa

SEQ ID NO: 16318 - DNA, 518 bp, Glycine max
  Peptide Sequence Number=SeqID_108003
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccggtgcgccttatccggtaactatcgtcttgagtccaaaccg

SEQ ID NO: 16319 - DNA, 501 bp, Glycine max
  Peptide Sequence Number=SeqID_108004
atggctactccacctgcatcgcctcctcctcctcctcttcctcctcctcctgtagacgcatcagcgtctccatctacgttgaagtggacacacaaggcgacacggctacgatcattggcaactagaccacctggggcagaaagacctgtggtcaacgtcgatcctgctaccggcaaggccgacagtccccataagaagaaattaagaacatatttggggattgtcgctcgtgataaggtcgacatgacatatgacacctggaaggaagtccctgcttctcagaaggatttgatatgggaggattttcaggcggaatttgaaatccctgaagcttctgacacacttgcagccaacaaggacggtgtggatgacattgtctgtgaaaaatacggcattagcaaggagaaatgggcccagttttgtcagacccgcagagacacctcgtgggaggatgtgcggaaaaaggcacaggccatccagaaacaaaacattgccccccac

SEQ ID NO: 16320 - DNA, 363 bp, Glycine max
  Peptide Sequence Number=SeqID_108005
atgactagaggcaatccatttgacttacaaccctttgatcctgagatagataggacatttcatagattagttagacatcattttgtaccttttgagcatcccgagcattctgttattggtgattttgagcattatagttttcaacattctgattttgaacattctgagaacatggcacaacctccaccccgtgaagacccgcacaaacatctgaaagaattccatattgtctgctccaccatgaaacccccagatgtccaggaggatcacatatttctgaaggcttttcctcattctttagagggagtggcaaaggacttgctaatattaccttgctccaaggtccatcacgagctgggatga

SEQ ID NO: 16321 - DNA, 825 bp, Glycine max
  Peptide Sequence Number=SeqID_108006
atggcgcagtcgatggagacggtattcgactgcaagcctggccaggtgatgttttccacctctgatgtcggctgggctgtcggtcattcctacaatgtgtacggcccgctgatcggtggttgcacctcgctgctgtacgaagggctgccgaccaatccggacccgggcatctggtgggcactgtgcgagcagtacaacgtgcgaacgatgttctcttcgcccaccgccatccgcgtgctgaagaagcacgacgcagacttcatccatcgccacgacctgcgcgcgctgaagtacctgttcctggccggtgagccgctggatgaaccgaccgcgcactggatcagcgaagcgctcggcaagccgatcatcgacaactactggcagaccgaaaccggctggccggcactgaccctgctgccgggcctggagatgaagccggtgcgcttcggttcgccgggtttccccaatctcggctatcggatgaaggtgatcgacgagaacaccggtgaggaagtcgcaccggggcagaagggcgtgctggtggtgtcgccgccgttgccgccgggctgcatgagcacggtgtggaatgatgacagccgcttcctgcagagctacttcagccacttcaaggaactgctgtacagctcgctggactgggcgatccgcgatgatgatggttacaccttcatcctcggccgcaccgacgatgtgatcaacgtggccgggcaccgcctgggcacgcgcgagatcgaggaggccatttccagccatccgcgcgtggccgaggctgccgtgatcggggtcaaggacgaactgaaggggcag

SEQ ID NO: 16322 - DNA, 72 bp, Glycine max
  Peptide Sequence Number=SeqID_108007
ggaattggaaaggaggatcggtgccatacctttaagaatttgagtcaacaagcaaagggccaaccaccgtaa

SEQ ID NO: 16323 - DNA, 504 bp, Glycine max
  Peptide Sequence Number=SeqID_108008
atgcggagacaaaatttggtcattccgcacccctttgccattcagacacagtcgtgcccgatgagacaaaatttggtcattctgcaccctttgtcatccagaggcggcgggcccgatgacatgcggagacaaaatttggtcattccgcagccctttgccattcagacacagtcgtgtccgatggcgcgcagagacaaaaatttggtcattctgcaccctttgtcatccagaggcggcgggcccgatgacatgcggagacaaaatttggtcattccgcagccctttgccattcagacacagtcgtgtccgatggcgcgcagagacaaaatttggtcattctgcaccctttgtcatccagaggcggcaggcccgatgacatgcggagacaaaatttggtcattccgcacccctttgccattcagacacagtcgtgtccgatggcgcgcagagacaaaatttggtcattctgcaccctttgtcatccagaggcggcgggcccgatga

SEQ ID NO: 16324 - DNA, 435 bp, Glycine max
  Peptide Sequence Number=SeqID_108009
atgagggacttagcaacctgggagaggagtatgattgatgctgctagtggtggagctcttggtgatatgactcctgttgaggctaggaatctgattgagaagatggcttccaactcccgacaattcagtgcaagaaatgatgctattgtaattagaggagtccatgatgtggccacagattcatcttcatctgctgaaaataagaagcttgagggaaaacttgatgccttggtcaacctagtaactcaacttgccataaatcagaaatctgcatcttcacctattactgttgcaagagtctgtggtctatgttcttctgctgatcaccatacagatctctgtccttctttgcagcaatctggagtcaatgagcaacctgaagcctatgttgcaaacatttataatagacctcctcagcagcaaaaccaacaatag

SEQ ID NO: 16325 - DNA, 243 bp, Glycine max
  Peptide Sequence Number=SeqID_108010
atgtgtgaggttgggaagcgtgtgacttataaccaggctgtcggcatatttggttttgttggtgaagatcatattggaaaagttagttttccacctgtgcagttagttggtttccttagtcactatctcttctttgcgggtaccgagctcgaattcgtaatcatggtcatagctgtttcctgtgtgaaattgttatccgctcacaattccacacaacatacgagccggaagcataaagtgtaa

SEQ ID NO: 16326 - DNA, 129 bp, Glycine max
  Peptide Sequence Number=SeqID_108011
atgcagaattcaaaacgggatgtgtacctaggagcctacctgaatagtgctttgaaaggacttgacgatactccacaacctaaatccaaggctggtgctaggtggattgttgttaaaactaatttgtag

SEQ ID NO: 16327 - DNA, 165 bp, Glycine max
  Peptide Sequence Number=SeqID_108012
ggtctgcttgaggaagcattgaccatgcggtcaaaaatggaagacaatggttgcatccctagtgcagtaacttttgaaatgatcatcaatgctctctttgaaaaagatgagaatgataaggcagaaaaacttcttcatgaaatgattgctagaggcttgttgtaa

SEQ ID NO: 16328 - DNA, 321 bp, Glycine max
  Peptide Sequence Number=SeqID_108013
atggttcttggaagtagcttctacgttggtgttggaaatagttttgctttttggatgccaatccggatagcgatggagtttaaaacatgtctccatgacatgattattcccattgcagtgggtacacttgcggattcctttcttagaatacttcttaatagcaaagccaatccctatagtagactcactatcaagcatagcctcttggcgagattacctgatgagaatcctgaaactggccaaatacatgctaaaggcccaagtggagaaggacaaagcccccgagtggagaaggatgaaggccaaagtggagaaggatga

SEQ ID NO: 16329 - DNA, 129 bp, Glycine max
  Peptide Sequence Number=SeqID_108014
atggtgggtatcggaaggcaaaggagaagaggagaagggaggcaccatccacaagggaataagccaaggaagaaggagcttcaccaccaagaattgacttggataaaaagcttgaagaggatgctttaa

SEQ ID NO: 16330 - DNA, 300 bp, Glycine max
  Peptide Sequence Number=SeqID_108015
atgggtgccaagtacctcgaagtggtcaaacgaggttcgcatcccaacaacggatggtccccggacaaaattaggggaagtaaagataagacactaatttcgttcgggcgaaacaccattcagttggtgaatctccctgccaacggaacctgcaaaaattttgaaaatgatcagtaccgacacatcatcccgatactgtcgaattcgttcctcttggttgacacaaggcgcaaaatgaccataatttgtctctgcgtgtcttcgggcacgatcgagcttgggtggcaaggcgcagaatga

SEQ ID NO: 16331 - DNA, 399 bp, Glycine max
  Peptide Sequence Number=SeqID_108016
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcacagactggacagtcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 16332 - DNA, 231 bp, Glycine max
  Peptide Sequence Number=SeqID_108017
atgccgataactgattctatttaccagtttgcaacgattacacctccgagacacctagtggacccagagaagtccaacaggaccctggggtttcctgctctgactacaggtctctatcagttctatggagtggcggccaaccccaccaagctcatctggcctcccatcagtagggcctacatctataagtactacatgctcaggaagatgcagggtcgggcaccccagtag

SEQ ID NO: 16333 - DNA, 177 bp, Glycine max
  Peptide Sequence Number=SeqID_108018
atgacctgggtcgcaacatcagtcgtgatggtgatggcgacaacattgagagttgtcaggtgtgtggaacattgcggtggagatggactgttagtctctcatactactagtgcaaaaggttgtgatgctgatcatggttacaggaagtaccttatattcatcagttgtatgatgtga

SEQ ID NO: 16334 - DNA, 255 bp, Glycine max
  Peptide Sequence Number=SeqID_108019
atgattttgagggggagtagcatttatactactgctgctgattatgattgttgtaagctactaaaactagtagctgatagaagatgccgcagtgaactgcttcacagcagtaggagcatggagacaggggagcagaaagctgatgtcacaattttgctgtcgccactacagataccgctgtgcttgattactctgataatgaaagttgctgatcccacttgcataactgctcgtacctgctcaggaagtgtctaa

SEQ ID NO: 16335 - DNA, 354 bp, Glycine max
  Peptide Sequence Number=SeqID_108020
atggatacctcaaagccctacactgcggcaatgaggggcatcgtgcatgagcctcaagcgaacctaggggcagatcaaaaatttcttacatctaatgaatttgggatgaccggccctctcaatgagtcaatctcatgttttctcataagggtggacccttgggtactagaacctgtcgcctttagaggactacacgtcctcacctttcgagggctacatgccctcgccatcagagggctacacgccctcacccttagaggactacatgtcctcgccttcagagggctacacgctctcgccttcagtaggctccacatccgcaccttaagagaatttaaggtcctctgcccttaa

SEQ ID NO: 16336 - DNA, 501 bp, Glycine max
  Peptide Sequence Number=SeqID_108021
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgggaagcatttcttccaattttctcagatcaatctcttcttcaaatcgcaaacccacttcttcaaaccctaa

SEQ ID NO: 16337 - DNA, 156 bp, Glycine max
  Peptide Sequence Number=SeqID_108022
atgcccagtggacccgaagaagtccaacaaggccctggggtttccagctctggttacgggcctctgtcagtcctacagggtgtccgtcccccaacgaggtcattccatcgtgacatagggatcgcgcccacaaagacacccagtggacccggataa

SEQ ID NO: 16338 - DNA, 678 bp, Glycine max
  Peptide Sequence Number=SeqID_108023
atggcattaactgcccccccccccctccatgattggaaaacgggtttgtttttatgttgggcctgtcctcttgaaaagtcaaccacccggcctctatcaagctttggaccttgcttttcaaggccaagcactgttcgatcgagtggcccggggtccccccatgaagatctttctcgggacaaccacgaccagttggttggcgatgagagatggcaagagttccccatatgtcattgggatcggggcgaagatctgtgcctaccttggcgaaaagttccttgccgtgtttgcgccaaagtgagcgttgttggccgggtgaggccgagtcggagctggagtccggagagctcccccgtgtgggggtgtgggcacccttggttgagtgatgttgcgcatattggtgggtaccgtggggggtttgcgaagaccaagtccgcgaagctggaaggcatgcaaggtatccaccatcatagtaaccatttgcctctcaaccatgggaggggctacttgcgctgccaggtccctccaacgctgagcgtattctttaaaggactcgctttcccgtttaatcatgttttgcagctgagtcaggtcgggagccatgttagagttgtactgataatgcctaaggaaggcggtaatcagatccttccaggtgcggatgcgggaagcttctag

SEQ ID NO: 16339 - DNA, 156 bp, Glycine max
  Peptide Sequence Number=SeqID_108024
atggcgtatgttaggtgttttgatgataacaaagatgataacttaaagcccatgagaatgatttcaagattgagtcaagaacaattcaagaatcaagagaaagattcaagacaagtttcaagtttcaagttttcaataatcaagaatcaagaataa

SEQ ID NO: 16340 - DNA, 70 bp, Glycine max
  Peptide Sequence Number=SeqID_108025
atggctggccctcagcattcaaaacaaaccccttgcggggaatacaaagcatggcttcaatctcctggtg

SEQ ID NO: 16341 - DNA, 342 bp, Glycine max
  Peptide Sequence Number=SeqID_108026
atgtcacaaaactttacggattacgcaaccatcccctctttgacttctggaatgttatggaactttacggattgcacaataatgcttcctttcgactaccgacatgtcgcggaacttcgcggattgcctaacgatgggtgccaagttcctcaaagcggtcatgcgaaggtcgcatcccaccaaacagatggtccccggatgaaattagggaaccgattgggaaaacaacaaaaactgtattttcccctcaccgtgggctctgtacttgataacggaggatgcacggacaacgctaggcaatcaatttgtggggctccggacttgatggtggaggatgcatga

SEQ ID NO: 16342 - DNA, 171 bp, Glycine max
  Peptide Sequence Number=SeqID_108027
atggcacctattgtgttgaacttccctgatgcaagctccattggagcttgtaggcctaggatcttcttcatcaatggattcctttgcttcttggaagatgaatggcagcggaatggagaaggaagagagagaggagacgccacttcaagagcatcttcatctaggtgttga

SEQ ID NO: 16343 - DNA, 522 bp, Glycine max
  Peptide Sequence Number=SeqID_108028
atggcatacgatttggaagaacaggaacaactagacgagtttaaagcctggtggaacaaaaacggtaaattagtcacccgcctggtgattgcggcagtggtagtctatggtggctggcaagggtatcaatcctggatgaacagcaaggcgacagcggcttcaactgcttaccagactttggtcagcacttccttactggatgtagacagcaaaaaagccgagcaaatcagcaaagatgccgaagccatcgaaaaagactatagcatgacgccttatgctggccgtgctgcattatttgctgcgcatgccctgcatgaagccaaacaatcagaagccgctgaaaagcagctgcgttgggcgatggccgaagccaaagagcctgcgattaaacacatggctgcgattgaaatcgctggcttgcagattgagcgcaatgcattggacgacgcaaagaaaatcctggcggctatcgatgacaaaggcttcgatgggattaaaaatgctttgctgggcgatatctat

SEQ ID NO: 16344 - DNA, 237 bp, Glycine max
  Peptide Sequence Number=SeqID_108029
atgggggagggagtcgcggtcagagagctcgatgaggacggtggtggcggtgagaacattgacagccttgtcggccactttgtggagggcgtcggagacgatgatggggtggatgtcgtgagagaggaggatgaggcactactcgaggagggcaataggaatgacaacgatgatagtggtgctgtcgcccgcgacagagtcttaggacttggagagctcgaggagcatcttggatga

SEQ ID NO: 16345 - DNA, 342 bp, Glycine max
  Peptide Sequence Number=SeqID_108030
atgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagatcatatagatggttggtatctaagataa

SEQ ID NO: 16346 - DNA, 159 bp, Glycine max
  Peptide Sequence Number=SeqID_108031
atgccaaaagatagggggagtaagggttgtgtgagcatgctatcatcttgtatatatcttgtcttgattttaggattacatgaatcatatgcttctcaaagatttactcaagacaaagcaattagagatattcaagatgataatcaagacagtctatag

SEQ ID NO: 16347 - DNA, 183 bp, Glycine max
  Peptide Sequence Number=SeqID_108032
ggctcgctcagcgagaaagattggccaagcaaggcttatccgcttagcaaggaagttagctcgctaagcgagtacaaaaccctagagaatgttgagccagagagcaaagcgcttagtgcgcagctagtccgcccagcgaggacgttgtctcttctcgcgcttaacgcgtcgaagcccgcttag

SEQ ID NO: 16348 - DNA, 366 bp, Glycine max
  Peptide Sequence Number=SeqID_108033
atgggaaaattggatcatctagaggaaaggctcagggccattgatggaggtgaagattatgcctttgctaacctagaagagttgttcatagtacccaatatcatcacccctcccaagttcaaggtgctggactttgacaagtacaaaggggactacttgctccaagaaccatctaaagattgtcagtacaattctgatatggctccggataggatgcaactacaaaaagtgtgcaaaaagggggcacgaatctttcaaagaatacacccaaagatggagagacttggcaactcaagtagcacccccaaaaacaaagaaagagattatcacaatgatagtagacacctgaccggtgttctactatga

SEQ ID NO: 16349 - DNA, 150 bp, Glycine max
  Peptide Sequence Number=SeqID_108034
atggataagagaatgaaggtagaagaagatgagcagagggagaaggagagaaggagcacgaaattttatgccttaaatgagtgtactaatctcaagatcaagtcccaagattctccacttagtgtgcttaggtgtcatgagacattgtaa

SEQ ID NO: 16350 - DNA, 916 bp, Glycine max
  Peptide Sequence Number=SeqID_108035
atgggggccatgaagtcttttaagtcttggatggaaccatctcatcccaaaaccattgacgatgaagcatgggaatggggccaaaaagtttggttcataagtgaacacgttgatgtacacagaaccgcccctttcctaacaccatttgtaatggcagttacacaaatgacaaatactctgcttctaaattctaatttcggtggtccactatttccacctatttttgctgatgacagcattctaagagcaaaatttgtgtacaagaactatgatggacttgggaaatcccctaagttctttgtttgtattgggatagctatcgctgcaagcataaatcttgttgaatcagatccatggagtgaagagtttctatggactttccacaaggatacactgtcattttgcttaaatgcaattccaaaaggaggttcacttgtaatttcttcccctgaaattagaccacttcctcaaggagcctacacgaatggcatggaagattttcctattaagttgataaggaagagttatagaattaattgtggacactccaatgattctataaggtatccattggatccatttgatagaatatgggatgctgatagaagtttcacactatttcatgttgcaactgggtttaagattcaacttagcttcaaacagtctagtcttgtcaaaaaaccaccaccagttgttcttcaaacagggagagttttggctcgaagaaatacactgacatacagtgatgcaatccttccaaggaggggatccatcactagagccatggctaggagactccaagaatattgggccagagatgcaggagaaggtcacaggattctcataagctttagggaaggcgcgtggagtcgccaccaacgtttatttgaggaaaacgtcggaaaaatcgaaaaag

SEQ ID NO: 16351 - DNA, 336 bp, Glycine max
  Peptide Sequence Number=SeqID_108036
atgaggcaccatccactagggaataagccatggaaggaggagcttcaccaccaagagagtgccttggataagaagcttagagaggaagctttaacggaggaaatgaatgagagagagtggcatctccagtcacctttcctccttctccattccactgccattgattttcaagaagcaaaggacttcattgatgaagaagatccaaggcctacaagctctacatggagctacattaaaacccaagaaaagatccaggtggaacaaaaggaggaacaaacctaccaagtggaacaaacccaaaaaatggacgtagggtttgggaaatggatggtgtag

SEQ ID NO: 16352 - DNA, 222 bp, Glycine max
  Peptide Sequence Number=SeqID_108037
atgacaagtatcaaggaaggtcaaccaagcttaatcctcacggccactgtttctcacatatgcacaagtgtttcagtcataaacacacaaaatgaatctgaaggactttctttggcttgtaatgaggctaggctaaaaacaattcatggtttttctaggatgcaaaacttaggttctaggagagcattcatccatagatcacctttttcggggatcctctag

SEQ ID NO: 16353 - DNA, 618 bp, Glycine max
  Peptide Sequence Number=SeqID_108038
atggatccggatgtcacccgcgtcgaaccctacgagtgggttgatggcgaatggcgttccagtgcccagggcaccggcaatgtgtcggtatacctgtccggcatttccacccgcgacgacgcgatgatgttcgctcgcatcctgccggccgatctgcgcgcgcagctgcgcgagccgggtgcggtgatcgtcgacagcgccgatctggatacgctcggcgtggacctgcagaacaaccgtgcctggatcaatggcaaggccgtgcgcgtggttgccgcgcaaccgggcctgcgtggcctgggtggtgtcaacgtactggcttcgctggatactgcgcgcgccatcgccggtaccgacccacatgagggcagcacctatttcgtggcgggcctgcgctcgccggacctggccgatcgcgtgcgtgaccgcttgtccgcgtcgatgggccgggccacgccggtcgagttctggaccgcgccggagttcgccagccgctcgcagcagtactggctgttcgataccggcgccggcatcgcggtgttgttcatggccgtcatcgtctgcttcgtcggcgcggtgatcaccaaccagtcgttcgcctctgtggtggccggctcg

SEQ ID NO: 16354 - DNA, 450 bp, Glycine max
  Peptide Sequence Number=SeqID_108039
atggtccggcgtcagccctttggcggcgatgataacgctgttgtgcagaacgcgggcgtcgccgtagagatggcactcgccccgcacgcaggagtgctgaatggtgacattgtcacttattcgcgccccgtggctgacctccgcgccgtccagccagcagctgccgctgatatgcgcatcgtggctaacgatgcacggcagggtaagtcgcgcattgccggacacgacggcaccggcgaacaccacgctgttttcgtcgtagatccaacagtcgccgtcctgcgcgagggcgcgctcatcgtcaacccagccgcctttcgtaccgaccgtcacgtcgttaaaatccactatcgcgataatctgccgcagcgtgacggagcgggtagtgtcgccgtttttccattgccagaggcgggtttcgtcgctaaggcgatatttgttcatctttag

SEQ ID NO: 16355 - DNA, 481 bp, Glycine max
  Peptide Sequence Number=SeqID_108040
gagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 16356 - DNA, 186 bp, Glycine max
  Peptide Sequence Number=SeqID_108041
atggagatgacaaggtgtatgctgcatgaaaaggagttgccaaagaagttatgggtggaggctacaaacactgtagttaaaagggacaaacttgataagaaggtagaacctggagttttcattggatacagcaacacctccaaagcttacaaaattttccaacctcaaaatgggaaattcttgtga

SEQ ID NO: 16357 - DNA, 54 bp, Glycine max
  Peptide Sequence Number=SeqID_108042
atgaacagcagaaaccaacccaaggtacacagggacggatgcaagtggggatag

SEQ ID NO: 16358 - DNA, 267 bp, Glycine max
  Peptide Sequence Number=SeqID_108043
gtgtttgacttaggtgcaagctgggacgcagcagcgaaatgtcggggctggatgagattatccgtttgtaaaggaaaggtgggagattgccgagaggcaattcaggctgaggatttagccacggaggtacatatgcttaaaatggaactttccctgctgaatcaagaatatcaagcggcgttaatcaccatacaaaagcttgagcagcaactcgcagccaggagtaaaagtagtttgctttttatggggctgaaaaaaattagataa

SEQ ID NO: 16359 - DNA, 213 bp, Glycine max
  Peptide Sequence Number=SeqID_108044
atgccaccagccgcaggaccaacacatgccccttctaatgtggagcgacctagacacgccgtggaggcttgccaagcgatcgcagaaaggttggagcgtcttcttaacctaaggatagtcaccgtaggtacagaaatacacgaggtcatggaagactacataaggatcgctaagggtgtaacaccagatggcaatgtttatgtcaggtcatga

SEQ ID NO: 16360 - DNA, 519 bp, Glycine max
  Peptide Sequence Number=SeqID_108045
atggaatatcttttggtttcaggggcagagtcatttaagagtctgtgttctttgagtatttaccaatgccccaactttgtatcattcgggagagaaggattgcctgaagagatgagtactcttctcccaaagttagaagatctttacatatccaactgcccagaaattgagtcctttccaaaacggggtatgccacctaacctgagaacagtttggattgtgaattgtgagaaactactgagcggcctagcatggccatccatgggcatgcttactcatctcaatgttgggggtcgatgtgatggcatcaagtccttccctaaagaggggcttctccatctcacatccctgcaagaattaaccatgaggggatgtcctttgctggagaatatggctggagaaaggcttcctgactctctaataaaattaaccatatgggaatgtcctttgctggaaaaacgatgccgcatgaagcaccctcaaatttggcctaaaatttcccacatccctggcattaag

SEQ ID NO: 16361 - DNA, 204 bp, Glycine max
  Peptide Sequence Number=SeqID_108046
atgggggtgcaaatagcaactaggcccacttgggccctccagaggattcctctagaaggcggttgcttctggaggaagtcaccttgctcgcctgggcgagctagaaaatccgagccgaggcgcttccgtaacgtttccgtggggattttcgcgaagatcttcaaccgttcttcgttcgttcgttcttcagccttcaatgggtaa

SEQ ID NO: 16362 - DNA, 848 bp, Glycine max
  Peptide Sequence Number=SeqID_108047
atggggacaaggggttgcatcagctacaatcttgttcttgctataagacaacttggctaccctatgggaggagcaccaataaaggaagagctcgcgcctgtcatttcacgaggtttcaataagaccaacgtggagacacttcagaaggttcgcaaggcatgggaggtgttgcaaaagaaggacaaggaactcaggggcagtaacaatgggctcatcggtggctatcgtaagtggttaaaagcccacgtgcaaggtttggattgcctcccaagtttgagaaccactaaaagagaggaagttgaggcactgaaggaagacgaagaagtgcaggcccttagggcggaactcgagcaagcccaaacagttaaagaaagactgagagatgtaaatgtggctaccaccaaagccttggaacgagaaaccaagagggctcgtagggaagaacacggtcggaacaagttccgaggggctctgtggggcagtaacaacgagcttaagctccagagagaggaaagggaccaatcgcgagtagacaatttgatcttgaaggatgagttgaaggcttgctcgaggtccaagaaaagtttgtctcagcggttatgcaagatagagaccaacatgttagccatcatcagcaagtaccaagaagaactaaatctagccacggcccacgagcatagagtggcggacgagtatgcccaagtgtacacggaaaaggaggctagaggaagggtgatcgactcgctacatcaagaggcaacgatgtggatggaccgattcgctcttaccttgaatgggagtcaagagcttccccgattactagccaaggctaaagcgatggcaaacac

SEQ ID NO: 16363 - DNA, 135 bp, Glycine max
  Peptide Sequence Number=SeqID_108048
atggaacacggtatcgtgacaactccaggatctttgttgatgcaatcctacctcccaagggcattggatagaagagtccaagaagattgggccagagatgcaagagaaggccctaaggttctcatgagccttagg

SEQ ID NO: 16364 - DNA, 204 bp, Glycine max
  Peptide Sequence Number=SeqID_108049
atgggcaaaggatggccttcgggaccattgtttgatggcatgcaacctttgcttgactgcttcgagaagtcaaaagagagcattgttgcacgatccgtgaagttccgtaacatgccggaaatcaaaaggaagcattgttacacaatccgtgaggttccgcccacttgggccttccaagatgttcctccagaaggtggtgcctaa

SEQ ID NO: 16365 - DNA, 126 bp, Glycine max
  Peptide Sequence Number=SeqID_108050
atggcaattttgatcgccaatacttcgacaacatttaatagagatgaaagacttgggaacacaaatgggtttatgatcccaacatggttggctcatgaggaaaacgcaaggatcatgcatgagtaa

SEQ ID NO: 16366 - DNA, 618 bp, Glycine max
  Peptide Sequence Number=SeqID_108051
atgtcttgcctagcgaactccgatctccctctgcctaagtgccagttggtgtatgccatcctgacacggatgagcgtccatgtggcccaggtgattgttgacgccatctacttgtttgcaggtatgccacccaccaggcaccctctagacccagataagtctaataggaccctaggatttccggcattgatcacgggcctctgccagtcgttcggggttcccgtcacccccagtaaggtgatccgactgccaatcactcgggccttcatcgagaagtattgcatgcctaggcaggcgcagggtgatgcacctcaggccgcagacgcaccgccaccacctcatcaggccgatcccgttggatcactaggcatggagcgttatctacagcacttggttcgccagcaggcggccaaccaccgggggcaggggcagggtttcgctccttttgcatgccctactccagagcagtttggggctgaggtcgcatggcccggagattggcccgaggcccaggcaggggaggagcccgcaggatcccccggtgaggcagaggaggcccgtatggatgaagaaatgacagacttgcttggtttcttgggaggaagcatagccacatga

SEQ ID NO: 16367 - DNA, 476 bp, Glycine max
  Peptide Sequence Number=SeqID_108052
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttctttggccaatctgatctatggaagcaacaggcagctaattatctgaattgccgtttgctggctctcccttttacttacctgggaatacccttaggagcaaacccgaggagatgtcatttgtgggaccctataatccacaaatgtgagagaaagttagcgagggtgcctaaatcagtggtcgacaagttggtgaggatacaacgtagcttcctatggggaggagggcctgaccaaaccaaaattgcatggatcagg

SEQ ID NO: 16368 - DNA, 284 bp, Glycine max
  Peptide Sequence Number=SeqID_108053
tgatcaacgggttcccatgaaccctaagagaataaaggtcattcctgagtggcccactccaccaacaccattcattgagttggtgagaaaccatgttccttcatgggaagatgcccaggaaatgggtgttgagggaaggagcccagagtatgaagaacctcgagatttgaggtcaaatcctttccaagcttctcatctcaaggaggtgagcttagctattagagaggtgtgtgtactaagctctagcttctttaggaatcttttcaaggaagcttcccaaggag

SEQ ID NO: 16369 - DNA, 171 bp, Glycine max
  Peptide Sequence Number=SeqID_108054
gagttcttccggaagttccggaagaaccttttccggaaagtttcaagatctttctcactttcgtatacaagactcataactcttccggatgaaccgcttcttccggaagacttccggaaaacgtcttccgggaactttccggaagaagcggttcatccggaagagttatga

SEQ ID NO: 16370 - DNA, 426 bp, Glycine max
  Peptide Sequence Number=SeqID_108055
atggttgcaatggctctaaaaaagattctctctaagagggcaaggaaggatgctgcgggagaaggatctagtgtggctccacaagcaaacatagaatttgatggacaccatttccaaagtgaggaacatgaatgctgctttgaagcgatcaagggttggtctttcctcaaagagagactggtccaactaagagaggaggaatacacggagttccaggaggaagttgtgaggaggcaatggactcaactcacagggaccatggctaagtatgacttggaaatagtcatggaattctatgcgaatgcatggcccatcgaggaagaagtcatggataagcgctcctgggtgtggggccaatgggtcccctatgatgaagatgccatcaaccaaatcttggggcatccgttggtcctggaggaggggtag

SEQ ID NO: 16371 - DNA, 477 bp, Glycine max
  Peptide Sequence Number=SeqID_108056
gtcatttgtctaacagccctgtgcgctaagcctgagtgtcattctgatgagactgagctaagcacaccatactgcgctaagcttcgactttcttctatggcatctaagaaaaggaaggctccttctacaccttcccaagttagatttaatcggtctcggttcacatctcaagaagcttgggagaggtataccgatattggggtgcctaggaaactactaccggataggaatgtgatagtttattacactgagtttgacgagttcaaggaggaactcgagagaagacactgggatgaggagttgactgattttactgacagtagcatagatgtcgccattgtgaaggaatttgacgcgaacctctatgacctcgaggataaatcacctaagcagaagaacctagaagaagatgatctgtacaggtgcactgagcgagtgtcaaactcgctaagcgcaccgcttgcacctccaggctga

SEQ ID NO: 16372 - DNA, 320 bp, Glycine max
  Peptide Sequence Number=SeqID_108057
tcaagagatcttttgccattggtgctggagcggtaacttcttttgggtactgtaaggatattgatggacagtggattaggaaacaagatttaccaccaccgattcctgatgagcatactccgtctcctctgccacagagagatgcttcctctactcttatgcatcacgtcctttctaagctacgtggccttcgagcgttcataggtgaccgtttggataccctggattctcattttgaaggcatggatacacggattactcagcttgaagacgacatgggtttcattcgtcgttgcttcgatccaccggctgccccatag

SEQ ID NO: 16373 - DNA, 189 bp, Glycine max
  Peptide Sequence Number=SeqID_108058
atgggtgcgtcttccatgggaggaaaatgcgcggagtcgaaaccaacatttattcagggaaaacgtcagaaaaatcggaaaaggtgtggtctacgaactttaatcgtgaaaggttcaggagttgtttttatgcacggggaagggtgtttcccttactcctacgtatcctcaattgcgatgagcgaataa

SEQ ID NO: 16374 - DNA, 222 bp, Glycine max
  Peptide Sequence Number=SeqID_108059
atgcttggaagtgtgcttagcgtgcttgttgcactaagcctaaactactctttgttagggtttctagctttagggtttgttattttaggacttaggttgagttatgatcgcgctaagcccgatcatgttgcactaagtgcattcatccttctagtgagtttcaatgatgaacccgctaagcgcgtttgtgcactaagcgagactagtgtttcagacatttag

SEQ ID NO: 16375 - DNA, 183 bp, Glycine max
  Peptide Sequence Number=SeqID_108060
atgaaagataaatggaatgtgcatgaattgcacagtatgttagttcaggaagaaacgaggcttaagaatcaaggaagtcactcagtccattatgtaagccaccaagggaatcaaggagctggaaagaaatttatgaagaagcatgataaaggcagaggagatttcttacaatccaaaccataa

SEQ ID NO: 16376 - DNA, 540 bp, Glycine max
  Peptide Sequence Number=SeqID_108061
atgtcgatgttgcctcccatttgtttggttagcagtgtggtgtggcgaaaaacaatgatgtttgtcgacccaaacaatgcaaacacaactacattgggtgaagttgcggagacattgcagtatatggtgtcaccacaagggcggaaaacatggacagttgatgatctcgtgccttatgtggagaagctaatgattttatccgaagagcaagagaggatcactgagcctgtggcacatggtctagcatcagagcgccgatttcccccacaacagtttcacatgcttcagtcaagtgttgaaactcgaggttttgacagacgaagggagattgttcaagcagaagatttttcccaacaaatgcagcagcgtggccatggaatatattacatgccaccaacattttctcaatatcctttgcagatgtatcagtatcctttcgaaggtcatgacactgatatgtctgcaagcgaacattcatttggtggtgttgtggaaacacatcctcatttttcatggtcgaccatgacctcttcgcagtaa

SEQ ID NO: 16377 - DNA, 192 bp, Glycine max
  Peptide Sequence Number=SeqID_108062
atggcttgccataatgtccaaccgcacttcacaaattatagagatgcattgtgtcccgacgtcattcagcacaaagttcctttaagcacttcacctagccatctgctcccccgaacacaaggttcaagatcatcacaagatccaaacacaaacaacaaaccgggagtgagttatcacattcctaactactag

SEQ ID NO: 16378 - DNA, 378 bp, Glycine max
  Peptide Sequence Number=SeqID_108063
atggctactcaattgaatcaagctcaatcccaaaattctgacaaattgccttcacagactgtgcagaatacgaaaaatgtgagtgccatcaccttgaggtctggcaacaaaattcaagtgcctccaccagtagcatcacctgcacctgagcctgtcaagcttcattctaaacctgaaaaagaagttgagatagttgcacaaaagaggaagcttcctgatcagggagttaacaaaaattttcatgctggtggaccttcttctagtaattctgacttgcaacagtctcctatccctcttccatttccacatagagcaattcccaacaaaaaaatggaaaaagtggaaaaggagatcttggagaccttcaggaatgtagag

SEQ ID NO: 16379 - DNA, 358 bp, Glycine max
  Peptide Sequence Number=SeqID_108064
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcaagggaccattcctttccgattccttatcacaccgagtcaactcgccctcaccgttttctccgactcagcgtcacctcaccacg

SEQ ID NO: 16380 - DNA, 222 bp, Glycine max
  Peptide Sequence Number=SeqID_108065
atggaggaaagaagaggaagcttgaacatgaaaataggaggagtggaaatgattgagattaatagcttcattcaaaacatggaacttgaagatataccacttgtggggaggaggtacacattgtacaaacccaatagttgttgtaagagtaaacttgatagatttcttgtttccaaagagtggattgagaattggccgggaagcataataccaccaatgtga

SEQ ID NO: 16381 - DNA, 498 bp, Glycine max
  Peptide Sequence Number=SeqID_108066
atgaaagacggtgcgccaacggaactggttgttccgcaggtactcgcctccaccacgtttatggttgacggagaaaagatcgacatcgagcagcctgacagctacgcggcctatgtgtggatcccgtcagcgaaaaccatcctcggcggcaccggggtagcctggggtattcacgtctggacggcagacacgcagaccgcggaaagccgtaagcagtggcaggacaccctgcaggcgatggctgcgcataagccagaacgcgtgatcccgggccactatctgggtaacccacccgcgggcagtggcgcgattgattttacgcgtaactatctgcagcgctttgaaaaggctttagctgcgcataaagattccgctggcgttatccgtaccctgaaaaaacagtatccgaatcttgcggaagagagctcgctggaattaagcgctaaggtcaataccggcgaaatgaagtggagcatctccctaatattccctccatga

SEQ ID NO: 16382 - DNA, 468 bp, Glycine max
  Peptide Sequence Number=SeqID_108067
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcaaccgatcgaccgagcgcagcgagaaacagctatgaccatgattacgaattcgagctcggtaccgctgcggcgagcggtatcagctcactcaaaggcggtaatacggttatccacagaatcaggggataa

SEQ ID NO: 16383 - DNA, 154 bp, Glycine max
  Peptide Sequence Number=SeqID_108068
gagtaaaaggtttatggaggttgaggatgaggatagtgttgtgtataagaagaaaactgctgacaaaaaaagtactgatggcaagaaaaacgaggaaactggaaataaccatgcccttcggagaagctttgcagcagatgccactctactttaa

SEQ ID NO: 16384 - DNA, 237 bp, Glycine max
  Peptide Sequence Number=SeqID_108069
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggacttgatgaaattagctttgaatgtatcaaagtaccatcaaaagctatttcgttcgatgctctccatgcatttaatgcaagatga

SEQ ID NO: 16385 - DNA, 977 bp, Glycine max
  Peptide Sequence Number=SeqID_108070
atggactcagaaatctaccctgaggtttatgagaaccctagggccttcttcagcagctctagcccaatcctcttggagcctcttgctcatggctctagagatggccccgagaaaggtccccgcaaagaggtccaggaaagacaccactggagagggttccagtgcggccctgcaggccgatatggacttcgacagacatcggttccggagcacggaacaccagcagcgggtgagatatcccgcaggcattgggcaccacttgtgtcacgcatggctaaatttgatcttgagatagtcatggaattttatgctaacgcctggcctacaggggagggatgcgagtatagccagagaaggagtcaggcctcaggcttcgatgaagaggctatcgcccagttgctatgtgtgtcggggcaggacttcgcccggaccaccactgggagacgggtgcggatcatgcacaccaacatgaccaccctcacacagatctggatgacgttgcagcttagcaacattctgcccaacgaccacaactctgacctccccctaccaaagtgtcagctagtttatgccatcctgacgcaggtaagtgtacacgtagctcagttgatctctgatgctatttaccagtttgtagggattgcacctacaagatacccagtggacccagagaagtccaacagggccctgggatttcccgctctgattacaggcctctgcacagggctaggcaccacaatagctggaggacggccaacagcaggtagtggtggatacaccatcgccacctctagagtccatctctgctcacctacggagggtcaggattccaaccctgacacatggcctactcccgagcagtccgaagctgtagtagcatggcctagagattggcccgatttctccgcaggggcctccgaagagggagacggagctcatgaggacgatgacatggccgacgtgttggacttcttcct

SEQ ID NO: 16386 - DNA, 266 bp, Glycine max
  Peptide Sequence Number=SeqID_108071
gttgggacaaggaagggacaaaggagaacacacatcttttagaagaaattgaaaagatcttatgctatgtatgtgatgaagtatgcatatgcttgctgcattcgtatggcttgctacattcgtatggcttgctacattcgtatcaccatagagtggtggtagtgaagtgccttaagaatgtcacaagtggagatgctgagttttgggcagaagtcacaatcattgccagaatgcaccacctcaatatggaactgaatttgagttag

SEQ ID NO: 16387 - DNA, 468 bp, Glycine max
  Peptide Sequence Number=SeqID_108072
atggcggaaccatcaaagaagcgaaaaggcacttcgagtcggagtcaacgacatttcgggtcacaggaaacgccgattccttcttccattccctctggatcattgttttcatatgaggaacatcggatacggtacaaaaacctcttttcgtctcattccattattgacccaaaattcattgtcaaagctttctattcaaacttagaaatccaagaaggcaccctaatgtctgaagtttatgggattaagatggtcattgaccaatccatattctatgatttaacccaatttccaagtgaaggtgcactgattgacgattggaagtttgatttttatgtgcatgatgcctgccggttggtttgcaccaaccaagcggatatgaccggaaggcttcttgccggttcattggcttttgaaagccgcatccttcattatctaattgttcgcatcttgcttccgagatcttga

SEQ ID NO: 16388 - DNA, 504 bp, Glycine max
  Peptide Sequence Number=SeqID_108073
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccatattccctaccttctcttttggctgaaagtgagattgctttcccgtgtaaaaaatatgttcgagattaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 16389 - DNA, 1020 bp, Glycine max
  Peptide Sequence Number=SeqID_108074
atgaaaagagaaaaacatgtctcttatagtagtcataactcttgcaagagcctaagtgaagaacttcatgactattacgaaggaagacataggtcacatcttagacctcactcccatagaagagaaaaggaaagaaagcctcaagaggctaacattaacctctcatacttccgtgggaaggacaatgtagaggctaacttagattgggaaataaaggtagagcaacaacttaaaaacaagtctacttcaaaatcttatagctctcattcttatccaaagaaagaccaaggtcaaggcatcttaggggtgacaccttctaagcccaaagatgataaggggaaggcaatagaaaagcaagcccctaaggctagtatgcaagaaaaaactagctctataaagtgctttaaatgtcttagaagaggacacattacttctcaatgccccaccacaaaaatcattattatgaggggccaagacatttatagtagccaagatgaggttactacttcaccttcctctagtgaaagaggtaagtgtctcctccaagagacacttgctagcattgccacacctcttgggcttgagtttattcctcaagtaaataagttgtttgatgagggtttggtttgcaagagcttaaatccttgtgctttgttggtgcccaaaataggtattattaggaaccaagtccctaaaataggtggtatgatgaatgttttgagtggtgcaaccctcttttgtaaaatcactcgtacacctaacatcttcatggtgtgtgtacatagggacccattaggggttcccatgaaccctaagagaataaaggtcattcttgagtggcctactccaccaacaccactcattgagttggtgagaaaccatgttccttcatgggaagatgcccagaaaatgggtgttgagggaaggagcccaaagtatgaagaacctcgggatttgaggtcaaatcctttccaaggtggagggaatgatgcaatcctacctctcaagggcattggatag

SEQ ID NO: 16390 - DNA, 531 bp, Glycine max
  Peptide Sequence Number=SeqID_108075
atgtccacccagaacttgatagcattaacatcacccaaactgaaagaaatcagtcgtacaaagaaagcattcccttgggaattaaatttccaacttccaagagttagcatggatagctgtggtgcttgggattatccagacaatcctccatctgttagatttcaaacaaggattaacatgacatgtgtcaatcaagaaactggagtggtaagaggcaattcttgcagaggcttcattgctgtggttgagccacatttgtttcctatgcttgctaattggaaacgtgagcgtacaatggaagacattttgattcaattgaagagagaaatgatgtctccccaaaataggaagctaactcagcctcctgaagggattattgacagtattaactttgttgagcttgtaatgatgctctggaagttagtcattgtaaaatttgaagatgccgctattcagaatttaaaattgttagaatggttacaacttatgagatttactgctggcttgttctttctccaagtagtcttatga

SEQ ID NO: 16391 - DNA, 492 bp, Glycine max
  Peptide Sequence Number=SeqID_108076
atgttgtacttggaatgtgatccaattccaaaagttgttgaggatgaggatgatttagatgatgtacctgttgttggccatgaggaagatgttggtgtgctggtgagcatgttggtgctggagagcagagagatgctggtgagcggagggatgctgatgctgcaaagagatggtagtgagcagagggatgcggatgctggtgagcagagagatggtggtgagcatagggatactgatgctggtgagcaaagagatggtagtgagcagagggatgctgatgctggtgagcagagagatgctggtggtgaagagagagatgttgctgatagtgaggaggaaaaggaagttgatagtgatgagtggtttataaatttctcttgtatgatgaatggagttgaagctgaagttgagacagatggttatcattcagaggagcttaatatccccattagtagtgatgatgaagatgaggatgttgaagtttatccttaa

SEQ ID NO: 16392 - DNA, 847 bp, Glycine max
  Peptide Sequence Number=SeqID_108077
atggttgtacaggccgtcgaactcctgatcggttttcaacaccttggcctggatctttttcagcaggtggcgcgaggctccggcggagccttgctcttcgctgatcaggatgcgccgtttgagatcggcgaagcggactttatagaattcgtcgaggttgttggagtaaatgcccagaaaacgcatacgttcaatcaggggattgctcttatctgcggcttcctgcaacacgccgccatattgcctgttggcagtgaaaatgacttggtggagattggcgagacacatgacacagacgacggccaatcaacatccccgagatcgcatgcgcgggcgcatcgaccgcggcgtgcaggcggcagtgaccgccagcgggctgatggtgctgatgacgttgatgctgatcttcgtttatctgctgtttgcggtgctgccgctgttcaaaccggcctcgcttgggcaggcgcagccgttgccgatcgcggcgtcggccccggcgctggcgctgggcatggacggcgcggggcaattttatcgcctgacgccgaccccgaacggccagccccaggcgccgctggcgcagcagacgctgttggccaagccggcgctgctcgcgcaggccgccggagagcgcgatctgtttgcgctggcgcaggccgacggccgcttggtggtggcgcgcgcggatttcgcgacggcggagaccggccggccgcagtggctgttcccgctcgggcagcagccgttggcgctggatccacagcgcaagccgctgaaactgctgtcgctggcggatgcgcatcgcgggcagtatctgctggccggggtgaccgacgatcggcgcctg

SEQ ID NO: 16393 - DNA, 213 bp, Glycine max
  Peptide Sequence Number=SeqID_108078
atggcacgcagcgtgttcacttcgtgcccctattcaagggacctatatgggagggagctaacaaggcttttagtgataattcccaaggtggttatatctctcttgatggtctctagaggtatcattctcttcaaaggacatattgcagcaatagggactactagcaacaatatgttatcaaagagaaaaactctagatgagggttcactgtaa

SEQ ID NO: 16394 - DNA, 279 bp, Glycine max
  Peptide Sequence Number=SeqID_108079
atggtgaaaagttggaacctcttacgtgccgatcaacgtctcatttttcgccaaaagttggcccagggcttcccggtatcaacagggacaccaggatttatttatttctgcgaagtgattcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 16395 - DNA, 483 bp, Glycine max
  Peptide Sequence Number=SeqID_108080
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccccagtctccgaacgcctctcctgtagctactcctgtacttcatttgttggaagaggaggaggttcagacacaggacacccaggaccaatcacaggacttttaa

SEQ ID NO: 16396 - DNA, 210 bp, Glycine max
  Peptide Sequence Number=SeqID_108081
atggaggaaggcataattcccatactagacctcactcccaaagaagagaaaaggatagaaggtctcaagaggttgaacaactctttgcttgccatcatattagtgaagagagaaaagttccattggctacccttagcttccaagggtgtgccctataatggtggacttgccttgttagggaaagaaggattcatagggatcctccagtag

SEQ ID NO: 16397 - DNA, 531 bp, Glycine max
  Peptide Sequence Number=SeqID_108082
atgagtattcattcttcatctagtgttaatggtgagggttctcctcctaaggaccccttgtataagatattggatgagttgagatctcttaagttgtggacaaaaaaacaagagagaaaagaaaaaggtaaaaaaagagtggaagaaataagtcaagatgaaagaaagaaaattagagaggaagaaagaagaaaaataatgaaagaaatgaaaagaaaaaaacatgcctcctatagtagtcataactcttgtaagagcctaagtgaagaacttcgtgactattataacggaaggcataagtcacatcttagaggaaaatgcattcacgctaagcgaagggtcatcccgctaagcgcacctttcgcaacctaccctttggcgggcgagcgaggcgaggctcacagatgcgtcttccatgagaggaaaatgcgtggagtcgccaccaacgtttatttgtgggaaacatcggaaaaaccaaaggaaaccagtcatgaagaatattccagattcgggagttgtatttacgtttga

SEQ ID NO: 16398 - DNA, 417 bp, Glycine max
  Peptide Sequence Number=SeqID_108083
atgcagagataccttatggttatctacaccttttgtcagctaaaggcaagcaagcccgttgacacgcagagactatcatcgtcatgtacaccattgtcatccagagacgacgagttcgatgacatacggacacaccttatgctagaggcaagcgagcccattgacacggagagactaacatcgtcatctgcacctttgtcatccagagacgacgagtccgatgacatgcggagatatcttatggttatccacaccttttgtcagctagaggcaagcgagcccattgacacgcagagattaacgtcgtcatctgcacctttgtcatctagagacagcgagtctgatgacatgcggagataccttatggttatctgcaccttttgtcagctagaggcaagcgagcccgttgacacgtag

SEQ ID NO: 16399 - DNA, 315 bp, Glycine max
  Peptide Sequence Number=SeqID_108084
atggcagaatcatcaaagaagagagagggatcatcctccatcgccgttgctgctgcccatcgccgccatggaccatccgaagcacccacaacacctatccatccttccttgtcatctccaagatcatccactttgttttcttctgatgataagcgtctatgtcaaggtgcaccttttgagggcaccattgttgatgactggaaatttgattattctagtcatgatgctcgccgtatggtttgcattgaccaggctgaaatgaccgttagattgttggccggatcattaacttttgataatcgcatcatgcactaa

SEQ ID NO: 16400 - DNA, 309 bp, Glycine max
  Peptide Sequence Number=SeqID_108085
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaacctctgacacatgcagctcccggagacggtcacagcttgtctgtaagcgatgccgggagcagacaagcccgtcagggcgcgtcagcggtgttggcgggtgtcgggctggcttaa

SEQ ID NO: 16401 - DNA, 294 bp, Glycine max
  Peptide Sequence Number=SeqID_108086
atgattaaatggcttaactctctaacaaagagtcctcagtggagtcgccaactatcgcaacctaccattcagtgggaagaaggctctgaagtagcctcaagggatcgctcaggtgtggcagcaactacctgtctcacctgtgtctcctctgcctcttctctcataacaaatggctctgggatggtagcctcagatgactcatcctccacacctgttgaggtacctaggctgtgggaccttcatcttccctgtgaagagaaggttgggtcccgggctaggctaccatctcagtga

SEQ ID NO: 16402 - DNA, 190 bp, Glycine max
  Peptide Sequence Number=SeqID_108087
atggatgtgtcgcaacctaccctttggcgggagggcgacgcgagactcactggtacatcttccaaggaaggaaaatccgcggagtcgccaccaacgtttattcaaggaaaatgtcggaaaaactggaaaaggggtgatctacgaactttaagtgtgaaaggttcgggagttgtatttacgcacggggaag

SEQ ID NO: 16403 - DNA, 1162 bp, Glycine max
  Peptide Sequence Number=SeqID_108088
gagaggacaacatgtcctcgccttcaaaggactacaggttctcaccttcagaagactacacgtcctcaccttgagagggctacacgccctagccatcagaggactacatgtcctcggctttagagtgctacacgccctcacctttagaggactacacgtcatccccttcagaggactacacgttctcgtcttcacagggctacacgccctcatcttaagaggactacacgtcctcgtctttagagggctacacgatctcaccttcagaggagtacacgtcctcgcctttagagggctacacgccttcaccttcagaggacaacacgtcctccccttaagagggctacacgccgtcgcattcaaagggctacacgtcctcatcttcagaggattacacgtccttgctttagaggactacacgtcgcctccttcagaggggtacacactctcgccttcactggggtacatgttctccccttcagagggctgcacgacatctcctttagaggacaacacgtcttcaccttcagagggttacatgccctcgccttcagaggactataagtccttaccttcagaggactacacgtcctcaccacaagagggctacacgccctcgcctctagagggctacatgccctcgccttcagaggactacacgtcctcaccttcagtgggctacacgccctcgccttcaaaggactacacagggctacacgccctcaccttcagaggacaacacgtcctccccttaaaagggttacacgccgtcacattcaaagggctacacgtcctcatcttcagaggactacacgtccttgctttagaggactacacgtcccctccttcagagaggtacacaccctcgccttcacttggctacatgtcctccccttcaaagggctgcacgacatcgcctttagaggacaacacatcttcaccttcagagggctacacgccctcgccttcagaggattataagtccttaccttcagaggactacacgtcctcacccccaaagggctacatgccttcgcctctagagggctacatgccctcgcctttagaggactacgcgtcctcgccttcaaaagactacatgtcctcaccttcagtgggctacaggccctcgccttcaaaggactacacgtcctcgccttaa

SEQ ID NO: 16404 - DNA, 417 bp, Glycine max
  Peptide Sequence Number=SeqID_108089
atgccgggagcagacaagcccgtcagggcgcgtcaacgggtgttgtcgggtgtcgggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccaaatggatttttggagaaatttttggatcaaagggctggacaacccgatgtgaatga

SEQ ID NO: 16405 - DNA, 201 bp, Glycine max
  Peptide Sequence Number=SeqID_108090
atgttcatgacccctaggctatgtatttcggctattttgggtgaaaaaacatgtttccgtgaagaaaaattgagtcgaagtgctttcgtaacgcttccaagacatttccgtgagcaaatctgtgaagatttttcgccattcttcaccgttcttcgttcttcaactgctttaaccgatcgtttaagtcgttatctcacctaa

SEQ ID NO: 16406 - DNA, 1339 bp, Glycine max
  Peptide Sequence Number=SeqID_108091
atggaggttttgaatcacaatgctgctcttcaattgcttacaaggaatgcttttaaaagagaaaaaattgatccaagttatgaggacgtcttgaatcgtgtagtaacttatgcttctggcattccattggctttggaagtcataggttccaacttgttagtaaaaacagtagcagaatgggaatatgctatggaacattataaaagaattcccagtgatgaaattctagagattctaaaagtaagctttgatgctttggaggaagaagaaaagaatgtttttcttgatattgctttttccttcaaagggtataaatggacagtggttgatgatatactccgtgctctttatggtaactgcaagaagcatcatattggggtgttggttgaaaaatctctcataaagcttaacaactgctatggtactgttgaaatgcacgacttgattcaggacacgggtagagaaattgagcggcagagatcaccagaagagccagggaagtgcaagagattatggttaccaaaagatataattcaagttttaaaacacaacacgaagttctggcatctaagagttttgaattttgaccagtgcgaatttttaacacagatacctgatgtatctgatctcccaaatttgaaggaactttcatatgattggtgtgagagtttagttgcagttgatgactcaattggtttactgaataaacttaaaaaatggagtgcttatggttgcaggaagcttacgagttttccgcctctcaacttgatctctcttgaaatacttgaaatttctgagtgttccaaccttgagtattttccagaaatattaggagagatggaaaacataaagcatcttttattgtatggccttcccataaaagaattgtcattttcatttcaaaatcttattggactccaagagttatccatgttgggctgtggaattgttcagttacgatgtagcttagccatgatgcccgaactgtctggaatcgatatttataattgcaacagggggcaatgggtagaatcggaagaagtagatttagatctatcggggaataatttcacaatccttcctgaattcttcaaagaattgcaatttttaaaatatcttgacgtgagtgattgcgagaatcttcaggaaattagagggcttccaccaaacttaaagcatttcaaagcaataaactgtgcatccttgacatcctcgagtacaagcatgcttttaaatcaggtactgcatgaggctggaggaaccaatttatgtttccaggaacaagtataccggagtggttcgatcaacaaagcagtactggacattcaagttctttctg

SEQ ID NO: 16407 - DNA, 990 bp, Glycine max
  Peptide Sequence Number=SeqID_108092
atgatattagagggacttgttaagctacctgacaacagggaatgtgcagactgcaggaccaaggcaccacgatgggcaagtgtgaacttagggatattcatttgcatgcaatgttcaggaattcaccggagtcttggagtgcatatatcaaaggtgcggtccacaactttggatacatggttgccagatcaagtttcttttatgcaattaattggtaatgcaaagtcaaataagcactgggaggcagaattaccgccaaattttgacagaaatggatatggagttgagaaattcattcgttccaagtatgtggagaaaagatgggcttcaaaaggtggactacagccagcttcaaagtcagctgaaataatctttaactcgaatgaatcaccagctgctagggccaagagtgccactcagaggaataggagattgtctcttgaggaaagcattcttgtgaaacatgtggcacaaattcggcctccagtcacgagatatcatgagatattcggaaggaggaatgttccagatgttcaacttatctctcaagttttactgtgtttctgcaacaaatataacaccaaaggctcctcagattttcaaaagaattcaccaccaccaccattaaggaagccatctgcatcatttgattttgactacactaggggaaagaacaatggtattgttgatcattttgacttgttttccatccatgatgataaacaggatttctcaactacacctcctagctggacaacatttgattatgacccttatagttttgtacgttttcctaaaccgagagacttgtcgtggtttgcggccttacaattgcctgaaatagttcaactcagctcaaagttcttcaaacagctagtggaggctggtgcaaggtttagggacaaagatttcaaccaacacacgttgctgcaggatataaatttggagcacatctgcaccgctttggcgttgatgtatcacacagcctga

SEQ ID NO: 16408 - DNA, 1182 bp, Glycine max
  Peptide Sequence Number=SeqID_108093
atggctgcaaaaacacgttcccttgcatccatctacgatgtgttcctcagcttcagaggggaagacacacgccatggtttcactggcaatctctacaaagctcttgatgacaggggaatctacactttcattgatgatcaggagcttcccagaggagaccaaataacatctgcactttccaaggcaattcaagagtccaggattgctattactgtgctttctcaaaactatgcttcttcctcgttttgtttagatgaacttgtaaccatccttcactgcaagaggaaagggttgttggttataccggtcttttacaaaatagatccttctgatgtcagacaccagaaaggtagttatggagaagcaatggctaagcatcagaagagcttcaaagctaagaagcttcagaaatggaggatggctttgcaacaagtagctgacttgtctggctatcatttcaaagatggagattcatatgaatacaagtttattgggagtattgttgaggaggtctctaggaagattaatcgtgcttatttacatgctgtggattatccatttggtcaatggtcacaagtgatggaggtaaggaagcttttggatgttggatcccatgatgttgtccacatcatagggatccatggaatgggcgggttaggaaaaacaacacttgctctggcagtttataatttgattgctcatcattttgataaatcttgttttcttgaaaacgtgcgagaagaatcaaataaacatgggttaaagcaccttcaaagcatcctactttcaaaattacttggtgagaaggacatcaacttaacaagttggcaagaaggagcttcaatgatacgacataggctccgacgaaagaagattctcttaattttagacgatgttgacaagcgcgagcaattaaaggctattgttggaagatctgattggtttggtcccggtagcagagttatcattaccactcgggacaaacatctgctaaaatatcaccaggttgaaagaacttatgaggtgaccaaatctctagtgaatacaagtatattggtaatatcgttgatcaaatctctagtgagattaattggtaggataacaggaataggaaacaacaaggcaccagtaacaggaagcacaaaaaagaagaacagagggtgcaaggaggattttgcttaa

SEQ ID NO: 16409 - DNA, 2472 bp, Glycine max
  Peptide Sequence Number=SeqID_108094
atggatgctacaacacgttaccgtccattcatctacgatgtgttcctcagcttcatacgggaagacacacaccgtggtttcactttctatctctacaaagctcttaatgaccggggaatctacactttcttttatgatcaggagcttcccagagaaaccgaagtaacacctggactttacaaggcaattctagcttccagggtagctattattgtgctttctgaaaactatgctttttcctcattttgtttagatgaacttgtaaccatcctacactgcgagagggaagttataccagtctttcacaacgtagatccttctgatgtcagacaccagaaaggtagttatggagaagcaatggctaagcatcagaagaggttcaaagctaagaagctgcagaaatggaggatggctttgaaacaagtagctaacttgtgtggctatcatttcaaagatggaggttcatatgaatacatgcttattgggcgtattgtcaagcaggtctctaggatgtttggtcttgcttctttacacgttgcggattatccagttggtctagagtcacaagtgacagaggtaatgaagcttttggatgttggatccgatgatgttgtccacatcatagggatccatggaatgggcgggttaggaaaaacaacacttgctatggcagtttataattttattgctccccattttgatgaatcctgttttcttcaaaacgtgagagaagagtcaaataaacatgggttaaaacaccttcaaagcgtccttctttcaaaattacttggtgagaaggacatcaccttaacaagttggcaagaaggagcttcaatgatacaacataggctccgactaaagaagattctcttgattttagacgatgttgacaagcgtgagcaattaaaggctattgttggaaaacctgattggtttggtcccggtagcagagtcatcattaccactcgggacaagcatctgctaaaatatcatgaggttgaaagaacttatgaggtgaatgttttgaatcacgatgatgcttttcaattgcttacttggaatgcttttaaaagagaaaaaattgatccaagttataaggacgtcttgaatcgtgtagtaacctatgcttctggccttccattggctttggaagtcataggttccaacttgtatggaaaaactgtagcagaatgggaatctgcccttgaaacttataaaagaattcccagtaatgaaatcttaaagattctagaagtaagctttgatgctttggaggaagaacaaaagaatgtttttcttgacattgcttgttgcttcaaagggtataaatggacagaggtttatgatatattccgtgctctttatagtaactgcaagatgcatcatattggggtgttggttgaaaaatctctcttattaaaggttagctggcgtgataatgttgaaatgcacgacctgattcaggacatgggtagagacattgagcggcagagatcaccagaagagcccgggaagtgcaagagattatggtcaccaaaagatataattcaagttttaaaacacaacacgggaactagtaaacttgaaatcatatgtctggattcctccatatctgacaaagaagaaacagtggaatggaatgaaaacgcgttcatgaagatggaaaaccttaaaatacttattattagaaatggcaaattttccaaaggtcccaattattttccagaaggtttgagaaagttggggcatctaacagttttgaagtttgacaagtgcaaatttttaacacagatacctgatgtatctgatctcccaaatttgagggaactttcatttgtagggtgtgagagtttagttgcaattgatgactcaattggttttctgaataaacttgaaatattgaatgctgctggttgcaggaagcttacgagttttccgcctctcaacttgacctctcttgaaacacttgaactttctcactgttcgagtctagagtattttccagaaatattaggcgagatggaaaacataacggcacttcatttggaacgccttcccataaaagaattgccattttcatttcaaaatcttattggactccgtgagataaccctgaggaggtgtagaattgttcggttacgatgtagcttagccatgatgcccaatctgtttcgattccaaattagaaattgcaacagctggcaatgggtagaatcggaagcaggtgaagaaaaagtggaggttagatatccaaatgtgttagagtatgaaaaagaaaagaaagaagaaggtgtgttagagttagagagctcactcatcaaaggaagtggaatccatatattcagagaagaaggcagtatggaggaagatattcgatttgatgatccatatctcagcagctctgcatcagaaagcccctccttgctacaaaccatagctttggggacacgcaatcttcaaaaaacgacttaa

SEQ ID NO: 16410 - DNA, 2790 bp, Glycine max
  Peptide Sequence Number=SeqID_108095
atggctgcaaaaacacgttcccttgcatccatctatgatgtgttcctcagcttcagaggtttagacacacgccatggtttcactggcaatctctacaaagctcttgatgacaggggaatctacacttccattgatgatcaggagcttcccagaggagacgaaataacacctgcactttccaaggcaattcaagagtccaggattgctattactgtgctttctcaaaactatgcttcttcctcgttttgtttagatgaacttgtaaccatcctccactgcaagagtgaagggctgttggttataccggtcttttataaggtagatccttctgatgtcagacaccagaaaggtagttatggagaagcaatggctaagcatcagaagaggttcaaagctaagaaggagaagctgcagaaatggaggatggctttgaaacaagtagctgacttgtctggctatcatttcgaagatggagatgcatatgaatacaagtttattgggagtattgttgaggaggtctctaggaagattagtcgtgcttctttacatgttgcggattatccagttggtctagagtcacaagtgacagaggtaatgaagcttttggatgttggatccgatgatcttgtccacatcatagggatccatggaatgggcgggttaggaaaaacaacacttgctctggaagtttataatttgattgctctccattttgatgaatcctgttttcttcaaaacgtgagagaagaatcaaataaacatgggttaaaacaccttcaaagcatccttctttcaaaattacttggtgagaaggacatcaccttaacaagttggcaagaaggagcttcaacgatacaacataggctccagagaaagaaggttctcttgattttagatgatgttaacaagcgtgagcaattaaaggctattgttggaaggcctgattggtttggacccggtagcagagtcatcattaccactcgggacaagcatctgctaaaatgtcatgaggttgaaagaacttatgaggtgaaggttttgaatcacaatgctgctcttcaactgcttacttggaatgcttttaaaagagagaaaattgatccaagttatgaggacgtcttgaatcgtgtagtaacttatgcttctggccttccattggctttggaaatcataggttccaatatgtttggaaaaagtgtagcaggatgggaatctgcggtggaacattataaaagaattcccaacgatgaaatcctagaaattctaaaagtaagctttgatgctttgggggaagaacaaaagaatgtttttcttgacattgctttttgcttaaaaggatgcaaattgacagaggttgaacatatgctatgcagtctttatgataactgcatgaaacatcacattgatgtgttggttgacaaatctctcataaaggttaagcatggtatagttgaaatgcatgacctaattcaggtcgtgggtagagaaattgagcggcagagatcaccagaagagccagggaagcgcaagagattatggttaccaaaagatataattcatgttttaaaagacaacacgaagttggggcatctaacagttttgaagtttgaccggtgcaaatttttaacacagatacctgatgtatctgatctcccaaatttgagggaactttcatttgaagattgtgagagtttagttgcagttgatgactcaattggttttctgaaaaaacttaaaaaattgagtgcttatggttgcaggaagcttacgagttttccgcctctcaacttgacctctcttgaaacacttcaactatcttcgtgttccagtcttgagtattttccagaaatattaggagagatggaaaacataagggaacttcgtttgactggcctttacataaaagaattgccattttcatttcaaaatcttactggactccgtctgttagccttgagtggctgtggaattgttcagttaccatgtagcttagccatgatgcccgaactgtcttcattctacactgattattgcaacaggtggcaatggatagaattggaagaaggtttcaagaggtttgctcatgtaggatatttaaatctatcggggaataatttcacaatccttcctgaattcttcaaagaactgcaatttttaagaactcttgacgtgagtgattgcgagcatcttcaggaaattagagggcttccaccaatcttagagtattttgatgcaagaaactgtgtatcctttacttcctcgagtacaagcatgcttttaaatcaagaactgcatgaggctggaggaacccagtttgtgtttccaggaacaagaataccagagtggttcgatcaacaaagcagtggaccttcaagttctttctggtttcggaataaattccctgcgaaacttgtttttcttcttattgcacctgtgtcgggtgccagctatcctttccttgagcccaagttgttcatcaatggcaaagttctgccattcaaaaatgaggtgatagatatgttgaaattggatcatacatatatctttgatctccaagagttacctttcaaaaatgataatctgtttgaagaagtggcttgggaaaaggaatggaaccatgtggaggttagatatcaaagtgtgttagagtatgaaaatgaaaaaagaaaaggtgtgttagacttagagagctcactcattaaagcaactggaatccatatattcaaagaagttgtcaaaagttcacttaacccaactgttgttcaccctatcttcaacatgtacttctga

SEQ ID NO: 16411 - DNA, 1926 bp, Glycine max
  Peptide Sequence Number=SeqID_108096
atggctgcaacaacacgttcccttccattcatctatgatgtgttcctcagcttcagaggggaagacacacgctatggtttcactggcaatctatacagggctctctgtgagaagggaattcataccttctttgatgaagagaagcttcacggtggagatgaaataacacctgcactttcgaaggcaattcaagagtccaggattgctattactgtgctttctcaaaactatgctttttcctcattttgtttagatgaacttgtaaccatccttcactgcaagagtgaagggctgttggttataccggtcttttacaacgtagatccttctgatctcagacaccagaaaggtagttatggagaagcaatgattaagcatcagaaaaggttcgaatctaagatggagaagctgcagaaatggaggatggctttgaaacaagtagctgacttgtctggccatcatttcaaagatggagatgcatatgaatacaagtttattgggagcattgttgaggaggtctctaggaagattaatcgagcttctttacatgttctggattatccagttggtctagagtcacaagtgacagacttaatgaagcttttggatgttggatcagatgatgttgtccatatcatagggatccatgggatgcgtgggttaggaaaaacaaccctttctctagctgtttataatttgattgctctccattttgacgaatcatgttttcttcaaaatgtgagagaagaatcaaataaacatgggttaaaacaccttcaaagcatccttcttttaaaattacttggtgagaaggacatcaacttaacaagttggcaagaaggagcttcaatgattcaacataggctccgaagaaagaaggttctcttgattttagacgatgcagacaggcacgagcaattaaaggctattgttggaagacctgattggtttggtcccggtagcagagtcatcattaccactcgggacaaacatctgctaaaatatcatggcattgaaagaacttatgaggtgaaggttttgaatgacaatgctgctcttcaattgcttacttggaatgctttcagaagagaaaaaattgatccaagttatgagcacgtcttgaatcgtgtggtagcttatgcttctggccttccactggctttggaagtcataggttcccacttgtttgaaaaaacagtagcagaatgggaatatgctgtggaacattatagcagaattcccattgatgaaatcgtagatattctaaaagtaagctttgatgctacaaagcaggaaacacagggatataagttcacagtaataaacaatgcactgacaacccccggtggtgtgagattccgtgacaaaataggagctgaatacgcaaaccgaacacttgagttggccacccaattcgtatggaggatctttcagcaaaaaaacccttctgacagaaaaaatgtgcagaaggtgagcttagtcgtggatgacatggagggtattgcatacactatgaacaacgagattcacgtgagtgcaagatatgttaatgggtatagtggtggggatgtgaaaagagagatcacaggggtgctgtttcatcaagtttgctacgtttggcagtggtatgggaatggtgaggctcctggtggattaattggaggtattgcagattttgtgaggctgaaggcaaactatgcagccagtcattggagaaaaccagggcaaggacagagatgggatgagggttatgatattactgctcattttttggattattgtgattctctcaaaagtgggtttgtggctcaacttaaccagttgatgaggactggttatagtgatcagttcttcgttcagttactgggaaagccagttgatcagctctggcgagactataaggcccagtatggcaatctagcctaa

SEQ ID NO: 16412 - DNA, 510 bp, Glycine max
  Peptide Sequence Number=SeqID_108097
atggctgcaacaacatgttcccgtgcatccatctacgatgtgttcctcaacttcagaggggaagacacacgccatggtttcactggcaatctatacagggctctttgtgacaagggaattcataccttctttgacgaaaagaagcttcacagcggagaggaaataacacctgcacttttgaaggcaattcaagagtccaggattgctatcactgtgctttctgaaaactatgcttcttcctcattttgtttagatgaacttgtaaccatccttcactgcaagaggaaagggctgttggttataccggtcttttacaacgtagatccttctgatgtcagacaccagaaaggtagttatgaagaagaaatggctaagcatcagaagaggttcaaagctaggaaggagaagctgcagaaatggaggatcgctttgaaacaagtagctgacttgtgtggctatcatttcaaagatgggtttaacttgtcgattgatttaactagtaaaatttaa

SEQ ID NO: 16413 - DNA, 3099 bp, Glycine max
  Peptide Sequence Number=SeqID_108098
atggctgcggcaacacgttctcgtgcatcaatctacgatgttttcctcagcttcagaggggaagacacacgctatggttttactggcaatctctacaaggctctttgtgacaagggaattcataccttctttgacgaagacaagcttcacagtggagaggaaataacaccagcacttttgaaggcaattcaagattccaggattgccatcactgtgctctctgaagactttgcttcttcctcattttgcttggatgaacttgcaaccatccttttctgcgcccagtataatgggatgatggttataccggtcttttataaggtctatccttgtgatgtcagacaccagaaaggtacttatggagaagcattggctaagcataagaaaagatttccagacaagttgcagaaatgggagagggctctgcgtcaagtagccaacttgtctggccttcatttcaaagatagagatgaatatgaatacaagtttattgggagaattgttgcatcggtctctgagaagattaaccctgctagtttacatgttgcggatctgcctgttggactagagtcaaaagtacaagaagtaaggaagcttttggatgttggaaaccatgatggtgtctgcatgatagggatccacggaatgggtgggataggaaaatcaactcttgctcgagctgtctataatgatttaataattactgagaattttgatggtttgtgttttcttgaaaacgtgagagaaagttcaaacaatcatgggttacaacacctccaaagcattcttctttcagaaatacttggagaggacatcaaagtaagaagtaagcaacaaggaatttcaaagatccagtctatgcttaaggggaagaaggttctcttgattctggacgatgttgacaagccccagcaattacagacaattgctggacgacgtgattggtttggtcctggcagcataatcatcatcaccactcgggacaaacaactgctagcacctcatggggttaaaaaaagatatgaggtggaggttttgaatcagaatgctgctctacaattgcttacatggaatgctttcaaaagagaaaaaattgatccaagttatgaggacgttttgaatcgtgtagtaacttatgcttctggccttccattggctttggaagtcataggttccaacatgtttggaaaaagggtagcagaatggaaatctgctgtggaacattataaaagaattcccaatgatgaaatcctagaaattctaaaagtaagctttgatgctttgggggaagaacaaaagaatgttttccttgacattgcttgttgcttcaaaggatgcaaattgacagaggttgaacatatgctacgtggtctttacaataactgcatgaaacatcatattgatgtgttggttgacaaatctctcataaaggttaggcatggtacagtaaatatgcatgacctaattcaggttgtgggtagagaaattgagcggcagatatcacctgaagagccagggaagtgcaagagattatggttaccaaaagatataattcaagttttaaaacacaacacgggaactagtaagattgaaatcatatgtctggatttctccatatctgacaaagaacagacagtggaatggaaccaaaacgccttcatgaagatggaaaaccttaaaatccttattattagaaatggcaaattttccaaaggtcccaattattttccagaaggtttgagaaagttcgggcatctaacagttttgaagtttgacaactgcaaatttttaacacagatacctgatgtatctgatctcccaaatttgagggaactttcatttaaagggaagcttacaagttttcctcctctcaacttgacctctcttgaaacacttcaactttctgggtgttccagtcttgagtattttccagaaatattaggagagatggaaaacataaagcaacttgttttgagagaccttcccataaaagaattgccattttcatttcaaaatcttattggacttcaagtgttatacctgtggagctgtttaattgttgagttaccatgcagattagtgatgatgcccgaattgtttcaactccatattgaatattgcaacaggtggcaatgggtagaatcggaagaaggttccaagaggtttactcatgtagaatatttagatctatcggggaataatttcacaatccttcccgaattcttcaaagaactgaaatttttaagaactcttgatgtgagtgattgcgagcatcttcagaaaattagagggcttccaccaaacttaaaagatttcagggcaataaactgtgcatccttgacttcctcgagtaaaagcatgcttctaaatcaggaactgtatgaggctggaggaaccaagtttatgtttccaggaacaagaataccagagtggttcaatcagcaaagcagtggacattcaagttctttctggtttcgtaataaattccctgccaaacttctttgtcttcttattgcacctgtgtcgggtgccgggtatcctttccttaaactcgaggtgttcatcaatagcaaatttcaagaattttggcactactatttatgggacgatatacaaagtatgttgaaattggatatcgatcatacatatatctttgatctccatgcgttcgctataaaaaatgataatcggtttgaagaaatggcttgggaaaaagaatggaaccatgtggaggttagatatccaggtgtgttagcgtatgaaaaaagaaaaagagaaagaggtttgttagacttagatggctcactcattaaagtaactggattccatatatttaaagaaggcagtatggaggaagatattcgatttgatgatccttatctcggcagttctgcatcagaaaacccctccttgctacaaaccatagttattctagatatgggacataaaattaatattgtgcttgtgatggttgatgttgagacatacatccaggaatatgcacccgagttacattgggttcggcatatgattgatattggtgatgaccaagataatactgtgattcaaatttacatagttagaaataacaatgaataa

SEQ ID NO: 16414 - DNA, 2718 bp, Glycine max
  Peptide Sequence Number=SeqID_108099
atggctgcgacaacacgttcccttgcatacaactacgatgtgttcctcagcttcacagggcaagacacacgccagggtttcactggctatctctacaaagctctttgtgacaggggaatctacactttcattgatgatcaggagcttcggagaggagacgaaataaaacctgcactttccaacgcaattcaagagtccaggattgctattactgtgctttctcaaaactatgcatcttcctcattttgtttagatgaactagtaaccatccttcactgcaagagtcaagggctgttggttataccggtcttttataaggtagatccttctcatgtcagacaccagaaaggtagttatggagaagcaatggctaagcatcagaagaggttcaaagctaacaaggagaagctgcagaaatggaggatggctttgcatcaagtagctgacttgtctggctatcatttcaaagatggagattcatatgaatacgagtttattgggagtattgttgaggagatctctaggaagtttagtcgtgcttctttacatgttgcggattatccagttggtctagagtcagaagtgacagaggtaatgaagcttttggatgttggatcccatgatgttgtccatatcatagggatccatggaatgggcgggttaggaaaaacaacacttgctctggcagttcataatttcattgctctccatttcgatgaatcctgttttcttcaaaatgtgagagaagaatcaaataaacatgggttaaaacaccttcaaagcatccttctttcaaaattacttggggagaaggacatcaccttaacaagttggcaagaaggagcttcaatgatacaacataggctccaacgaaagaaggttctcttgattttagatgatgttgataagcgccagcaattaaaggctattgttggaagacctgattggtttggtccctgtagcagagtcatcattaccactcgggacaaacatctgctaaaatatcatgaggttgaaagaacctatgaggtgaaggttttaaatcagagtgctgctcttcaattgcttacgtggaatgcttttaaaagagaaaaaattgatccaagttatgaggatgtcttgaatcgtgtagtaacttatgcttctggccttccattggctttggaagttatagggtataaatggacagaggttgatgatatactccgtgacctttatggtaactgcaccaaacatcatattggggtgttggttgaaaaatctctcgtaaaggttagctgctgtgatactgttgaaatgcacgacatgatccaggacatgggtagagaaattgagcggcagagatcaccagaagagccagggaagtgcaagagattattgttaccaaaagatatcattcaagttttaaaagacaacacggggactagtaaaattgaaatcatatgtctggatttctccatatctgacaaagaagaaacagtggaatggaatgaaaacgccttcatgaagatgaaaaaccttaaaatacttattattagaaattgcaaattttccaaaggtcccaattattttccagaaggtttaagaaagctcgggcatctaacagttttaaattttgaccggtgcgaatttttaacaaagatacctgatgtatctgatctcccaaatttgaaggaactttcatttaattggaagcttacgagttttccgcctctcaacttgacctctcttgaaacacttaaccttggtgggtgttcgagtcttgagtattttccagaaatattaggagagatgaaaaacataacgttacgatgtagcttagccacgatgcccaaactgtgtgaattctgtataacggatagttgcaacaggtggcaatgggtagaatcggaagaaggttccaagaggtttgctcatgtaggatatttaaatctaccggggaataatttcacaatccttcctgaattcttcaaagaactgcaatttttaacaactcttgtggtgcatgattgcaagcatcttcaggaaattagagggcttccaccaaacttaaagcatttcgatgcaagaaactgtgcatccttgacttcctcgagtaaaagcatgcttttaaatcaggaactgcatgaggctggaggaatcgagtttgtatttccaggaacaagtataccagagtggttcgatcagcaaagcagtggacattcaatttctttctggtttcgtaataaatttccagccaaacttctttgtcttcatattgcaccgtctactgggtcttttatccggtatccagaggtgttcatcaatggaaaatttcaagaatttgagtcccatgagacggacgatacagaaagtatgttgggattggatcatacacatatctttgatctccaagcgtatgctttcaaaaataataatcagtttgaagaagtggcttgggaaaaggaatggaaccatgtggaggttacatatcaaagtgtgttagacgatgaagaagaagagagtgaagaaggtgtgttagacgatgaagaagaagagagtgaagaaggtgtgttagacgatgaagaagaagagagagaagaaggtgtgttagagttagagagctcagtcattaaagcaattggaatccatatagtcagagaagaaggcagtatggaggaagatattcgatttgatgatccttatctcagcagctctgcatcagactacaaaccatag

SEQ ID NO: 16415 - DNA, 3507 bp, Glycine max
  Peptide Sequence Number=SeqID_108100
atggctaatttattgtgtctaagcaatgtggctactgttctttatgtagttatccaagtagtggtttgctatctaagaggagaaactagttttggtaatatgcacataaggttaggcgcaacagattatactgggtttggtcttttgattctgcaggcgaggaagatgcattgtgcccctcaagagataggcaatgatagtccaaaagtttcagaagcaagaaaggattccatatcaaccgtatatcaacagcaaaataaactcacatctttagaggattgtcaagaatcttctcttttaaagattaacactgatagtaggtgtgcaatccttccaatctttagcttcgagcctgatggaacctggagaattgttgccctaccagtgcagtgtcaaaatcacattaacttagcttctggtgtaaatatggatggtctgcaactccttttccctccacctctcaataggttgaagattgatcaatgtaaggggcctagagtacctcttcctccctatgcttattcagctaaatcatgtactaaaaaaggctttactggctcaaatgtgcatcgtcgatgtcaaaacaagattgctaacagagtttctaaactgaatgaactccccgacaattcttgttctcaaagttcattagtcagtggccctggcttgttccctggtagttctgctgcacttaattcatctgataagtacacaagtcattccaaggaagatgacaagtctttgaagaaaaactcaagaaaaagggcaagaaagaaagttaaacagagtaagaagaagtcaagtgacagtggctctcctgaacgtgaagttcttactgaggaatatgtctctgtaagtttgacttctgagacctgcagcagcaatgatgtggataaggaggatgtgggagaattttcaacttctgatgataggttaataaaatctgattgtgaaaggaattgcaacatcaatattatggaagcacctaatagttgcaactcttatcttaatcagggcatgtcaaaagctactgaacctattgttcaaagttctgccagagaatgtgccacatttgaacccaagaatcagctccaagatgagggccctgattttgaagtcattgatagaggaataaaggacatccaacacatggagccatgctgttttaatgatgtacatgactctttggtgctggattcagtttcaggtggtttcagaagtgatgaaagtataaatgctaatgatacaggaaagccgtccaacaaggcaaattgcacaatcacttcagattcaggagatggatattctcttggtcaaaacttaacgaatggtattcacaataactgtgaacataatgaggggatttggcatggtggtcaaaattgcatcagtaatgataagagagttaagcagaagagaacaatgtcgaagagttcagatctaaacaaatttgggggtgctggaattttgcatggtcgaaaagggaaggaaaatagtcattctgtatggcaaaaggttcagaagaacagttctgatgatggtagtggtgacttgaagaaagtaaacacaacttcatcacaatttgcttctactctagaaaaggatccttcagttatcaaagaatgtaattctgttagtgtaaatggtgtatcaaaaactgaagataagaaacacttgaaaaataaaattggtaggaaatcaaaagctaaagtggagtcaggtgcaaaaacgggcctcgacaattattcctggaagagtttccaatttaacgggtctttgtctaatgatcatgggaaggctagttttcaacagaatgacatgttgcatatctcttctcaggaaattgatcaacaaggattgaacactgtctctggattttctgatattaattgccttatggatggggtccagaccaatggagttgaacaggtaacatctgaaataggtcacagtgcagagtttcatctggaggagtcaggtccacaaaaaagtgccagcaatataattgcaaagacaaacaatgaaaatatagatagtcaggatagctcattcataatgccaggtgagtacatcaatcaatcaaatatgtctgaggagctgtctccagattcttgtaatcttgaaggtgatgaggttggtcaaaatgagaaagaagtttcttctgcagactacaatgcacaaaaccacagttctggaactaccctatggaaatggataccagttgggaaaaaagatagagggttggaaaaatctgaatcaaatagtgcaccaccagaaaattctgatgcatcctctcgtaacaattctaactctgaaagcagtgttgaaccagaagtggcctcttctgaaaatccggattcactaaatgcaagcagagcatgcaacggccagatttacgacaaagtgtcttgtctagatgagggtgagaaccacaaaatgggtagtcaggttgcacgtacattgacagagcacagggacaagcatgaagctgctaatcacatgttttatgaatgtgaaaatcaagatatgttagaaaattattcttacagaatagctcaagctgtgaatgatgcctgtaaggcacaactggcttgtgaagcagtacacatggctacaggtggtccagttgcagagtttgaaagactactacatttttgtagtcctgttatttgtaagtcactcagttcacacagttgttcggcctgctcacacaaccatggtggtggtgcctcactgtgcagacatgagatccctgacctatctttgggatgcctgtggcagtggtatgagaaacatgggagctatgggttagagataagggctcagggtcatgaaaatccgaagagacaaggaggtgttgctgattttccattccgtgcctattttgtcccttctttatcagcagttcagctgtttaagaaccatgaaaatttatgtgtaaataacggtgacaggctcccaaattctgaggtttcagaggcatgtgaaatggttgacatttcagcaaactcatctactgccagtcaacattcaatattttctgttctctttcctcagcctcgcaatcaggacaaaagcagtcaaacaccaaaggagacggcttctatcaataatgcatctattccgtctatcaactcaacctgctctggatacaagaactggttagaggccatataccaattgaatcttcaacttatggggacccaacaaaactggattcaattaacctacgagatcttcaccctagatcttggttcttgcatagtatctccaactgtggggcttcaaagctacaatgcccagggtgaatgctggttccagctgaagcattctgcacctgcagcagaaatggtgaacttagaaccttctttacttcttaaagagcgtttgaggacacttgaggaaacagcatctctcatggcaagagctgtggtcaacaaggggaacctaacctgtacaaacagacaccctgattatgagtttttcttgtctaggcgacggtattga

SEQ ID NO: 16416 - DNA, 5895 bp, Glycine max
  Peptide Sequence Number=SeqID_108101
atgactgtgtcagcatccttcagctacgatgtgttcctcagcttcagaggctctgatactcgctacggttttactggcaatctctataatgctctaagtgataggggaatccataccttcattgatgaagaggagcttcaaagaggtgatgaaattagaccggcacttgttgaggccattaaacagtctaggatggccatccttgtgttctctaagaactatgcatcttcttcgttttgcttagatgaacttgttaaaatcatggagtgtgttaaggcaaagggtcggttgatttttcccattttttatgatgtggatccttgtcatgtgcggcatcagtctgggagttatggagaagcgttggctatgcacgaggaaaggttcacaagtagcaaggaaaacctcaaggagaacatggagaggttgcagaaatggaagatggctcttaaccaagcagctgatgtgtctggcaagcattacaaacttggaaatgaatatgaacatgagtttattgggaagatagttaaagagatctccaacaagattaaccgtacacctttacatgttgcggattaccctgttgggctggagtctcgagtacaaacagtaaagtcacttctggaatttgaatctgatactggagtacacattgtagggatttatggaataggcggcatgggcaaaacaacacttgctcgagcagtttataattcaattgcagaccaatttaaaggtttatgttttcttgatgatgtgagagaaaatgctactaaacacgggttaatacatctccaagagatgcttctttctgaaatagttggagagaaggatattaagataggaagtgttagtaaaggaatttcaataataaagcacaggctccagcgaaagaagattcttttaattcttgatgatgttgacaaactagaacaactgcgggcaactgttggagggcctaattggtttggttctggcagtagagtcatcgtaactactcgggacaaacatttgcttgcaagtcatggggttgatagaaaatatgaggtagaggatttaaatgaggaagaatcacttgaattgctttgttggaatgcttttaaagatgacaaagttgatccatgttacaaggacatttcaagccaagcagtggcttatgcttctggccttccactagctttggaagttgtaggttctctattgtttgggaaaggcataaaagaatgggaatctgcgttagaacagtataaaaaaattcctaataaaaggatccaagatatacttaaggtaagctataatgctttggaagaagatcagcagaaaatttttctcgacatcgcttgttgcttgaaaggatatgaattggcagaggttgaagatatactttgtgctcattatggtgtttgcatgaaatatggcataggagtgttggttgacaaatctctcataaaaattaagaatggccgtgtgacacttcatgaattgatagaggttatgggtaaagaaattgatcgacaagaatcaccgaaagagcttggaaaacacaggaggctatggttccataaagatataattcaagttttagcagaaaatacagggactagtgagattgaaataatctctttggatttccccttatttgaagaagacgaagaagcatatgtagaatgggatggagaggccttcaagaagatggaaaacctcaaaacattaattattagaaattctcatttttcaaaaggtcccacacatcttccaaatagtttaagagtattagaatggtggacttacccattacaggatttaccaaccgattttcattcaaacaaacttgccatatgcaaattacccagaagttgttttacatcacttgagttatctggcatatcgaagaagttcatgaatctcacagttttaaattttgacgggactgaatgtttaacccagatacctgacatatccagtctccagaatttagtaaaattgacatttgaatgttgtgagaatttagttgcaattcatgattcggtcggttttctagataaacttaaaatcttgagtgcttttggttgcggcaagcttatgagttttccacccatcaagttaatctctcttgaacaacttgatctttcatcttgttcaagtcttgagagttttccagaaattttaggaaagatggaaaatataacacagcttgagttgaagtacactcctttaaaagaattcccattttcattcagaaatcttgctcgacttcgagatttagtgctggttgactgtggaaatgttcagctaccgattagcattgtcatgttgccagaactggctcagatttttgctctgggatgcaaagggttgctattgccaaaacaagacaaggatgaagaagaagtgagctcaatgtcttcaaatgtaaactgtctttgtctctcaggctgcaatctatcagatgaatattttcccatggttttagcatggtttagtaatgtgaaagagttagagctatcgtgcaataacttcacatttcttcctgaatgcatcaaagaatgtcactctttaatattacttaatttggataattgtgagcatcttcaagaaattagagggattccaccaaatttagaatatttctcggctggaaattgcaaatccttgagtttctgctgtacagccatgttattgaatcaggagctacatgagactggaaacaccatgttttgtttgccgggaacaaggagtccagagtggtttgagcaacaaagtataggtccatcattatctttctggtttcgtaacaagttccctgtcatggatctctgttttgttattggaccaatgggtaaggactctattttgtttagacccatcatgaccatcaatggcaacacaatggagacacagttaactgaaaagaggtgttgtttagacttccgagcattagattatcatatacttatcattggtacaaaatacatgaagttcggagagtgtctagataaacctctcacaaaaaatgaatggaatcatgtggtggtttccattggtattgaaccaacccctaaggatgtgattgtcaagcaaactggactccatgtaatcaaaccagaaagtagcatggatgatgtccaattcaccaatccttataagcaaccatcctttaaagagaagcaaagattggtggacatagttgattgtcatagacaatttatgcagcagcaaaccactttggtttcattaaaaccacatgtgagacagggcggagagtcattttcattgcttccacctcaagcatgcaaaaataatatgaattgggattcaaattcaactggaataactagcacttccagtgtccaggcagcgaaaaagattggctatattaggtttatcgcaacaacgccgaatggcttcattggatttacagcagcggcggggcagagaaatggtttccttgctttcttctccatcattggagttgatggtatcatggcagaggagatgcatcaccagtgtccaagcaatgatggaaacgacaatgacagaacctcctcaccggtggagcaattaccaatggcaaagttggttgatagggcacgagctttattgaaatgtttgctggatgttgctgttgaaagtgtttttgagactcgtttaaagacatcctttgaacatgaaaaacgcgtggctgtgcaggattcaaagtctccagtggcagccaacatttctcaaagctctgtaacatatccaacctgcagtaaaatgacttcagtgaaggaagagcagcctcagttgaaattactatcaaagaaagaactgccagagctgtcgaagttttgcatctctgatgatggaggaacaaaatgtaacacactatgcagcataggtgaggaaagcagtgtgatgcaacagaattcagtcaaggaaacaaatctacctaatgacaatggcatttttcccaacatagagagtaatcttaacaagcaacagcataatgatgtaaatgctttatatggcgatggtgagaacacagaagaatcattacaaatgtttgatgcaaaagctggtgagcaaaatgaagagaataatatgtcattgcagagtagaattcaagaagctcaaagtgattctaatgctgccaaacaggttgaacatccggatcaaaagggtgatttctctgatgatttggttaatgcaatcaaaagaattgagtcccggattttggctttccaactttgttcaaatttaagtggttccactaagaacagtgcaggtcttcatactacacatgaggcagcaaattcagactgtcctgtaataaagagaaacaatggggcttcaggaagtcagatgaatagtggaaagtccctcttggatggacgtaggttggtgaatcagaagacatgtaatgaaagttctaagggtgaaaattctatttcatcaaatgcattagtggaacccttttgtgctgtaaatggatcattgagtcagagtcagatggcaaatcagaatcgttggcatcataatggtgcagaatctgcaaagagcattgatataccacagcagattggtaccaagcaggcatcggtaggagagtggttgagaagtcggaataggattcaaaattcagtacaaaacatagctatgatagatagagttaagtcactgaaaaggttagttagcggtgatgcctattttgggagtcaagctagtgagtgtattcaaggtttgagggtccctttgaatcaagatgagcatactaagaagcactctatgttagtaagtaaaacaaacagggaaagtatggtccgtttaaatccagtggcttggtcaaagactgatcagaatcggaaggaaaagggttctgaatcttcctatgcacagaagttagcaggatcaaaggcccttatttcagggagagaaaagccaccacttcatcagatggtaatgaagccaactctattggaccagagatccagtgagattaaggtaagttcccatgaacacagagactctcgagttttggacagaagaataactcataagactggccatcttgaaccacggaagacaagggttctaccacaagatcataaactggaggaggcaaactcaaactctgactcttttcgcttgagttcttggcaaggcagtgccaatagtagtagtgactctgaggactactctttgccagatggaacacagtatccctcatccgcaatgatggtggattcagcatatgagggaagttcagaagagagcaacaactcatatctcaagaaggaaggtggtacttctcgtagatttggcagtttcaaaccatatagacatcaccgcgaaagaaatcctaaggaaacagttggaagactaaggaggctgaaaaataagttaggactaatctttcaccaccaccaccaccatcaccattaccatcatcatgatgatgatgttcatggtcatagacatactatgtggaatcagttgcagaatgtcttccaccataaagtcaagcatggggtgacaacaaataaagtagacaagacaaggagaggggctgttgcaagagtgttgcctcagagaaaccatgtcgggcagtttcatagacttgcggaaggggtcctgagacacatccggcattcaaagaaaccaaatcctttcaagcttgatgggatgaaacagttaaggaatggacattctcagaagaagctgcgttggtggcaaaaccttcgaccgcaccggagaccaaaaatcactaaagaactattgagtttgggtgcacgttggaatttctcaccttgcatctaccttcttctggctcatggtattcaagctcctatcagatatgcagaagaggattttgttagtgactgcatggtgattctgcattttgtaagtgctttgtga

SEQ ID NO: 16417 - DNA, 708 bp, Glycine max
  Peptide Sequence Number=SeqID_108102
atggaggaaaggataaaaagttctttcattttagcttcttcaaaagctgattttgacttatgtgttagggttaaagcagcacttaacaggcagtccaagactcgtttgataggaccaaactgccctggcattatcaagccgggggaatgcaaaattggaatcatgccaggttatattcataagcctggtcgcataggaatcgtctctcgttctggtaccttgacatatgaagcggttttccaaacgactgctgttggccttggacaatccacttgtgtgggtataggaggagatccctttaatggaacaaacttcgttgactgccttcagaagttcctaactgatcctcaaacagaaggtatcattcttataggagagataggaggaactgccgaagaggatgctgctgcactaattaagctccttataacggaggaagctctcataaaaatagaaaaagtagaaaaaaatggtataggaaataaggagagtggaactgagaagcctgttgttgcttttattgctggtttaactgctccccctggtcgtcgtatgggtcatgctggagctattgtgtcgggtggcaagggcactgcacaagacaaaattaaaaccctcagggaagctggggtcacagttgtggagtcccctgccaaaattggagctgccatgctagatgttttcaagcagaggggcttggttcaatag

SEQ ID NO: 16418 - DNA, 336 bp, Glycine max
  Peptide Sequence Number=SeqID_108103
atggaactaaatgcgtgcgaggaattggcgaaaattgcttcggatttcaagtgcgagaaggttctcaaaacagttgatgaatcaatcgtatgccccactccacagaagaacaaggaacccttaaccgttaaatccagagagggacaaaccaaccttcctgaaaagtgctctttttcattcttaattgacaatggaatccaattttgcaatgcgatgaaaaagaaaaggagacaatggcgttgtcaattttgcactgcgatgaagaagaactgtcagatcaaaattgacaatggatctgccaagggcaatgtgggaaaaattgagagttcaatgtaa

SEQ ID NO: 16419 - DNA, 1278 bp, Glycine max
  Peptide Sequence Number=SeqID_108104
atgggctgtgtggtgtcagctccgaaggactctggtggaaatagaaggaggccagggagtattggtgaactttcagtatatgttcctggtttgaggattcctaaacctgttgattttgctcaatcacttggtgattatttgtccaagaatatagtggaacgcctgtctgctcttagaacgcgtatagttgtaatggctggtcaagaaggtcctacaattacaagaacaaaaagaaaaactcagcatggaggttcaacactggctgaccttctgcaggctcttgaggattacttgcctgttgttctgggattagttaagaatggaagccatttacagtataaagtacaatttacttgggtgaatcaagaggatgacaaagaggaaacaaccatgtctaatgcttggtatgaggtgttgtcagttttgcatttgatggcaatgctatcactatcacaggctaacttgttactgtttccaagatcatcatcctctaatggtcatctgccaaaagtatcagaagaaagcagacgagcctctgttgatatctttctaaaggctgctgggtatttggattgtgcagtcaaacatgttcttccacagttgcctgtggaactcaggagaaatttacctgtagacctagcagagggagttcttcgagcactctgtctacaagcattaggacaggctatagatatacaacttggaatggcaattgatagtaccaaagccactcttgctgtgaagcgtaggcttgcatgtgagatggtgaaatgttggcaacaggctcaagataacattatgaatcttccgttggcaaatggttggggtgaaaaacattgtctttttgtgaaatggaaatatgttgaagcaaaggctgcagcatattattatcatggtttgattcttgatgagggaaatacagaaaaatctcatgggatggctgtagctgctttgcaagcagcagatgagtatttcaaagaaagtaagaagttgtgtgaggcattcaacgcagcatctccattgtcaagaaattcaccaccttgggggaccatgaaatatctctctgaaaaaattcctaaggatacttcaagcaaggtgcgaataaaccgcgatttgtactcttatgaaaggatcatggagacagcaccaacattgcctgatttttcattggccttgaaaccagatgaatatcaacttcctcaagtggactcatcttggagaacagagaacataaaagtgggacaaactgatcctaaccatcttaagggtgacaagtga

SEQ ID NO: 16420 - DNA, 3735 bp, Glycine max
  Peptide Sequence Number=SeqID_108105
atggcttggggatcacgttcctcttcctcttcctccaattacgatgtgttcctcagcttcaggggtgaagacacacgtagtgcttttactggccatctctacaacactcttcagagcaagggaatccacactttcattgatgatgagaagcttcaaagaggggagcaaataacaccagcacttatgaaggcaattgaagattccagagttgccatcactgtgctctctgaacactatgcttcttcctcgttttgtttagatgaacttgcaaccatccttcactgtgaccagaggaaacggttgttggttataccggtcttttataaggtggatccttctgatgtgagacaccagaaaggtagttatggagaagcattggcaaagcttgagaggaggttccagcatgacccggagaagttgcagaactggaagatggctctgcagcgagtagctgacttgtctggctatcatttcaaagaaggagaaggatatgaatacaagtttattgagaagattgttgaggaggtctctagggtgattaatctttgtcctttacatgttgcggattacccagttggactaaagtcacgagtgttacatgtaaggagacttttgcatgctggatctgatcatggtgtccacatgatagggattcatggaatgggcggggtaggaaaatcaacacttgctcgagctgtctataatgaattgataattgctgagaagtttgatggtttgtgttttcttgcaaatgtgagggaaaactcaaacaaacacgggttagaacacctccaaggaaagctgcttttagaaatactcggagagaagagcatcagcttaacaagtaagcaacaaggaatttcaatcatacagtctaggctcaagggaaagaaggttctcttgattatagatgatgttgacacacacgaccaattgcaagcaattgctggaagacctgattggtttggtcgcggcagcaaaatcatcatcacaactcgggacaaacaattgctagcatctcatgaagttaataaaacatatgaaatgaaggaattggatgagaaccatgctcttcagttgcttacatggcaagcttttaaaaaagaaaaagctgatccaacttacgtggaggtcttgcatcgcgtagtaacttatgcttctggtcttccattggcgttggaagtaataggttcccacttggttggaaaaagtatacaagaatgggaatctgccatcaaacaatataaaagaattgccaagaaggaaattctagatatacttaaagtaagctttgatgctttggaggaagaagagaagaaagtttttcttgacattgcttgttgtttcaaaggatggaaattgacagagcttgaacatgtttatgatgactgcatgaaaaatcatattggggtgttggttgaaaaatctctaatagaggttagatggtgggatgatgcagttaacatgcatgacttgattcaggacatgggcaggcgaatagaccaacaagaatcctcaaaagagcccaggaagcgaaggagattatggttaacaaaggatataattcaagttttagaagagaactcgaagttcaggaatctaaaggttttgaattttgaacagtgtgaatttttaacagagatacctgacgtatctgttctcctaaatttggaagaactttcatttcatcggaagcttaccacatttccacctctcaacttgacctctcttgaaagacttgaactttcatgttgttccagtcttgagaattttccagaaatattaggagagatgaaaaacttattgaagcttgaattgtctggccttcttggtgtaaaaggattgccagtttcatttcaaaatcttgttggactccaaagtttagacctggatgattgtgaaaattttttgttaccaagtaacattattgccatgatgcctaaactgtcttcattgaaggctataagttgcaaggggttgcaatgggtaaaatcagaagagggtttcatgcagcttcatcatgtgaaaactttaagcctaagggagaataatttcacattccttcctgaatgcatcagagaattgcaatttttaacaacacttgatgtgaatggttgctatcatcttcaggaaattagaggggttccaccaaacttaatagatttctcggcaatcgattgtatatccttgtcttcctcgagtacaagcatgtttttaaatcaggaattgcatgaggctggacaaactaagtttggctttccaggagcaactattccagagtggttcaatcaccaaagtaggggaacttcaagttctttctggtttcgtaatgaattccctgacaatgttctttgtcttcttgtagcacgtgtggaacgcataggtgataatgatattcccatgcccgtggtgttactcaatggcgaacttcttattgatcgtgatcatcacgtccaactaggaaaaaagaaatgggattatacatatctatttgacctaaaatcagttttagatgagcttgttgatctatctgaagtggtattagaaaaggaatggaaccatgtggaaattacatacgcgggtcagatagagacctcactggttaaagcaaccggaatccatgtattcagacaggatgatattcgatatgatgatccctatggcaagagaaaattagagcatgatctcagttctgaatcacaaccactcaataaaaagcctaggttatcgaggtgggttggccctgaaagaattataaatcttctggggaatgctgcagatggagctttatttactaatgccgagaggagatatagccatatttctatggtctcttgtaggcgatgcggcgtgttggaggagacatgtctgcatgctcttcgagattgtccagaggtggctgcattttggagaactttttttgggattgcagtggatctgttgtgggaatcccgcaacgaccttgtgttctatcaaaatggtcagacttgggcatatgtacatcttagggctacagatattgtctttaagcgctataaagattatatgagagcccgtgcttctcacaatttgatgacgaggaatctcttgaagtggaggaggcctttgcccctttcacatgggcattggttgttgagtctaaatgtgagtggtgcctatgatccctcttcaggtactgctgcatgcggaggtatattcagagactaccatgatagattcgtgcttgggttttcggtgaagcttggggaatgttggtcaaatgatgaggctgaaatatggggtatttatcatggtatgaagattgcaaggaagtatgatatttggggtttatttcgtgatattctaaggcagcatagcgataaacataatgtatttgactatattcgaataagtcctaagattgcaaggcagcatgaatttggtaaaattgtagtggtatcgggctctgagaaagctattgggtttgtgtcagatggatgccctacatctacatctacatctacatctacatcgatgcagcattgtttcccattctgtgatgagttgaaagctctaacgtctgctacaaatcactcatacttcatgtacgcaccggactcatacttgatgcacacaccggacgatcctgctgcttattcctttgtcaaattcggtttatccatgaaacaacaggctgcgtcaattttttcggcttgtccctccttttgccaaccttttgttagtgaatacatataa

SEQ ID NO: 16421 - DNA, 378 bp, Glycine max
  Peptide Sequence Number=SeqID_108106
atgtattccaaaatacttgttttggaatgtaacattctggaacaagaagcaaaagccttcctcctttcaacgcccatacctataaaggccacaaattcaatcagaaacagagaggacaccatggccaacaacaacgaagaggaagaggaagcagtggcgccaatggtgaagttgggttcttacggtgctgaggttcggttgctggttggtggggaggaatccgctgctttggggtattcagcagcccacactttccaaacccaatgccttcgtctctcaagcttccttgcaactctccctcgactcttgtggccactctctctccattcttcaatccccttcctcattggtatatatctctctcaatgctctggttaa

SEQ ID NO: 16422 - DNA, 1425 bp, Glycine max
  Peptide Sequence Number=SeqID_108107
atgcagttaaagcaactacagagttgctttagggatccacgtctcagccctgtaacgtgtttccaaacacagggtgagttcggcctagtggtggaagtattctatgaggtatgctattctgctgatccgccgaaattccagcagcgtggatggtcacatgctgcttctgtcccttctgaggaaccagaagccccaaaaggccaaaaaagggttccaagacatcaaaggagagctatggtggagtctttcgtgaacaagtatagagcagagaatgctgggaaattcccaaaaatatcagatacccagaaacaagttggtggcagttattatgttatccgggaaatcgttctggagctagaatatgagtctaaaatgaattcttcaaacagtgtggataagttttttgtgggaaagaaatttgatgagagtaaactacttaccactgaacctgtgaatgttccatctggtaatattgagattgcaaaagaaagccctgtcaaagatgattctcaatcggtagttttagatgacaaggagagtgttaacactggatatgatcatcttgaagaaaagagagagccacagacttcctatttggagaggaggttgtctgacaaacttgaaattatgtctacaccaagtaatcattgtattgctcctgaaagtaatattgtggaaaagttttctaaggagccttacccatcaagtctcgatatgccaaatgatattaagagtgaggaagctgtctctacttattctgattcttttgcacctgaacattctcaagaggaaagagaacattctcctttgtttagtgaaaatgatggtactggttatgacaaagctcagggccgtgaatatgattttgttcgtgtggaagatcatcaaaaagtggaggaaaaatgcattaaaaaagcagattgtgagataagggagcaacctgacttggaagacctatctagagagcttttgcattcaagtctcaaggtgccaaatgatgtgaagagcaaggaggctgtatctaattcttctgattctgctactcaagaaaggcacccactaaaagaagaaatagaccgattttctgctccttttattgaaaaatctgtaagtagttgcagtgaaggtcagacccatgattccaagtttgttgatatggaaaaacattcagcatttgagaaaggatatgcaagaaaagaccaagatactgtggatggtctaaagcataaaatagggcaatctcataggtctttagagttggatgagtccaaaatgatattaaggttgcttactttctctcaaatatccagggacagctctaataaaagggagaccagtgttgcagtgggtgcacagaaatcaactttgtgggaaaatatgaagtcatttgccactggcatattaaatatctggaaaaagtcatga

SEQ ID NO: 16423 - DNA, 900 bp, Glycine max
  Peptide Sequence Number=SeqID_108108
atgacttttatgagctgctttaatgatctaaatcccctctggcagcctcttggtaaggacacagttgaatacttcactctccaagatctttgggactgctattatgaatggagcgcatatggtgccggtactcctgtgatgttggaggatggtgataccgtgactcagtactatgttccttatctatctgctatccaaatctacaccagcaaatctgttgcagcttctcgcaatcggagagaggatagtgatggaattgaatttgaaagtgattcatggagtgaggatagtggaagtgataacctatctagatcattaagtaacaattccagcaaagcttgggaggatgctgtttctgaggattcaagctgtgaccaggagggttcatggctaagggataacaagcttggctacctttacttacagtatactgagatggcttctccttactcaagggttccactagcagagaagatagacaagttagctcaaagccacccggcattattgacattgaagagtgtggatctctccccagcaagttggatggctgtttcttggaacactgaaaaggatttggaagcatgcttcctcacttaccatacattgtcatcatcttttgaagattgtgctatggagtgtgatgacatagacatagggaatgatctacattgctccatccaaggagagaaatgcaaggaaaagaacagtggccatgtgtcgcttcttccatttgggcttgcaacttacaaaatgcaaggagacatttggctaaaccctgagccttatgacaatgaaaagatatcctatctatacagtgcagcagactcatggttgaaacagctcaatgtccatcaccatgacttcaacttcttcacattacacaacaacaccttgtaa

SEQ ID NO: 16424 - DNA, 741 bp, Glycine max
  Peptide Sequence Number=SeqID_108109
atggattatttgtatgggtattgcgatgccgaggcctatccattactttttcctgatgttgggcatcctacttcctttcgactgaaaaagctgtattttggtgagtacattggactaactggtgcacagctagatggagcagaaatggtagcatgcggtttagccacccattttgtcccttcagtgaagataaatacactagaaaatgtgctacaaactgttactaattcgaatttaccaatagcggaagttatagaaacattcgcagagaaagcaaatgtgaaggaagacagctcattcagaagattggagattataaacaaatgtttctcaaaagggacactggaggaaattattatatgcttggaaaaggaatcagaaaatggagcagaagagtggataaaaaatgcattaagttccatgcgatcgtcttgtcccttgagcctcaaaatatttttgaaatcaattagaacaggccgtgtacaaaatattgaacaatgcctttaccgggattacaccattgctggccacttcctcagaagaaccattagcaatgatttctatgaggggacaagagcaaagctgattgataaagacaacaagcccaagtgggaaccttcaaagctagagctggttagcgaagaaatggtagatcagtgcttcagggatatcgatgaggaggaaatggattgtctgaaacttcctgatagatccaattctcaaattgcaagcaggttgtag

SEQ ID NO: 16425 - DNA, 555 bp, Glycine max
  Peptide Sequence Number=SeqID_108110
atgagtttgaagaacaacatggtggtgctaaagatacacacttgcctcacatacaatcctggtcctgaatttctcaaaaacagcattcgtgtgaagcccgatttagatggtcttggtgccctaggtgacactggttggtattgcataagagccatcttatggactgtggactatgaacttccaaaatcagtgcttgcattcccaggagcaattctcaatgaagaagttttgggaacaaaagggtgtcttcgtctccatgattttgctcttccatttgaagaaagtttagggcatggaaaatttttggaggcctcagagttggattatgggaagattgaaccgggaatgtggtgtccaaagccaaatgagcatgttgtagagacagggttttctcaagatgctttgatggttaaggagtttgctgatttggttcaaaaggttaaggggtgtgaaatgaagcctgagaagacttggccagttttgagtaggaagcaagactcaggtggtgttggatgcagtgaaagagtcgattcagagaggttaccagcctgttga

SEQ ID NO: 16426 - DNA, 1857 bp, Glycine max
  Peptide Sequence Number=SeqID_108111
atgcacgcgccagttctagttctcaaggactctttgaaacgggagtctggatctaaggtccgctatgctattattcaggcggcggaggctgttgctgatgtagtccgaacaacgttgggacctaggtccatgctaaaaatgcttcttgatgctcaaggaggaattgtggttacaaatgatgggaatgctatcttacgtgaattagaccttgctcaccctgctgcaaagtctatgattgaattaagtcgcacccaagacgaagaagttggagatggaacaacatctgtcatcattcttgctggtgagatgcttcatgtcgccgatgcattcattgacaaaattcaccctacagttatttgccgagcatatgccaaagctttggaggatgctattgctgttcttgacaaaattgcaatgcctatcaatgctcaggatcgaggtataatgctggggcttgtaaaaagctgcataggtaccaaattcacaggccgatttggggatttaattgctaactgtttcctcaaaggagagcttggctctaaggctggtagggaaatatgtctacttgatttgtgtgtttgtgtactctgtgtggaatccaaaaaagtttctgttttaaaccctattatcctatgtaagaggaagcctagtctctgcagcattgctgataggaagggtggctcacagctagtgaagttggatgacttggctattgatgctactacaacagtaggtgttgaggttggccaaggtttgagagatgtggatattaaaaattatatcaaagttgagaaggtcccaggtgggcagctagaagattcaagagttctcaagggagttatgataaacaaagatgtggttgcccctggcaaaatgaggagaaagattgttaatccacgtatcattcttcttgattgtccccttgagtataaaaagggtgaaaaccaaacaaatgctgaactgctcaaagaagaagactggagtctcttattgaagatggaagaagaatatattgaggagctatgcatgcagatattgaagtttaaaccagacttggtaatcacagagaagggtctgagtgatttggcttgccattatctcagcaagcatggagttagtgcaatcaggaggctgaggaaaactgataataatagaattgcaaaggcttgtggtgctgttattgtgaatagaccagatgaattgcaggagtctgatgttggtactggcgctgggttatttgaggttaagaaaattggagatgagtactttgcatttattgttgattgcaaagaacccaaggcttgtactgttctactaaggggtgctagtaaggatctattaaatgaagttgaaagaaacctacaggatgccatgtctgttgcaaggaacattataaaaaatccaaaacttgttcctggaggtggtgctacagagttgacagtgtcagctgccttgaaacagaagagttcatctattgagggcatagagaagtggccttatgaagctgctgccctagcttttgaagccataccacgaactttggcacaaaattgtggagtaaatgtgatccggactatgactgctctacaaggaaaacatgcaaatggagaaaatgcgtggattggtatagatggaaatactggtagtatcactgacatgaaagagtgcaagatctgggatgcctacaatgtgaaggcacaagcatttaagactgccattgaagctgcttgcatgcttctgaggattgatgatatagtgagtgggatcaagaagaaacaggcccctggagccactccttcaaaacccaaggttgagaccgaggcagatgctgacagtgagcaaatccttcccgattga

SEQ ID NO: 16427 - DNA, 318 bp, Glycine max
  Peptide Sequence Number=SeqID_108112
atggtgatggaaagagatcctgcagctgccccaagggttccagaagatgacaatgttcttatcatgacaccaaccagcggcgaaggagctgagaagatggatgcagaagatggtgtaaactgcagtgattatgagcatgacatagaaaatgaagatttgtgggatgggaatgaagaaagtggagggtactggtcagggatatatgacagaaacaaggctcatacaaagccacttcttatgaaggggactaacaccacctcccagattgctattattggtgccaacctctgccctattgaaagccttgactatgagtaa

SEQ ID NO: 16428 - DNA, 1029 bp, Glycine max
  Peptide Sequence Number=SeqID_108113
aacgacacgacaatggcgtcaaccacatccaactcccaacaaccaaaaccggttcttccttggagggcacgcatttcaatatctttcctatgtaccctttccgacgccgctcgtcgctctaacggcaccgttaatcgcctcctcataaacctactcgacctcaagtcccaccccaacgccgcccccgttaacggcgtttcctccaatgacgtcaccgtcgacgcctcccgaaacctctggtgccgcgtcttctcccccaccgtcgccgccgcctccggcggcgctctccccgtcgtcatcttcttccacggcggcggcttcgcgttcctctcgccggattcattagcctacgacgccgtctgccggcggttctgccggcaaatccccgccgtcgtcgtctccgtcaactaccgcctcacgccggagcaccggtacccttcgcaatacgacgacggcgaggacatcctcaaattcctcgacgagaaccgcgcggtcctgccggaaaatgctgacttgtcgaaatgcttcctcgccggagacagcgccggcgcgaatttggctcacaatgtggcggttcgggtccccaagtcggggctccggataatccgggtcgtcgggttggtttcgatccagccatggtttggcggggaggagcggacggcagcggaggagaagttcaagggggcgccgctggtgtcgatggccaggacggattggctgtggaaggtgtttttgccagacgggtcggatcgcgaccatgtggctgcgaatgtgagtggaccgaattcggaggatttgtcgggtttggattacccggataccctcgtggttgtgggtgggtttgacccgttgcaagattggcaaaggaggtattatgagtggttgaaaaattcgggaaaaaatgtccaattgattgagtatcccaagatgattcatgcgttctatgtgttcgatgatttgcccgagtcttctcaattgatcacacaaatcaaggatttcataaacaagagaatctctgagttgaattga

SEQ ID NO: 16429 - DNA, 750 bp, Glycine max
  Peptide Sequence Number=SeqID_108114
atggcaactcaaatgagcaagaagagaaagtttgttgcggacggagtgttctttgccgaactgaacgaggttctgacacgtgaattggcggaggacggttactccggcgtcgaagttagggttacgccgatgcgcaccgagatcatcatcagagccaccagaacccaagccgttctaggtgagaagggaaggagaattagggaacttacctcagtggtgcagaagaggttcaaattccccgaaaacagcgtcgagctttatgctgagaaggtcaacaacagaggcctgtgtgccattgctcaggccgagtcgcttcgctacaagcttctcggtggcctcgccgttcgcagtgtggttctaaggtgtatacctagtcttgagaaattatgggcttgctatggtgttttaagatttgtgatggaaagtggtgccaagggttgtgaggtgattgttagtggaaagttgagggctcagagagccaaatccatgaaattcaaggatgggtacatgatctcttctggacaaccagtcaaggattacattgactctgcagtgagacatgtcctcctaagacagggtgttcttggtatcaaggttaagatcatgcttgattgggatcctaaagggaaacagggtcctaaaactccccttcctgatcttgtcacaatccacactcctaaggaagaggaagaatatgcccgtcctgctgctgttttggcaaccaatattgaggtccctgttgcttcttaa

SEQ ID NO: 16430 - DNA, 1185 bp, Glycine max
  Peptide Sequence Number=SeqID_108115
atggctaatttgctgacaatgttttttgttatggaaatgatagtagtgagtggtttcagttttggagcaagtggcttgagcatgaattactacttgttgagttgccctattgctgaacctgttgttaagaacactgtcaacacagctctgcaggatgatcccaccctagcagcaggtcttgttagaatgcacttccatgactgtttcatagagggatgtgatggttcagttctgattgactccactaaggacaacacagcagaaaaggattcaccagcaaacttgagcttgagaggctatgaagtcatagatgacatcaaggaagagcttgaaaaacaatgcccgggagtggtttcatgcgctgatattgtcgctatggctgctagagatgcagttttctttgcagggggtcctgtatatgacataccaaaaggaaggaaggatggaacaaggtccaaaattgaggatactatcaatctacctgcacccattttcaatgcttctgagctcatcaagatgttcggacaacgtgggttttctacaagagacatggtggctctatcaggagctcacacattaggagtggcaaggtgttcttcattcaagaacagactgacccaagtggactcagaatttgcgaagacactctccaagacatgcagtgcgggtgacactgctgagcaaccctttgactccacgaggagcgattttgacaaccaatacttcaacgctttggtctcaaacaacggggttctcacatcggaccaaacgttgtacaacagcccacaaaccaggaacattgtgaacgcttatgcaatgaatcaagccttgtttttcttggatttccaacaggcaatggtgaagatgagcatgctcgatgccaaacaagggtccaagggggaatgtggggaagcaatggaaaagatgaacaaagccttcgagaaagtgaagattatggtgggaatggacgccgaagatgaagatcaacaagctgctgcattgaacagcagcaactccttcgccttcatggacgacttcaaccgcaactgcaccttgtccaccacacaggacaataggatgcaggatacatgccgcaatcacaacacccatagtgggcacaatagcagaccgagtcacaattgtggatctgagaaattctgcaatgttatagctctagtgcgctaa

SEQ ID NO: 16431 - DNA, 219 bp, Glycine max
  Peptide Sequence Number=SeqID_108116
atgcattcttcgcttcatccaccttccaaactcgaacgaccatctcctcaccgtcgtgtctctccgccgctgccaccacacctccggcatccccaacagatttatggagcccctgcatcaaagtggaagatattgaagaatagaaggctacaaaattgggaatatacagatattcaaatactcaaaattttggaaagttgggatttcagagagaagtga

SEQ ID NO: 16432 - DNA, 489 bp, Glycine max
  Peptide Sequence Number=SeqID_108117
atggtgcccacgtggcaggaaccccgaaagcaacgccatttccttcgcattcttccatctaccgaagattcgcgacatgggtcgagaattttgatccgaaaaaccaaagggatgaaaaacagagaattagggttggttggggaattagcgtggaacggtgaaaaagagaagaactttggatctgtgttcgcggattgggaagtgggtgtgcgtgaatttatgcaggggaagagagagaaaattggattggaggggagaggattgagcaacaagatagagctaagaagtgtttatcggcgaaggaaagaaaactgccaacacaaacaacatgacacacccataagctacatttctggtttggagcggaaaaaaccaccaatggtgttgtttaccatggataaccgttgcaaagacttagtattatttgtcaatgtcttctcctggatgttcattttcagtggccatttattgttggatgtgatatattag

SEQ ID NO: 16433 - DNA, 432 bp, Glycine max
  Peptide Sequence Number=SeqID_108118
atggaggttccatcactttgtgctagtggctgtggcttctacggttcttctgccaacaagaacctttgttcaaagtgttacaaagattatctcaaagtcaccaaatcaaatgagtgtgaaaccaagaacttgaatgaccaagtttttgttcttgatcagtcatcaacttctgaagattctaacactgatgctatggttgatgttactctcaccgacgctgagggaatgaacaacaagcgaaagaggtgcaagtgctgcaacaaaaaggttgggctattagggtttggatgccgttgtggggatgtgttttgtggaacacatagatacccggagaagcatgcatgcaaagtggatttaaaggaaattggtcgtcaaggtttggttaaacaaaatcctgtatgtatcggtgataagttagaacataaaatttaa

SEQ ID NO: 16434 - DNA, 1161 bp, Glycine max
  Peptide Sequence Number=SeqID_108119
atgaataagtttgtgctggtactatttactgtttcctgggtccttctctttggtttgctagatggtaaacctcccataggcagtggtcgagtaatatgggacactggtggccaacagctgttcgcatcttatgcatactacattacggcaaggcatcctgatttaggcagtggtggcctcaaactcatcaagactggaaactcaacttgcccaaatactattttgcaatattttcccaagtacacccatggcctgccaatgtatttgctcatatctgtaataagcaatttcatcgtctatgaaggtaccccactggctatttttatggcaaagaagccaaattgtgttgaatcgttggttcctgatcctatgaagggatctccggatccaccaagtccattgaatcccccaaactcctctagattgttggtgtttgtggacaattcaatccacaagacatgtgtgggtactgctggtcctgaagctcatccaggcctactaacgtatagtggcacttttcacattgagatcctagaaaacgttcgatttggatacagctcttacaagcttgtgttttgtttcgatggctcagactaccaaaattgttcctatattgggacctatgataatgcaaaagggtctctgctaccattcacaaatcatccaaataccctcttggctgatctatggtctaatcatttccctgatccatttcgcgtgttagagcaaatcccatttggggttgacaaagatgaaacattcacagctctatcatcacatgcaagagtggattggaaggagacaccagaagggcatgtcataatgctagatgtgccagggttgaagagagatgagatcaagatagaagtggaagggaatagagtgctgagagtgagtggagaaaggaagagggaagaggagaaggaaggggatcactggcatagagtggagagatcctatggcaaattctggaggcagttcaaggtgccagacaatgtggacttggattctgtcaaggctaagatggagaatggagtgcttactctcacaatgaacaagttgtcacctgataaggtcaaaggtccaaggttggtcagcattgcaggggatgatgagcaagctcccaagctcaagggtaatgaagacaagcaggagctttga

SEQ ID NO: 16435 - DNA, 1179 bp, Glycine max
  Peptide Sequence Number=SeqID_108120
atggaggaaagagagatttttagttctgggcatgctgttaatcttctcgaggccccccatagcttccacgtggcactaaactccgtgcagttttccgggcccacagtggagacaccggcaccagcaccagcaccggcaccggcaccagcaccggcaccggtaccggtgattgctccggtgatgaattcaggtagtacggaggggaagaagaagaggggcaggcctaggaagtatggaccggatggcaaggtggcgctgtcaccgatgccgatatcggcgtcgattccgttcaccggagacttctcagcctggaaaaggggcagagggaagccacttgaatcaatcaagaagacttttaagttttatgaagctggaggtgcaggatctggtgatggaattgcatactcggttggtgccaatttcacacctcacatccttacagtaaatgatggcgaggacgttactatgaagattatgtccttctctcaacaaggatatcgagcaatttgcattctgtctgcaaatggcacaatttcaaatgttacactacgccaaccaacttcttctggtggtactttaacatatgaggggcggtttgaaattctttccttgtctggttcatatataacaactgagaatggattaacaaagagcagatctggtggtatgagcatctctttggccggtccagatggtcgagtaatggggggtggattggctggtttgctggtagctgcaggtcctgtgcagagttttgatggactttcttgtgccatatcaactaaaaagaaaaataaagatagagcacatgcattgaaagaactaaactacatgtatgaggaacattttactggacacttctcatgccatcttctgcatcaggttgttgtggctagttttcttcctggtcatcagctggagcagcagaaaccgaagaagccaagggtggagcatataatatcaatggctgcccctatgcatgtcaaccctacttcagctgctgaagaaataagaattggtcttggtggagtaaagccaatcatgacaccagctgcttttcaagtggaccacatttttggcaatggccaaagctctgggaactcagcttctgatgattcagcctctttccctgaaaatgagtccaaccccagccatgcagatgctggagttgcatgctaa

SEQ ID NO: 16436 - DNA, 708 bp, Glycine max
  Peptide Sequence Number=SeqID_108121
atggcttccattcccacactctcttcacccctacccacaatctctgctcactcctcaccccattcaaacccaaacaaccactgcactctctctcccacctctctcttcggcaccaggatcaccctcctacgcgccacctcatcgtctcgttccctccccaacaccaattgccgtgcgacatcagccaccgtgtcgtttagcctccccaccccgaaacccctttcagatacgcctgagaaaaccccaaagtggtcggcgagggctataaagtcatatgcaatgggggaattggaagcgaggaagctcaagtatccaaacacgggaaccgaggcacttctcatggggattttggttgaaggaacaagtaaagctgcaaaattcttaagagctaatggaattactcttttcaaagtacgtgaagaaacagtagagctactagggaaatctgatttgtatttcttcagccctgagcatcctccattgactgaaccagcccagaaagcccttgattgggcaatcgaggagaaattgaagtcaggtgaaggaggagaaataaacgtgacacatttacttctaggaatttggtcacagaaagaatcagcaggtcaacagatcttggatactctaggtttcaatgatgaaaaagccaaagaacttgctaaaacaattgatggggatgttgatttgagtttcaaaaggcaagcttaa

SEQ ID NO: 16437 - DNA, 243 bp, Glycine max
  Peptide Sequence Number=SeqID_108122
atgagggagcattttgcttactctagtggtggcaggatgttgtcgtcaaaggtttgtctaataggggtgagttcaaactacgatctcgttcatctccacgacgattatgatatcactagttaccaagtctccaacattcacactggtgatgttgttgctagtgatgtcgtggacgtcagttgtcaaacagagctagtcaaaaaagttgatatgcctatggaggaaatgcctgatttggcttaa

SEQ ID NO: 16438 - DNA, 285 bp, Glycine max
  Peptide Sequence Number=SeqID_108123
atgcacgaatgcaagagaaactcttgttttctcaatgggggatgcaaaggaaacacaatgaacataaaggggtgtctcaaagtgagagtacgtgcacacacaccttcatcaccaagaggtgaaacaaacggagagaggaacagcacaagcaccatacccacaacaagcaacaaaaagtgccttctcaacttgcctacaaaagccaacaacaacgcaacttccattgccaccacacgtaaaaaaaagctcaccttagagtacaacaacaaagaagatagaaggtga

SEQ ID NO: 16439 - DNA, 1194 bp, Glycine max
  Peptide Sequence Number=SeqID_108124
atgctaaaaaccgaaacaagcgaaccaaccaaccttgttatccgacaagcccaactgaataatcccattgggattctccaacgcgtcgtagggatctcgcgaaaccctctccaacccgacgtaatagagcgactcgtcgggtctggaaatctgcgtggcgagcttggagacccggacacgggaaatggagccacgtgtcgacaaactggagcgggaggaggtgcgtgggagggtgggttcggagggggagggaggggagaagttggaacggcgtcgtttgaggtagagctggaggaagtagaagagcgcgcaggggacgagagtcccgaggagaaggcctccgcctggagaacgaagaagaagggtggttctgttgggcttcgcgggcttgcgggttgggctttctgggctttctgctctgggtcattgacccgggtggagtgtggaggtgggtttggtttgtgtggtggtggtgctgctgctgctgggagaacccaagaaggaacgaacaaggagaagaaggagaaacaaaataaaccaaccaacgaaagagtttttcattaccaaaatggatcaagctctaatcttggctccaaccctttcaattctagcacttggatgatgctggagtttattaccttggttgtccagataaccattataacgttcactttggccatttccgagagggagaggtctatttggcctatgaggatatggatttctggttatgatattggctgtattcttaatttcctgctacttattcatctgacacaaggaaatgctcagaacctttctgatatggaacagcagagaaacaatgaagaaaccaggatgtcacacttgatgaataaatggcgacttgagcttttcttcgccatatggtttgtgttgggcattgtttgggtttttgagtcacgttttggatctttccatgaagctccaaagctccacgtggtctgcatcattctccttgcttggaatgcaatgtgctactcattccatttactactgtttgtgttgttatgctgctgtgtgccactaattagcaccctcctcggctacaacatgaacatggcttcttctgatgatcaaatttcacaacttccaagttggagacataaagaagtgaagagcagtgaagacccagaatgctgtatctgcttagctaagtacaaagacaaagagtaa

SEQ ID NO: 16440 - DNA, 1122 bp, Glycine max
  Peptide Sequence Number=SeqID_108125
atgaagcatatgaatgccactcttcctcatactctccctgaggatttgatcacagaaattctgatgatgttgcctgtgagatcgatattgcgttttaaatgcatgtgtaagttatggttttctcttatttctcatccagaattcgctcgatcccactttgccctagctgcaacacccaccaccagactttatctgtctgccaacgatcatcaagttgaatgcacagatatagaggcatcacttcatgatgaaaattctgccaaagtagtctttaactatcctcttccgtcacctgaagacaaatattataatcgcatgatagatatcgtgggttcatgtagaggatttatactcttgatgacaaccagtggtgccttaaatttcatcatatggaatccttcaacaggtctccggaaaggaattagctatttgatggatgatcatatatataatttctatgctgatcgatgtggctttggatatgactcatcaactgatgactacgtgatagttaatttaagaattgaagcgtggcgcacagaggtccattgtttctccttgagaaccaattcatggagtcgcatgttgggtactgctctatattatcctcttgatttaggacatggagtgttctttaatggggctcttcattggtttgttagacgctgtgatggtcgtcgtcaagctgtgattatttcatttgatgtgacggaaaggagattatttgaaattctactgccacttaatttcgccgttaaagatcaaatatgtgatttgagggtcatggaaggatgtctgtgtctctgtggtgctaatattggtcgtgaaactacaatttggatgatgaaagaatataaagtgcagtcatcgtggaccaagttattagttgttccaatttataatcagcatacaggtcctcctttactcttctttccccctgtcttttacccaatatgtttaaccaaaaaagatgagtttttgggatcaaatcacaagacattagtgaaacttaataagaaaggtgatttgcttgagcgtcacgcacgttgtcacaacattggctgtggtattttattacgctgtggtgtgtacagagagagtttgctatcactccctgagtaa

SEQ ID NO: 16441 - DNA, 285 bp, Glycine max
  Peptide Sequence Number=SeqID_108126
atgaagctgcatgttcttcttcttcttattctcttgttctgtattgcatcggaacttacgaccctttcagtctcagatgatttcacgtctcattctctcgaacgttgcgatgctgaaactgagttcaactcctatggctacattgctgggataaagaaggcattgaacgacacatcatgttcttaccaagtgatcatagctgcaagttgctcatcgcccaatttcacaatggagaacattgctattcgctttggggatgttcatggaaaccaaggttacgtttag

SEQ ID NO: 16442 - DNA, 108 bp, Glycine max
  Peptide Sequence Number=SeqID_108127
atgtatgcacacggtgacaaaatatttgtgaaaaagggaagatgtgggaaggtgaagatgatggttgttgatgttttggcttatgggcttcaattgggtcttaggtga

SEQ ID NO: 16443 - DNA, 607 bp, Glycine max
  Peptide Sequence Number=SeqID_108128
atgatgcccttcttctctttcacacactacaaatccttttggagatcttcaattgcatttgcatttgcatttgcatttttcttaacctttctcttgattgcaaactcactcactctccaaacccaatccactacaatcccatgcaacaaagacccctacaaggaactaaaccttatccctaacccaaacggcaccgtcacgcgccccaacaaacccccccagagcccgcccgcaccggatcccaacctcaacaccctcgtactctccaaagacctctccatcaaccaatcaaaaagcacatgggcgagggtctacctaccccgcgtagcactggatcacagctccaaactcccgttattggttttcttccatggtggcggcttcattttcctcagtgcggcctcaacaatcttccacgatttttgcttcaacatggcaaacgacgtcgttgcggtcgttgcgtccatcgaataccgtctcgcaccggaacacagactccccgcggcgtacgaggatgccgtggaggcgctgcagtggatcaaaaccaaccgagatgattggctgacaaactacgtcgattactccaacgtttttctcatggggagta

SEQ ID NO: 16444 - DNA, 1026 bp, Glycine max
  Peptide Sequence Number=SeqID_108129
atggccatagagtgcataacaaatatacaatctatgtctcaaccacaaaagcatcaccaagaccacaaagaagatgaagcaccattggtttttgatgcctcacttctcaggcacgaactcaacctaccaaagcagttcatttggccagatgaggagaagccatgcatgaatgtgcctgaacttgctgtccctctcattgacttgggagggtttatctctggtgaccctgttgcgacaatggaggctgcaaggatggttggtgaggcatgccaaaagcatggtttctttcttgtggtgaaccatgggattgatgccaagttaatctctcatgctcatagctacatggatgacttctttgagattcccctgtctcagaaacagagggcgcagagaaaaacaggggaacactgtggttatgctagtagcttcacgggcaggagggtttaccaggactattgtgatgccatgagtaatctttctttggggataatggaacttttgggaatgagtcttggagttggtaaagcatgttttagtgagttctttgaagagaataactcaataatgaggctcaattactatcctccttgtcaaaaacctgacctcactttgggcactggacctcactgtgacccaacatctttgaccattcttcaccaagaccaagtgggaggcctccaagtttttgttgacaatgagtggcattccgttagcccaaatttcaatgcttttgttgtcaacataggtgacaccttcatggctctttcaaatgggaggtacaagagttgcttgcatagggcagtggtgaacagtaggaccacaagaaaatctcttgctttctttttgtgtccaaaaggtgataaggtagttagtccaccaagtgaattggtggatgatttgaccccaagggtctacccagattttacatggcctatgctgcttgagtttactcagaaacattatagagctgacatcaaaacccttgaggcattcaccaactggcttcttcaacggaaaacgaactga

SEQ ID NO: 16445 - DNA, 162 bp, Glycine max
  Peptide Sequence Number=SeqID_108130
atggtgacttgcatgacccttctcatcacccaaatgtggctaccggagccactggaactcccttccttgtcgcggtcaacgctggtggagggtttggggttatcgtgtggggctggctatacaagggatttgaaaagaaacattattaagtgtgccctatga

SEQ ID NO: 16446 - DNA, 816 bp, Glycine max
  Peptide Sequence Number=SeqID_108131
atggctacggttattaggtcttgtggggtgcttgtaggtaaaatgttgggttatcaggtgcttggtagtgtgatcaaatctggattggatactactatgtttgttgcaaactccctaatttccatgtttggtaattgtgatagcatagaggaggcatcttgtgtgtttgatgacatgaaggaacgtgatactatttcgttgaattcaataattacttcaagtgtacataatggtcattgtgaaaaatctatagaatacttttctcacatgcgttatactcatgcaaaaacagattatattactacttcagccttgttaccagtgtgtggctctactcaaaatttgaggtggggaagagggcttcatggtatagtagtaaaatctagactggaatcaaatgtctgtgtgtgcaatagtctcctaagtatgtattctcaggctggaaaatctgagggttttgatgaatacatgaatttggttcttgatgatgctgaagaagtgaacatcaagaagaagagcagaaaaacattagctatgcttcagtttctcaaattttgttctatgaggatccttcttaaaggagataacataactttaatgatgaacacgcaatttgtgaaattccaggacatgccggaaaaccaaaaaaatattgatgcacaatcccacccaggcccacttgggccctccagaatattcctccagaaggctgttgcttctggaggaagcaacctggctcgcctgggcgagctgggcggcaaccacctcccctattttgctataaataggggaggaagtgaagaagaaaagggctga

SEQ ID NO: 16447 - DNA, 253 bp, Glycine max
  Peptide Sequence Number=SeqID_108132
atgtggattgtctctagtggtatggatctaacaacatatttagacaatgtggaagcaatgccttccaaggttattttgatgatgccaaagaatcaagagttaagcaaattccaaagattcaagaatcaagattcaagaataatcaagatcaagattcaagaatcaagagaagacttaatcaagataacacaagaagttttcacaaaatcattcccacaagagttttactctctggtaatcgattaccagacag

SEQ ID NO: 16448 - DNA, 228 bp, Glycine max
  Peptide Sequence Number=SeqID_108133
atggaggctggatctttgagcttcaatgaggtccttcaatggagaagaggtgagaggaggcgtcatccactagggaataagccatggaaggaggagcttcactaccaagagagtgtcttggataagaaacttagagaggaatcttcaatggaggaaaataatgagagagagagaggggaaggggggcacgaaattgaaggagaaaaagagggagaagcaagagcttaa

SEQ ID NO: 16449 - DNA, 678 bp, Glycine max
  Peptide Sequence Number=SeqID_108134
atggctctgaagaaactctccacgaagaggtctagaagagacgtcccaggagaaggatccagtgctgccccagattttgatagtcatcatttccgaagtgtcgagcaccagcagtgcttcgaggccatcaatggatggtcgttccacggggagaggcgtgtccagctcagggaggatgagtatacgaactttcaggaggagatagctcgtagacgttggacaccgctagtgactcccatggccaagtttgaccctgagatagtcctagagttctatgctaatgctttgcccacggaggagggagttcgggacatgcactcgtgggtaaggggtcagtggattcccttcgatgcagatgccctcagccagttcctaggtgacccgctagttttggaggaaggccagcagtgtgagttcagccagaggaggaaccgggccgatggtttcaatgaggaagccatcgcccagctgttatgcataccggggcaggatttcacccggaccgctgcagggaggcgggtgcaaatcatgcgcaccagcatgaccactttgacccagacttggatgacactgctgctcagcaatgtcttgcctagcgatcacaactccgacctccctctgcctaagtgccagttggtgtatgccatcctgacacggatgagcgtccacgtggcctag

SEQ ID NO: 16450 - DNA, 632 bp, Glycine max
  Peptide Sequence Number=SeqID_108135
atggggacaaatcaaatcagaaaaagattctatcaagtcaagattaagggcctagatgtcaccagccttaaggaggttggacggttgatgagacccctccaaaggcaagccttccgcaaagtgtacggaaatattttagatttgaccacaacggaggtatttacggaagccgttgcatccctcgcccaatactatgaccatccgttgagatgcttcacgcttggggacttccaaatagtaccgactgttgaagaatttgaggagattctaggatgccctcttgggggaagaaaaccctatcttttctccgggtttcatccctcgttgagcaagattacagctgtggtcggagattcagcgagagagttggatcgtatgaagcaaactcaaaatggcatagtgggcctaccgcggaaatacttggaaggcaaggcaagggatatggcgaatcaagatgagtgggtcccgtttgcagatacactagctttgctaatctttggggttgtcctctttccaaacgtggatggtttggtggacctagccgcaattgatgctttccttgcatatcaccatagcaaggagagctcggtggtagctatcttggcggacttatttgatacatttgaccgaag

SEQ ID NO: 16451 - DNA, 537 bp, Glycine max
  Peptide Sequence Number=SeqID_108136
atgcgggtgcttgcggccaccctgcgggggcaccgaggcctgcgtgccttccaggatcttcagcaacgcctgctgtacgccctcaccggagacatcgcgggtgatggacgggttctcgctcttgcgggcgatcttgtcgacctcgtcgatgtagatgatgccggtctcggcacgcttcacgtcgtagtcggcggcctgaatcagcttgaggagaatgttctcgacgtcctcgccgacgtacccggcttcggtgagcgtcgtcgcatctgcgatcgcgaacggcacgttgagcatcttcgcgagcgtctgcgccaggtaggtcttgccgcagccggtcgggccgagcatcaagatattggatttggccagttcaacggtctctccgcgggcgtcgcgagccttgtccccggcttggatgcgcttgtagtggttgtagacggcgacagccagcgtcttcttcgcggtgtcctggccgatgacgtagttctccaggaagtcgcggatctctgcgggcttgggcagttcatcgagccttga

SEQ ID NO: 16452 - DNA, 468 bp, Glycine max
  Peptide Sequence Number=SeqID_108137
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccagttacagttgttgcagaggatgttgagaatatggataatgttgctaacgtgtctcatgaggagccttacgattcagttatagagaatgatacattagtgttgacagattatgcttaccatgtggcatccaaagtgtgggcaagagaggtggagaaatttggaaggcttgcatctaagattgaaggcatgatggttgctacaagattaagttcttcgattacatgtttgttggagacag

SEQ ID NO: 16453 - DNA, 932 bp, Glycine max
  Peptide Sequence Number=SeqID_108138
agggctggacgccctcaccttcagaggacttacacgtcctcgccatcaaagggctgcacgccctcaccttcagaggactacacatcctggccatcagtcgactacacgtcctcgccatcagagggctgcatgccctcaccttcagaggactacacgtcctggccttcagagggctacatgcactcgcaattagaggactgcacgtcctcgccataaaagatctgcacgccctctccttcagagggctacacgccctcaccttcagtggactacacgtcctaacctttagaggactacacgtccttggcatcacagggctgcacgtcctcgtcataaaagatctgcacgccctcaccttcagaggactacacgtcctcgccatcagagggctgcgcgccctcacctttagaagacaacacgtccttgccttcagagggttgcacgccctcaccttcggaggactacacgtcctcccattcagagggctacacgtcctcaccttcataggagtacacgtactcgccatcagaggggtgcacgtcctccccatcaaaggactacacgtccttgccattagcggactagacgtcctcgccatcagaggactgcacgccctcaccttcagaggactacatgtcctcgccatcaggggactacacgatgtcgcctttagagggctgcacgccctcaccttcagaggattacacgtgctcaccttcagagggctgcacgccctcaccatcagaggactacacgtcctcgcctttagaaggcagcacaccctcgccattagaggactacacatcctcgcctttagaaggcaacacgtcctaacctttagaggacttcatgtcctcgccatcacagggctgcacgtcctcaccatcagagggcagcacgccctcgccatcaaagtgttgcacactctcacc

SEQ ID NO: 16454 - DNA, 129 bp, Glycine max
  Peptide Sequence Number=SeqID_108139
caaggagcagaatcgtctcaggtcaaagttagaagtcaagacaagttgactgcgaaaatcaaccaaggtacatggggacggatgcaagtggggatagaccgaccgatcgttgccctttcccggcgctaa

SEQ ID NO: 16455 - DNA, 379 bp, Glycine max
  Peptide Sequence Number=SeqID_108140
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccacaatggtagattttaacattatggtcaatgatgatgttgttggtcctatgactcctaagaaaggcttaaagcagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16456 - DNA, 306 bp, Glycine max
  Peptide Sequence Number=SeqID_108141
atgacggtatccggttttgtgtgggggggggctaactctgtgccagcagccgcggtaagacagaggatgcaagcgttatccggaatgagtgggcgtaaagcgtctgtaggtggctttttaagttcgccgtcaaatcccagggctcaaccctggacaggcggtggaaactaccaagctggaagatcggaaagaacaccaacggcgaaagcactctgctgggccgacactgacactgagagacgaaagctaggggagcgaatgggattagataccccagtagtcctagccgtaaacgatggatactag

SEQ ID NO: 16457 - DNA, 321 bp, Glycine max
  Peptide Sequence Number=SeqID_108142
tctttagacgaagatgacagtgttgatggtatatctgatacagacgatgaagtcaccgacatgattcaaccagtaagaattgttcacccagcagaaggtgcacaaggaattcaaaatccattttggaatgatgttttgcattataacaatatcaactggagtcatcctgatgaggaggacatttgtggtttggagatgctgttgacctttaatgttgggcaagaattatatgttggcatgaaatttgatagtaaagatgcggtaaaaaaatgcagtcaaacaatatgttatgaaggtgcatcaaagtttcaaagttgttga

SEQ ID NO: 16458 - DNA, 630 bp, Glycine max
  Peptide Sequence Number=SeqID_108143
atggttaaggaggagtgtaaggaggtaagtgtctcctccaagaggttagctaagaaggaaagtcattttgaaataaagacaaatactaaagaaacttctcctcttagacaacctccacatcttctcctttgtaaaaagacacttgttagcactgtcacacctcttgggcttgaggttattcctcaagtaaaggagttattggatgagggtttagttcgtaagagcttaaatccgtgtgctatattggtgtccaaaataggtattaataggcaccaaatcccaaaaataagtgatatgatgaatgtgttgagtgttgcaaccctcttttgtaaaatgagtcatgcaccctacatcttcatgattcatgtaaatagggactcattacgtaggaataatcaacatgaaaataaagaaaaaggtatgttttattccattactttccttaactttttaaatagtgatcaagggcttcccatggatcctaagagaataaaggtcattcctgagtggcctactccaccaagtgttgaggaaagaatcaatgagtttcaagaacctctggatttgaggtcaaatccttttcaagggggaggtaatgaagcaatcctaccccccaaggacattggatag

SEQ ID NO: 16459 - DNA, 120 bp, Glycine max
  Peptide Sequence Number=SeqID_108144
atggaagagaagaaaatattccctaagggagagttctcaggctttagttgctggagtggacttgggcctgcgctaagcttgtgctgctcgcttagcgtgggtgcttgttttcacgcttag

SEQ ID NO: 16460 - DNA, 363 bp, Glycine max
  misc_feature (259)..(259): n is a, c, g, or t
  Peptide Sequence Number=SeqID_108145
aaggcttattcaaagcctaggttgatccgatggatgctctggctccaagagtttgacttggagatccgtgataggagcggagcacaaaatttagttgttgatcatttgagtcggatcgaacatcatgctaaggcccaaacagataaaattaaaagtgtcagagagcaggaagtgcacttacatggtgacaacaaatgcctcagcaacctatgctattctgtgaggtttttgatgtctaggggtatccataccataccanccccaaaacaatggacaggcagaaatttctaccagggagatcatgagaattttagagaagattatgcaaccaagcaggaacgatcggagtaccaggctagatga

SEQ ID NO: 16461 - DNA, 651 bp, Glycine max
  Peptide Sequence Number=SeqID_108146
gcactttacaccttccttgcttggccgacacatctggtcaagtctttatcacagcaggtagccgtgtctccgacaaaaccacctccgaagcccgatccggaggtcgatgatacgctttatctgatgacattgaccatcccaaagcttttcttgaggccttatcaggttagatgggatgccaccatgttcggggtctttaatccagatttccccctctacataaaacatgaagacctatctgaaatcgcacacggtggtcagtgtctcagcatatcagtgttacaattgtggattctgcatctcactgaaacatgtatgcaagtggggaattctgatatctatggattccttgagccacagtccattcagaggtctgggcaatcgcagtttgagtctgaaagttacataaagagttggatgcagagttcacaacgcgatgtctatcttggagcctacctaaatgggttccaatgcagcggacactggcagatggtggtcatcctgcccaaggaacacctagttgtctggttttgttcattgcataacaggccagacaactacctaaaggggattattaatagtgctatcaagggtcttgatgatgctccacagcctaaatcaaaggcttctgctaggtggattgtcgtcaag

SEQ ID NO: 16462 - DNA, 501 bp, Glycine max
  Peptide Sequence Number=SeqID_108147
atgggacctctccaaatgcaagccttacgcaagacttacggaaagatcttagatttgaccatagcagaggtatccatagaggccattgcgtcactcacccaatactacgaccagcctttgagatgcttcacgtttggggacttccaattggtaccaaccattgaagaatttgaggagattctaggatgtcctctcgggggaagaaaaccatatcttttctccgggtgtctcccctctttgagcagaattgcaactgtggtcaaggattcagcaaggggtttggaccgcgtaaaacagactcgaaacggcatagcgggcctaccacggaagtacctagaagataaggcgagggatatggcaattcaaggagattgggtcccgtttatggatgtgttagcattgctaatttttggggttgtcctctttccaaacgtagatggtttggtggacctagcagcaatcgacgctttccttgcataccaccatagcaaggaaagtccg

SEQ ID NO: 16463 - DNA, 342 bp, Glycine max
  Peptide Sequence Number=SeqID_108148
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccacaagcagcaagagaagtagcgataagatggatggcaaagagaatgtag

SEQ ID NO: 16464 - DNA, 360 bp, Glycine max
  Peptide Sequence Number=SeqID_108149
atggaatttggtgatattgttgttcattttaacattcttgatgccatgaaacatctatctgaggatcattctgtttttcgtgctaagatacttgatcagattgttgatgattatatgtttgattttgattctcttcatgagtcagaacgcactaaccatgttgcaggaagtacatatacttctgacttgctttatgaggtacaggctgaggaaccctcctcttctcctaccctggttcctcccactgttcagccaccatccacactagagttgaagcccttaccagtaaacctcaagtatgcttacttagaggaccaaggaaacatttccagtgattatctctgcctcctttgctgttga

SEQ ID NO: 16465 - DNA, 531 bp, Glycine max
  Peptide Sequence Number=SeqID_108150
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgttttttggaaaaccgccgtcaacaccactcgtgaacatcggtttttcaaaaaccgatgataatgccttcacgtgtacaccgggttttctaaaacccagatga

SEQ ID NO: 16466 - DNA, 131 bp, Glycine max
  Peptide Sequence Number=SeqID_108151
atgtataccttttttagcattaaggttttggaaatcaagtctttaaaaacattgactgaaaagttacagaaggagaatcaggaattagagtttgttctggatatgcatggcctggagaattatgataaaag

SEQ ID NO: 16467 - DNA, 384 bp, Glycine max
  Peptide Sequence Number=SeqID_108152
atgacattaacctataaaaataggcgtatcacgaggccctttcgtctcgcgcgtttcggtgatgacggtgaaacctctgacacatgcagctcccggagacggtcacagcttgtctgtaagcggatgccgggagcagacaagcccgtcagggcgcgtcaacggatgttgccggagtgtcggggctggcttaactatgcggcatcagagcagattgtactgagagtgcaccatatcgcggcgccattcgccattcagactgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 16468 - DNA, 294 bp, Glycine max
  Peptide Sequence Number=SeqID_108153
atggagaggagtatgattgatgctgccagtggtggagctcttggtgatatgaccctagttgaagctaggaatttgattgagaagatggcttccaactcccaacaattcagtgcaagaaatgatgctattgttcttagaggagtccatgaggtggccacagattcatcttcatctactgaaaataaaaaccttgagggaaaacttgatgccttggtcaacctagtaactcagcttgccatgtgtcataccctaatttcgtccggggactattgcttgatggcatgcgacctttaa

SEQ ID NO: 16469 - DNA, 294 bp, Glycine max
  Peptide Sequence Number=SeqID_108154
atggagtgttgtctaccgcacttggtttgccagcaggcggccaaccaccgcggacaggtgcagatacacgagtgtctctaccgtttcagccgcagtcaacaggggcagagttccaccccttttgtgtgccctaccccggagcagtttgcggctgaggtcgcatggccgggagactggcccgatgccaaggcaggggaggagcctgcaggatcccccggtaggatagatgagccccgcatggacgaggatatgactgacctgttcgatttcttgggagggagcggagccacatga

SEQ ID NO: 16470 - DNA, 444 bp, Glycine max
  Peptide Sequence Number=SeqID_108155
atgggggatcccatcagcagactctccttccctgaaaacaacgagactttttcaagtctcacaagttatccagaactacgtaggtctgagttcctcattggaggatacgtaggagcaagagcctcgcttttgtcgaccacaccgtcttttgttgccataactcatgagccgataccttacggttatctgcacccctttgctaggcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacggttatctgcacccccttttgctaggcagacacagttgtgtccgatggcacgcagagaacaa

SEQ ID NO: 16471 - DNA, 351 bp, Glycine max
  Peptide Sequence Number=SeqID_108156
atggcctctaggaaatgcaagagtgtcggttcaagacccacagctcaatatgatacaaggagatttcactccttagatgcatggaaccgctctgatggtccttcaccaaagcaagccagggtcagaggccacctagtgaagattgacgttgacagcctcaacatattcctagagacacctgtggtgttggcagagggtgagactttgcccacatactccagatactataggctgccttcagatcctagggagattgaggctgccctgtgcataccaggcctagggttcatcttgaacgctgagggccatcctgggaggatcctgaggaaggacctaacgactctagcccag

SEQ ID NO: 16472 - DNA, 198 bp, Glycine max
  Peptide Sequence Number=SeqID_108157
atgtctcctccacctctaggacctcacaatcactcacaaactcatctcaagctctcaggacaacttcctcttcaagctccgatctctgtagcgcgcttagcacgactatggacagctaagcttgcattagtggattttggcttagcgcgcctcttctcgctcagcggatggactgaagcggtgcgcttagcgggatga

SEQ ID NO: 16473 - DNA, 438 bp, Glycine max
  Peptide Sequence Number=SeqID_108158
atgatcatgaggggtcaatacatctatagtagccaagaggaggctacttcttctccttcctcaagtggggcaacaacaacgagctcaagcttcgaagggccgagagagaccagtcaagagtcgaagttgagtaggatggaggcgaacatgtgggcaatcatcgaccaatataaagaaaagctaaatctagttgcaacccataagcaaaggctagaggacgagcatgcaaaggtattggtcttgcaagtgaaaagggaagcgagggagaaagtgatagattcattacacaaagaagctttgatgtggatagataggttcactttcactttgaatggaagtcaagagctcctaagattgttagccaaagccaaggcaatgacggacgtgtactcgaatcccgaggaagttcatgggcaaattgatgtcccacataattag

SEQ ID NO: 16474 - DNA, 525 bp, Glycine max
  Peptide Sequence Number=SeqID_108159
atgacggtgaaaacctctgacacatgcagctcccggagacggtcacagcttgtctgtaagcggatgccgggagcagacaagcccgtcagggcgcgtcagcgggtgttggcgggtgtcggggctggcttaacttgcggcatcagagcagattgtactgagagtgcaccattgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgcttgtgaaagaagctcaggaggggggattaatggggaattttggggtttaaaatactttagacatgttacaggagcatttctattggccacatatgaaacatga

SEQ ID NO: 16475 - DNA, 411 bp, Glycine max
  Peptide Sequence Number=SeqID_108160
atgccatctactcacgattggtccctttcctctcttcagagcttatgttcgctattactgcctcacaaagcccctcggaacatgttccagccatgttcttccttgcgggccctcttggtctcctgctccaaggccttggtggtgtctaggttgacgtctctcaattcggcattctcttttcggatcctaacagctgttgacttgaacttttctttggctttgggatttcttaagctctgttttgagggcttgttgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 16476 - DNA, 137 bp, Glycine max
  Peptide Sequence Number=SeqID_108161
atgggtgccaagcacctcacgaggaccaaagaatggtcgcacgtcatcgagcaaaggcaccctgtaggactgacagaggcccgtaaccagagctggaaaccccaggaccctattggtcttctccggatccaccggct

SEQ ID NO: 16477 - DNA, 371 bp, Glycine max
  Peptide Sequence Number=SeqID_108162
ctctgattacggtcctctgtcggttctacggggtgcctgttgcccccagcaaggtcatcagggcccctactaatcgagctttcatcaagaagtactgcgcagccaggcaggcgcagggcgaaacaccacagcagcctagggatggccggcagcgggcaacagatgcaccgccaccacctctagagttcacctcagcttatccacaaaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16478 - DNA, 168 bp, Glycine max
  Peptide Sequence Number=SeqID_108163
atgtcaaatgaagaattgaagctgcaagataaaatgtcaaatgcagattttcaggaaaatgatagatctcatccagcgcaagttgttgcagcccagatacgcccactgctatataaacatgaaggctgcacgagttctgtaccaagttcgggattgaagagttatttt

SEQ ID NO: 16479 - DNA, 496 bp, Glycine max
  Peptide Sequence Number=SeqID_108164
taatctggtggagaagtttttgcacaatgctcgggtggttagtataggtgaaatcaacaacctcagacaggattgttactacttgactgttgggacagttgacgaaatcatcattgatgctccatggagttatgacagttgtcctaactgtaccaccacatttgatccatcgaaagatggctcagcttgtcattcttgccaaaatagtgtgaccaatacagttccacggatggagcataatggggacaaaggaaacttccttttttgggatgcaacatgtatcaagctgtttggtaagactgctgcagaatgtcgagatgaattgatagcggatggggacgatattaaggtgtttccaacctgtgttgatgaaatcctgtccaaaacttgggctgtcatatttaagttctgttcacaattgcgccaatcatctgtgttggatgtcagtgaagaaccccatcatattcaaacattgatagccacccttgggttgaag

SEQ ID NO: 16480 - DNA, 246 bp, Glycine max
  Peptide Sequence Number=SeqID_108165
atggagaacaatggcggtttgtggtggataatggtggtcatgggtgatggagaaagtccttgggacgttagaaatggctttggaagaaagaaagaagaagaaatgactgagaaatgctctcgggaacggaagcttcgtgcacactccagacatcttctagaagatcccaacggtcagatcgtgtacaagtgtcttgtgaagctgcaaaccaaatgtagagaagatccaacggttaacgaaggctag

SEQ ID NO: 16481 - DNA, 411 bp, Glycine max
  Peptide Sequence Number=SeqID_108166
agtggaagctatgcgtggggagctgccgccctagtgcatatgtatgatcatttgaataatgcttgtaagagcgacggccgacagcttgctggttacatcactctattgcagatatatgagcatttttcctctattgctgactgcgtcactgatctagactatgatgagatgtcaccacatgcctgccggtggcttaactacgaaggcttattcgaagggattcccagcatagacgtactggacactgagcttcgatggggtcccgttgtggtcacacatcgaccagagaaggtggtgcgacaatttggatacgttcagaccattcctccgcagcctatgggtgtcagcttgtcatttgaagatattgacgacacgtgttggacaagtggcctcaataacttaggaaggggg

SEQ ID NO: 16482 - DNA, 147 bp, Glycine max
  Peptide Sequence Number=SeqID_108167
atggaagacgcacccgtgagccctcgtgtcgccctcccgccaaaggcacccacgagtttgcgtaaaaagaggccctatacctgggttcatggaaatctaaggagtggaggtggatctatggtcatgctaggtctccaacttgcttga

SEQ ID NO: 16483 - DNA, 757 bp, Glycine max
  Peptide Sequence Number=SeqID_108168
atgcctgaaggaaaggttccgttcattaatgcatttttaaaagataaagatgaagagcggtttcagaatttaagggttaaagcaactaattttactgtagagcctcgtttctatttaggagcaggatacggaaaaggcttttacgtagccccgtattacagatattcaaaagtaagttctaatacttttgatttctattatgattataaacccaccaatggagttacttatcagattccattgaaaggatcagggaataccaatggtaatagtggtggattaatggtcggggtacaattctttcttaccaaaagccaaaatcttgttttagatctatggattgccggtgcacattatggtagtggaaaaggagactttacgcttacaagtgattatctgctgacccctgaaatgcaacaacagctaaaaaaagagatcgaaaatctggacatcccgtttgtaaaatataccgtagaaaccaatcccaatggagcccggataaaagtagatgaccataaagatcttgcttccaacatcacagattatcttaaaaaagaagactatgtttgtgaagtggcgactaatgcaaaagaagctttagaaaaaattgagcttttcgaatatgattgcatcctacttgatctgatgcttccggatggaaatggattggaaatcctgaaacatattaaaaatgatgctccggaatccagcatcatcattgtatccgccaaagactccctggataccaaactgacag

SEQ ID NO: 16484 - DNA, 63 bp, Glycine max
  Peptide Sequence Number=SeqID_108169
atggcagagcataaaaacatatgtgtagaagaagagctagactccctatccaaagagccttaa

SEQ ID NO: 16485 - DNA, 183 bp, Glycine max
  Peptide Sequence Number=SeqID_108170
atggcagaaccatcaaagaagcgaaagggcacttcgagtcggagtcaatggcattccgagtcacaggaaacgctgattccttcatctattccctctggatcattgttttcatctgaggaacagcggatacgtgaaagccttctattcaaacctagaaatccaagaaggcactttaatttctga

SEQ ID NO: 16486 - DNA, 450 bp, Glycine max
  Peptide Sequence Number=SeqID_108171
ccaaactctcctccgcctcctcctccttctactgttgtagcatcgcattcgttgtcaccaccattgaagcggactagaaagacctcacgcctaagatcattggcaactagaccagttggggcagagaaaccccttgtccatgtggatcctgttactggcaaagcagatggttcccacagcaagaaattaagaacatatttagggatcgttgctcttgataaggtggatgtcacatacgaaaattggatgcatgtccctattactcagaaggatttgatatggggggatattcagctgacaaggatagtgtcgatgacactgtatgcaaaatgtacggcattagcaaggagaaatgggcccaattttgtcagagccgtagagacccttcatgggagaatgtgcgaaaaaatgcacaagccgtccaaaaacaaaacactgcctctcacgtga

SEQ ID NO: 16487 - DNA, 486 bp, Glycine max
  Peptide Sequence Number=SeqID_108172
ggcgacacgccctcaccatcagaggattgcacgtccttgccttcagagggggtacacatcctctcctttagagggctacatgccctcaccttcaaagggttgcatgtcctggcctttagaggactgcaggtcctggccttcagaggactgcacgtcctccccttcagagggacacacgtccttacattcagagggctgcacagcctcgccgtgagagggctacacgccctcaccttcagaggacttcaggtcctcgcctttagagggctacacgtcctcgcctttagaggagtacacgtcttcacctttagagcactacacgtcctcgccttcacaggactacaagacctcgactttagaggactatacgtcctcactttcagagggctgcacgccctggcctttatagggctacatgccctcaccctcataggactacacgttctcaccattagagaaccatacatcctcaccttcaaaggataa

SEQ ID NO: 16488 - DNA, 384 bp, Glycine max
  Peptide Sequence Number=SeqID_108173
atgtgccctttgtcattcagatttcgcaagtcgagtgataaacgcgcagagacaaattcggcgccctttgtcattcggggacagtttcgctggcagggagattcactggccgaatggtgtttcgctcgaacgaaattagtgtcttatctttacttcccttttatctccaataaaagacaagtaaagaggggcaattatcataccctaatttcgtccgaggaccatccgttgttgggatgtgatccttgtttgaccagtttgaggtacttggcacccatcgttaggcaattcgtgaagttccgtgacatgccagatgtcaaagaaggcattgtagcacgatccgtgaagttccgtgacatgccagaaattaaaaggaagtgttag

SEQ ID NO: 16489 - DNA, 144 bp, Glycine max
  Peptide Sequence Number=SeqID_108174
atggggtgctctcccaggcgagctcagctcgcccaggtacgtgctctctatgggtcggcgttcgcttacttgacccgcctagggctgcttcccagtagcgcttctcgcttgtccggagctggacgtgggacgacgatccgttga

SEQ ID NO: 16490 - DNA, 397 bp, Glycine max
  misc_feature (251)..(251): n is a, c, g, or t
  Peptide Sequence Number=SeqID_108175
atacttggcaccctttgttgcacaatatgtgaagtcccgagacgtgccgaaaatcaaaaggaagcaggcttacgcgatccgtgaaaattccgtaatgaaaataagtatcgttacgaaattcgtaaagtttcgtaaggttacggaaaaagaattaccaaaaaagcaatcgggcccacttgggccttctagattcttcctccagaaggctgttgcttctggaggaagcaaccttgctcgcctgggcgagctangtggcaagctgctcccctattttgctataaatagggggaggagtgaagagggaaggggttcagccttcttggcacttcttattctctcgaaattgctgaggaaaattatttccgtgaagaaaattcaagccgaggcgcttccgtaa

SEQ ID NO: 16491 - DNA, 426 bp, Glycine max
  Peptide Sequence Number=SeqID_108176
atgccgggagcagacaagcccgtcagggcgcgtcagcgggtgttgccgggtgtcggggctggcttaacttatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctatcgttatatcaaattgcactaccaaggcccagctcatccccaatgtcatcatcatcttcaaataa

SEQ ID NO: 16492 - DNA, 524 bp, Glycine max
  Peptide Sequence Number=SeqID_108177
gtcgactcctagaggatcccccgctcggtcgttcggctgcggcgagcggtatcagctcactcaaaggcggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 16493 - DNA, 351 bp, Glycine max
  Peptide Sequence Number=SeqID_108178
atggtacctagatcaagaaagggtctgttcatgggttatggtgatggggtgaaaggctatatgatctggtcacactcgaaaaagaaagttcttctcaacagagatgtaatttttgatgaatcacatctgtttcatcacaagcttaaggttccaattgctggaacacagagctgccactctcctcaagaaaaggatgtagaatctataaccaaagactcagaaaaaggaggtcattccgaaacatatcatgtggttcttcaagaaggtgagaaatcagaagattccaatgcaaatgagtctcttttggctgctgaacctgatcctccacagctcaattctggaatcaattag

SEQ ID NO: 16494 - DNA, 508 bp, Glycine max
  Peptide Sequence Number=SeqID_108179
ggagctatgcttacagaacaaagcacctgatcctcactattgaattcaggatcaactgttgtattgtaagggcagatgtaagctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16495 - DNA, 120 bp, Glycine max
  Peptide Sequence Number=SeqID_108180
atgatccagagggaatggaggaaggaattggcgtttcctgtgacccggaatgtcattgactccgactcgaagtgccctttcgcttcttcgatgggagtgatttggacaagaattgagtga

SEQ ID NO: 16496 - DNA, 471 bp, Glycine max
  Peptide Sequence Number=SeqID_108181
atggggtcggaccaagcgcaatcttttaagaaaaggttccatcatgtcaaagtcaaaaatctagaattagccagcttgcgaaagctggggcagcggatggatcaaattcaacgtcagtcttttagcaaggtatatgggaggatttgggatctagcaatgatagaagtgtcagttgaagtcattgcatctctcactcaatactatgaccaaccactcaaatgcttctcttttggggtctttcaattagcaccaaccatagaggagtttgagaggatcttaggatgcccgataggaggcagaaagccatacctcttttcagagtactatccttttatggtgagagtagcaagagtggtcaagatcttgaaacgagaattagatcaagtgaagcaaagtaggaatggagtagcaggaatactgaggaagtgcttggaagagaaggcgaaaactctggcaagccaaggagagtag

SEQ ID NO: 16497 - DNA, 450 bp, Glycine max
  Peptide Sequence Number=SeqID_108182
atggctccgaggaagctttccttgaagagatctaggaaggacgtcgcggtcgaagggactagtgccactcccgagttcgatagccatcgtttcaggagcgctgagcaccaacagcgtttcaaagccatcaagggatggtccttccaccgagagagacgcgtccagctcagggacgatgagtacacagatttccaggaggagatagctcgccggcgttggacgtcgctggtcactcccatggccaagtttgatccagatatagttctcgagttttatgccaatgcttggcctacagaggagggcatacgagacgtgcggtcatgggtaaggggccagtggattcctttcgatgcagacgccctcagtcagttcctgggatacccgctagtattgcaggagggccaggagtgcgaatacggtcagagaaggaaccggggccaatggatttga

SEQ ID NO: 16498 - DNA, 423 bp, Glycine max
  Peptide Sequence Number=SeqID_108183
atgtctcgccttcagaggactacacgtcctcaccttcaaagggtcatgtaccttcaatttcagaggactacacgtcctcgccgtcaaaaggtcatgtaccttcacctttgtagggctacacgccctcaccttcaaaggactacacgtcctcgccactcagagggctacacgccctcaccttccgaggactacatgtcctcatcttcagaggactacatgtcctcacctttagagggctacacgccctcggctccgaggactatacgtcctcatcttcagaggactacatgtcctcaccttcagagggctacgcgccctcgccttcgtagggctacacgccctcatcttccgaggactacatgtcctcaccattcagagggctacgcgccctcgccttgtagggctacacgccctcacctttga

SEQ ID NO: 16499 - DNA, 140 bp, Glycine max
  Peptide Sequence Number=SeqID_108184
atggtcaaagcaccaatggatgagtttagagatgaattagtgaaaggtgaagatgatgatgatgatgaatctttatccgattactgtgaaacccaattcagcaccaacaacatgaacaatccagtggttcaattcaacaa

SEQ ID NO: 16500 - DNA, 880 bp, Glycine max
  Peptide Sequence Number=SeqID_108185
atggcgaatcaagaggagtgggccccgtttatggacgtattagcattgttaatctttggggttgtcctctttccaaacatggatggtttggtggacctagccgcaattgatgctttccttgcatatcaccatagcaaagaaagcccagaaggaaaggagggagttctcttctcatgtggagactacccaaacatcctgttgataggaacgaggggttgcattaactacaattccgcacttgttataagacagttagggtaccccatgaggggagcaccgacggaagaaagcctgtctcctttccttgtgagagatttcggcgcgcaaagtttcaagctctccaagttaaagattatcaacgaagagaacttcgaagctccggaagaggatgacgaagtccgagctctaaaaaccgaactaggaaaagcgagacttgccaaagaaaaattcaagttggttgctacagacgtccggaaagagtgtgctggcaacagtgagctcaagcttcgaagggaagagagagaccaatcacgagcacatagcatggtcttgaaagaggagttagccgcttgctcaaggtccaaaagaaacttgtctcagcgtttatgtgagacagagaccaacatgttagccatcgtcaacaagtaccaagaagaactaaatctagccacggcccacgagtataaagtggcggacgagtatgcccaagtgtacgcggaaaaggaggctagaggaagggtgatcgactcgttacatcaagaggcaaaaatgtggatggaccgatttgctcttactttgaatgagagtcaagaacttccccgattgctagccaaggccaaagcgatggcggacacctactccgcccccgaggagatccacg

SEQ ID NO: 16501 - DNA, 288 bp, Glycine max
  Peptide Sequence Number=SeqID_108186
atgacattaacctataaaataggcgtatcacgaggccctttcgtctcgcgcgtttcggtgatgacggtgaaaacctctgacacatgcagctcccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 16502 - DNA, 294 bp, Glycine max
  Peptide Sequence Number=SeqID_108187
atggggcgtattccatgttgtgagaaggacaacgtgaaaagaggacagtggacacctgaggaagataacaagctatcctcctacattgttcagcatggcactcgcaactggcgtctcattcccaagaatgctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16503 - DNA, 172 bp, Glycine max
  Peptide Sequence Number=SeqID_108188
ggtgaaacatgaaaagaacatgaatctggggatcccacggtcatgttttctctgcatgccaccgaactcttgggtcacggtaacaagaagtggggtggtcgacaaaagcagggcttttgctcctacgtatcctcaatttgtgatgtggaactcagacctacgtagttcttga

SEQ ID NO: 16504 - DNA, 585 bp, Glycine max
  misc_feature (113)..(113): n is a, c, g, or t
  Peptide Sequence Number=SeqID_108189
atgagaaagcgccacgcttcccgaagggagaaagacggacagttatccggtaaacggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgttaaaacaacagaggctgatctaagatgtttgtctcagatgctaggcattggaagtgatgcactgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16505 - DNA, 168 bp, Glycine max
  Peptide Sequence Number=SeqID_108190
atggatacctcggagccctacactagggcaatgagaggcaccgtgcatgagcctcaagcgaatctagggacagatcaggagttcttacccggcttaacacccatcgccgtggaatccgtcaagttccgtgagattttggaaagaaaacagcccaaaacacaaaaacag

SEQ ID NO: 16506 - DNA, 144 bp, Glycine max
  Peptide Sequence Number=SeqID_108191
gatttggtggggtcacctctaggtgatttgggagcactgcgtgcttgggaattggttgctattaccataagacccatcaattggtccgacctgccggatcaatctcacacaacgaagaagattgtagatgtcaaggaagcctaa

SEQ ID NO: 16507 - DNA, 569 bp, Glycine max
  Peptide Sequence Number=SeqID_108192
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggcctcacaatgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaactt

SEQ ID NO: 16508 - DNA, 168 bp, Glycine max
  Peptide Sequence Number=SeqID_108193
atgccaatcttagctccaaaatttcaattgaaaattactgtgaaaacaagtgccaaagctagagggaattggaaaggaggattggtgtcatcccttgaagaatttgtgtcaagaagcaaggggccaaccaccttaagagctattggactacgaagcactccaaattga

SEQ ID NO: 16509 - DNA, 336 bp, Glycine max
  Peptide Sequence Number=SeqID_108194
atggcgaccaaaatgaagcgatgtccatttgaagctttgggctcaatagctccaatcacgtctattcctcacatagagaacgaccaaggtgctgccaagacgttcaaagcctccctgacgtccacacatcagagcaaaaccatatcatggttcctcttgtacaggatattcccactcaggaagaagccagctgccaaccttcgcaatgttctcttgtcattgtcagaagcctcccatgggtattccttgtcttcgatatattgcttgatatcgaagtaccaaggtttaccatcttgctcctcttctatcaagaaacaatgtgcaggcttgccgtga

SEQ ID NO: 16510 - DNA, 372 bp, Glycine max
  Peptide Sequence Number=SeqID_108195
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacggaggaccgaaacatgccactgaaagactctactgagacaaagacgggctgtcaagaacgtagaggaggtaggatgggcagttggtcagatctagtatggatcgtaccatggaccgtagttggagtcggtggctctcctaag

SEQ ID NO: 16511 - DNA, 321 bp, Glycine max
  Peptide Sequence Number=SeqID_108196
atgcaccgtaggcagcaaacacaccgccaccacctcatcaggctaatccagctgggtcatttggcatggagcggtatttacagcatttggttcgccagcaggcgaccaaccatagggggcaggtgcagatccatgagtgtctctaccagctcagcctcagtcagcagagccagggtttcggagattgcatggctcggagattgtcttgaggcccaggcaggggaagcacctgcagaggctcccggcgatgcagaggaggcctgcatggatgaggagatgacaaatttactcggtttcttgggagggagtggagccatatga

SEQ ID NO: 16512 - DNA, 453 bp, Glycine max
  Peptide Sequence Number=SeqID_108197
atggctcaattgatttctgatgtcatctattgtttgcagggatcacgcccacaagacgcccagtggacccgaagaagtccaacagggtcgtggggtgtccaactctggttacgagcctctgtcagtcctacagggtgcccgttccccccggcaaggtcacgtcatcatgacatagggatcgcacccgcaagacacccagtggacccgaagaagtccaacagggtcttgaagtttccaagctctaattacgggcctctgtcagttctacggagtgcctgttgccccccagcaaggtcgtcaggccccctactaatcgagctttcatcaagaagtactgcgtccccaggcaggcgcagggcgaaacacaacagcagcctggggatggcggcagcgggcacaaacgcaccgccatcacctctagagttcacctcagctcatccacaaaaaggttag

SEQ ID NO: 16513 - DNA, 339 bp, Glycine max
  Peptide Sequence Number=SeqID_108198
cattttcttgagcaagtagcctggcctgaagctcaacttccattgatgagacccaacgaggctgctctgcctgagcccacacctgtgcaggctgatccaaagccagctgacccacaatctccagtgatgaaccaactgtcttctcctgagtgtgaagtagttcccccatctccacctctaattatcatctctaatgcatcatcagatgaagtagctgcccctcctgattcaccagccggagaaacagctgaccttcctacttcaccagttggaggaattaccgatctttctgattcatcatctggagaagttgttgctctcactgattccccagtttag

SEQ ID NO: 16514 - DNA, 419 bp, Glycine max
  Peptide Sequence Number=SeqID_108199
gactctgccagtcattcggcgtccccgtcgcacctagcaaggtgattcggccgcccatcacccgagcttttattgagaagtactgcacgcagagacaggtccagggtgatgcaccacaggccacggacgtgctgccacctcatcaagctggtccagctggatcgtttgatacggagcagtatttgcggcatttggttcgccagcaggcggccaaccaccgggcacatagccagggctttgcttcttttccgtgccctactccggaccagttcagggcaaaggtcgcatggcctggagattggcctgaggcccaggcaggagaggcaccagcagaggctcccgatgaggcagatgaggcctgtgaggacgaggagatgaccgatttacttgatttcttaggaggaagcggggccacatga

SEQ ID NO: 16515 - DNA, 288 bp, Glycine max
  Peptide Sequence Number=SeqID_108200
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaacagtatcaagctaatgaagcagtcacagggatgctatgcaaaccttcaaagtggagccagaaaggttaattatgaactcatgtggaaggcttttcaaagaagcattagcattgaatggaatgaaagtagtgcgtaa

SEQ ID NO: 16516 - DNA, 357 bp, Glycine max
  Peptide Sequence Number=SeqID_108201
atggctgcgagatgctttggcataggtgtttttgagaaggatccagagatcatgcgaggtcttggtttgagacaccagggaggccacttcattatagagagtggtgaggagagcaccatatataaggcggtcctgtcgacgccagtggtggggtcgtttccgatggagtcggcgtcgaagatgttggagtggataattgttgggaagaagtttggtgacattggtgaaagtgatgcaagcaaggggtttggatggctcatgggggttgggaatgaaggagttgttgtcggccatgggaggcaagggtggggaacgacgtccttaattgaagaaatagggaatgggtggatcgtttag

SEQ ID NO: 16517 - DNA, 188 bp, Glycine max
  Peptide Sequence Number=SeqID_108202
atggtggaaagggaaaaattcgatcatatagaagaaaggttgagggccattgaaggaggcaaagactatccttttgttgacatggcagagctgtgcctagtgcctgacgtcgttatacctccgaagttcaaggtgccaaatttcgacaagtacaatgggactacttgctccaagaataacctgaagat

SEQ ID NO: 16518 - DNA, 351 bp, Glycine max
  Peptide Sequence Number=SeqID_108203
atgggcccagttttgccagactcgcatagacccttcttgggaggatatgcggaaaaaggcacaggccatccaaaaacagaacactgcctcccatgttttgtctcatgtgtcatttttgggcaggattcctttgaggagcaggcaccacagggatccttcgtcccccatggacgtcaagatgttctcaccgctactataggacatccagagcaccctggacgtgtccgtgttgctggagccggtgtcaccatcaagcaatactttggatcggctccacggatgtcccacagctcttccttgctgcctcctaaagaattgcagcaactgacccagcaaatagggaccagctag

SEQ ID NO: 16519 - DNA, 1515 bp, Glycine max
  Peptide Sequence Number=SeqID_108204
atggaagggctgatcgtcgataaagacatcagtttcaccaatctgaagggcacgctgcacgatttcctgaacaacttctttgaagaagacctgcaggttcgtttccgtccgtcctacttcccgttcaccgagccgtccgctgaagtggacgtgatgggcaagaacggcaaatggctggaagtgctgggctgcggcatggtgcatccgaacgtgctgcgcaacgtgggcatcgatccggaagtttactccggcttcgccttcggtatgggcatggagcgcctgacaatgctgcgttacggcgtcaccgatctgcgcgcattcttcgaaaacgatctgcgtttcctcaaacagtttaatgaactctggttgcgcgagtgggtaaacccggccatcagcagcgaagcattatccgatcaaatcaccatggccggcctggaagtggacggcgtggatccggttgccggcgcgtttaacggcgtcgtcgtgggcgaggtggtcgagtgcggccagcacccgaacgccgacaaactgcgcgtcaccaaggttaacgtaggcggcgaacgcctgctcgacatcgtctgcggcgcgccgaactgccgtaccggcctgaaagtggcggtcgccaccgtgggcgcggtgctgccgggcgacttcaaaatcaaggccgccaaactgcgcggcgaaccttcggaaggcatgctgtgctcgttctccgagctgggcatttccgacgatcatgacggcatcatcgagctgccgctggatgcgccgatcggcaccgacatccgtgactacctgaaactgaacgacaacaccatcgagatcagcgtcacgccgaaccgcgccgactgcctgggcatcatcggcgtcgcgcgcgacgtgggcgtacttaaccaggttgcgctgaccgagccggacatgagcccggtggccgccaccatcgacgccacgctgccgatccgcgttgacgcgccgcaggcgtgcccacgctatctggggcgcgtggtgaaaggtatcgacgtcaaggcgccaagcccgctgtggatgcgcgaaaaactgcgtcgttgcggcatccgttctatcgatgccgtggtagacgtcaccaactatgtgctgctggagcttggccagccgatgcacgctttcgatctgggccgcatcgacggcggtatcgtggtgcgcatggcggaagaaggggaaaccctgacgctgctggacggcaacgaagccaaactgagcgccgacaccttagtgatcgccgatcatcaaaaagcgttggcgatgggcggcatcttcggcggcgagcattccggcgtcaacggggaaactcaggacgtgctgctggagtgcgccttcttcagcccgctgtcgatcaccggccgcgcacgccgtcacggcctgcacaccgatgcgtctcaccgctatgagcgcggcgtcgatccggcgctgcagtacaaagcgatggagcgcgccacgcgcctgctgctcgacatctgcggcggccaggccggcccg

SEQ ID NO: 16520 - DNA, 393 bp, Glycine max
  Peptide Sequence Number=SeqID_108205
atgaccatgattacgaattcgagctcggtaccctggcaactattggaaatacaatgccactcaaagcttgccgctaggcgctttcagaagcccaagaaaggtttaaaacttgatggctctgatgataatggtgatgtgccttccatggatatgcgcttgaataccgagtcccctttattatggattagagcagatcctgatatggagtaccttgctgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16521 - DNA, 76 bp, Glycine max
  Peptide Sequence Number=SeqID_108206
atgcaatttacgaatacgggagctcgagaaattgtccccttcttggatacaacgtttgggcagcatggcacccaac

SEQ ID NO: 16522 - DNA, 450 bp, Glycine max
  Peptide Sequence Number=SeqID_108207
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctggctgatggcgagattgcgcggattgttcagcgggcgccagatccattcgccgttgcccgcgtgaatcgccaggccgttcgagtcgtgcagcgccggacggaagttgtggggatcctctag

SEQ ID NO: 16523 - DNA, 138 bp, Glycine max
  Peptide Sequence Number=SeqID_108208
atggaagcttgggggctgctgttttcgtggttcccgatattgggctgccttgcagcgacgttctctgcttgtccagcgccgggaagcaatgacaatcggtcggtcgtgaccctatcctccatttgcgtctgctcctaa

SEQ ID NO: 16524 - DNA, 198 bp, Glycine max
  misc_feature (34)..(34): n is a, c, g, or t
  Peptide Sequence Number=SeqID_108209
atgcctataggttggacctcccagaagagtgganctgatattgaggaggaggaactaacagatttgaggtcaaatcctcttcaaggggaaggggatgatgcaatccttcctaggaagggaccagtcactagaaccatgagcaagaggctccaagaagattgggctagagctgctgaaaaggccctagggttctcatga

SEQ ID NO: 16525 - DNA, 432 bp, Glycine max
  Peptide Sequence Number=SeqID_108210
atcatgggttctccacctgcctccactcctcctcctcctcctcctcctcctcctcctcctacttcggacgcatcggcttcaacgtctgccgtgaagcggacacgcaaagcctcacgcctacgatcattgtccactagaccacctggtgttgagagacctgtggtgcatgttgatcctgctacagggaaggccgacgatccccacaagaagaaattaagaacatatttggggattgtggcacgtgataaggtggacatcacctacgagaactggaaggaggcgaaatttgatatcccagaggcttctgacagtaggacgaaaaagaagttactacagaccgacggtgtcgaggacactgactgtgacaaatacggcatcagcaaggaaaagtcggcccagttttgccagactcgcagagacccttcttgggag

SEQ ID NO: 16526 - DNA, 570 bp, Glycine max
  Peptide Sequence Number=SeqID_108211
atggcatccttcagccaccttcagtcgcagatgcaatctcagggacttacagtgcctcctaagcctctggttggtcctggtccctccggtcctcgagtgagcacaaaggggagttgtgttgatccctcaggaaacgatcctgagaccggtgactctgacaggtgcggcttgtacatagaagcagatcctgcccgcctggttgctatcgggagagtttgtgagggacccactgttgttcataacactcctttgttgcctggccaagtaaaggtgagtgtggaggaggttagagatgcagatgctccagttcctatacccactgatgaggtagctgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccaggtttccccctgtacataaagcacgaagacctctccgaaatcgcacacggtggtcaatgtctcaacatatcagtgttacagttgtggattctgtaa

SEQ ID NO: 16527 - DNA, 246 bp, Glycine max
  Peptide Sequence Number=SeqID_108212
atgacgactttagtctctgcatgctaccggactataaccacttgggtatctctgcctgctatcgcaacctacccttcggcgggagggcgacgcgtgactcgcgggatgcgtgttccacgaaaggaatacgcgcggagtcaccaccaacgtttatttgagaaaacgtcggaaaaccggaaagacgcgatctacgaactttttagtgaaaggttcgggagttgtatttacgcacggggaaggtattag

SEQ ID NO: 16528 - DNA, 353 bp, Glycine max
  Peptide Sequence Number=SeqID_108213
gtgaagacattgtcgtctttgaaatgtgtgcggattatcgtatagggcgtctccgcatgctacctgacttctcacagataaccacttggggcatttccgcctgccacctgacttcacgagtcgagattaacagaaactcactgtctctggatgaaaaaggtgtagaagacgacgttagtctctgcgagtcaacaggctcgcttgcccctggtgcggatgaccatggtatctccgcctgccacctgacttcccggtcgccgtctctggatgacaaaggtgcagaagacgacgttagtctctgcgtgtcaacagggctcgcttgcccatggttgacaaagggtgaagatgacgac

SEQ ID NO: 16529 - DNA, 330 bp, Glycine max
  Peptide Sequence Number=SeqID_108214
atggctgatgagcaccaacaaagagttacccttgaggactatttaagcagttcagtgccacaattctttaccagcattgcacgtcctgaattccctgacaagtccttgagtgaagcattggataggtttagaggtttattgagaaagactcccacccataggttctctgagtcaattcaattgaatatgtttatagatgggctgaaaccacaaaccaagaaactgttagatgtgatgcaatcctaccccacaagggcattggataaaagactccaagtaggttgggccagagatccaagggaaggccctaaggttctcatcagccttagg

SEQ ID NO: 16530 - DNA, 535 bp, Glycine max
  Peptide Sequence Number=SeqID_108215
atggctccgaagaagcttccaaccaagaggtccaagaaacatgccactagagagggttctagtgcggccccacaggtggaggtggactttgatggacatagggagaggctagtccaattgagggacgaagattatgttgagtttcaagaagaaatcgcccagaggcaatggactcagctggtgtcacccatggctaagtatgacccagagataatcatggagttctatgccaacgcctggcccacggaggagggattcaaggacaaacactcctgggtgagggatccaatgaggatgccattaactagtttctggggcgtccaccggtcttggaagaaggccagcgctgtgagtttagccagaggaggagccaagcctcaggcttcgacgaggaggctattagccagttgctatgcgtttcgggtcggtggccttgttgatgcttgcgcgcttagcgcaactctggctcgcttagtgcgcattagtgaatttcggcttagtgctcatctttatgctcagcggatggacttaagcg

SEQ ID NO: 16531 - DNA, 370 bp, Glycine max
  Peptide Sequence Number=SeqID_108216
gcccatggctactccacgtgactcggctcctcctcctcctcttcctgtagtagcatcacagtcgcaaccggtggtccacgttgatcctgcgactgggaaggtcgacggtccccacaagaagaaattaagaacatatttggggattgtcgctcgtgataaggtcgacgtgacatacaagacttggaagcaagtccctgctgctcaggaggatattcaagttgaatttgatatccttgaagcatctgacgctgacaacgacattgtggatgacactgtttgtgaaaaatacgacattagcaaggagaaatgggcccatttttgtcagacccacagagacccctcgtgggaggatgtgcggaaaaaggcatag

SEQ ID NO: 16532 - DNA, 615 bp, Glycine max
  Peptide Sequence Number=SeqID_108217
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgtaggccatgggatgggtctccttctgggtcagttgacggggatcgccgcggcgcgcagtgggcgcgcacccgggctgtacgtcttgctggtcgggtcatagatggcggcgtcccggatcgggcagccgagctcgtcgtcgaggaacagcacggggagatcgtcggagctggggtcgctcacgggtgtgaagctcatccagctgccgtccccgccgggctcgtcaccgcgggggaacttccacccgatgcgccgcgtgatcggagccttcgctaccgcggcggccatcgcgtcagcatcggcgccgggcgggttgaagaagccctggaacatcgagatgcggagctcgccctcaccgtcttcgccgatggtgtccgcgacgatgccgcgccccttggcggtggggtaccgagctcgaattcgtaa

SEQ ID NO: 16533 - DNA, 231 bp, Glycine max
  Peptide Sequence Number=SeqID_108218
atgcagtcccagatgcagtcacaaatgcaatcacagggactcacactacctcctaaggctaaggttggtccttctgctgctcgtgtcagcacaaaggacatctatgggttgtatgtcgatgacagttcttctcgactgtttgctcttagaagagcttatgaggagtcgattactgtccacaatgttgctttgggcaatgatcaagtgaaggtcggtattgaggaagtctga

SEQ ID NO: 16534 - DNA, 120 bp, Glycine max
  Peptide Sequence Number=SeqID_108219
atggaagagacggaccacaaaaatgaagaagaaagaaagcaaacggaggaggaagctcaagttggtgaggacatgacggaagaaggttggagaagaaggcacgtggagcaaccaatagag

SEQ ID NO: 16535 - DNA, 271 bp, Glycine max
  Peptide Sequence Number=SeqID_108220
caacaccgatgtgttgaccgatcatgtaggatttatgttggtagatctaaagaaactcgcttaccagaatgaccttttcatgatggcaaaacaagctaaacaggggaaaacaattggtgttaatgttgaagatgatgattcatacattgatacttatgttagtcctttgtcaacacaaatttcgcctaacgtcatcggagaagaagaagctaacgacattcatgctaatggtaatgatcatgatgaaggagaattaattaacatcgtctaa

SEQ ID NO: 16536 - DNA, 165 bp, Glycine max
  Peptide Sequence Number=SeqID_108221
atgaaccacaaaggaatcctctcctttgtgttcaatgattacaaccaagaagttatgcccacttcttgcaatgaacccaatagcgtgttcaaccaagaagaccttctcttgaaaacaatcaccatgagtaggtctcttgaaaagctttttgtaagaatggaggag

SEQ ID NO: 16537 - DNA, 429 bp, Glycine max
  Peptide Sequence Number=SeqID_108222
gatgcatcttctaaggctaccatccctggagcttttgatatttcaggtgcaggggtagagatgagacgtgatgaggttgttcttctagagccaattgtgccagttatacatgagagtgctgaagcaggtgagtcacagttgaggttggaggctgctactcctgagaggacatcacagaccccagaaggtccactctcactagggatggacctatcttttgctcagcaggtaacagatcctcctacaccagtacaggagagacaggtggatcctcctacacctatcatggagatgccagaagaccctactacactagtcctacgactatcatccactcctccagctaccccagttttacatctgacagatgaggaggatatgcaggaccaggacacacagggcacgcaggaccagccacaagaattctaa

SEQ ID NO: 16538 - DNA, 357 bp, Glycine max
  Peptide Sequence Number=SeqID_108223
gggtacatcctttgtggtacaagtagagggtacatctacttgggtttgactgagaacaagagagggtacatctcttgtggatcagttctagtggagggtacatccactaggttcaaagagaacaagggagggttgctcaaagatcatgatgaagaccaagtcaacttgtgtctcatgacaaaatctgatgagaataacaaagaagattctgtaaggaagaaatggtacatagacagtggatgttccaagcatatgacgggtgatgtatccaaattcacaactatttcccccaagaaaagtggacatgttacatacggagacaacaacaagggtaaaattattggagtcggtaaatag

SEQ ID NO: 16539 - DNA, 384 bp, Glycine max
  Peptide Sequence Number=SeqID_108224
atggagaaaggtgctgaagctacaaaacccataattgaagccttaaaaagtaaaggtgtttcagctattgcagctgttggtttttgttggggtggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 16540 - DNA, 283 bp, Glycine max
  Peptide Sequence Number=SeqID_108225
atggacatagactatgctataaggaaagacgaaccacttgtaatcactgatgaaagtatcccagttgacgttgcgctatatgagcgatgggagcgatccaaccggctcagcgtgatgttcattaagaccaaaatctcggctgggatacgtggttttgttgaccaacatgaaaaggtccgagacttgcttaagaccattgatgatcagttcatcacttcagataagactttagcaagcactttgatcatgaagttctgttctcttcggctcaccaatgtgaaag

SEQ ID NO: 16541 - DNA, 180 bp, Glycine max
  misc_feature (48)..(48): n is a, c, g, or t
  Peptide Sequence Number=SeqID_108226
atgagaaagcgccacgcttcccgaagggagaaaaggcggacagggggncggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 16542 - DNA, 834 bp, Glycine max
  Peptide Sequence Number=SeqID_108227
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctgatgaagatgttccaacatcttccaccccgaatgtttctgtgcctgatgtcaagaaagatgttccaacatcctccgctccaaatgctgaagtactctcttcccccagcaaagagagatcaacagaggaagatgatcaagcgacaaaggagacccctgcaccaagggcaccagaacctgctccaggtgacctcattgacctggaagaagtagaatctgatgaggaacccattgccaacaggttggcacctggcgttgcagaacgattacaaagccgaaaagggaaaactcccatcaagaggtctggacgaatcaagactatggcccagaagaagagcactccaatcactcctaccacatccagaaggagcaaggttacaatcccctccaagaagaggaaagaaatttcctcatccgattctgatgaggatgtcgaactagatgtctcgacatctaagagggccaagaaatctgggaagaaggtgcctgaaaaggttcctgatgcaccattggacaacatctctttccactccattggcaatgttgaaaagtggaaatatgtgtatcaacgcagacttgcggttgaaagagaactgggaagaactgccttggattgcaaggagatcatggacctcatcaaggctgctggactactgaagacagtcaccaagttgggagactgttatgaaggccta

SEQ ID NO: 16543 - DNA, 195 bp, Glycine max
  Peptide Sequence Number=SeqID_108228
atgttgattgatgttggaaatgctttggcatgtgcatgttgtgtatgttcgtggagggcgaagtgcactgaccttccagggtctttggcacttgctttgggccatgttcatacgttggatattgttgtatgttcatggggggtaagtgcactgaccttgtcggatggcccagacgtgggtgacaagcgtggttaa

SEQ ID NO: 16544 - DNA, 441 bp, Glycine max
  Peptide Sequence Number=SeqID_108229
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccatcaaggatgagtctgattcttgctttcactataggtcggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 16545 - DNA, 798 bp, Glycine max
  misc_feature (97)..(97): n is a, c, g, or t
  Peptide Sequence Number=SeqID_108230
gcgcaacgcaacggcgccgcgcagcataatctacagggcgatatcgaagcgctgccgctgccggatgcctgcttcgatctggcatggagtaacctgncggtgcagtggtgtgacgagctaagcgcggcaatcggcgagctgtaccgggtggtgcggcccggcggacgggtggcgttcaccacgttgctcgccggatcgctaccagagctcaatcaagcgtggcgggcggtcgatgaacatccccatgccaaccgttttctcagcgaaaaggcggtaagggcggcgctgagcggcctgcgcgccgaaggcgtcgtgcatcagattagcttaccgttcgccgatgcgctaagcgccatgcgctcgctaaagggcattggcgctacccacttacatcaggggcgggcgtctgcgccgcttagccgcggcaagctgcgcgaactgcagctcgcctggccgcaacagcagggccagtgcccgctgacgtatcatctttttacaggagcggcgaatcagctgggatttaacaccgcgggctataaaccggtggcttccgggagcgacctgaccgcacaagggttacgcaatgaagatgcgctggccctgcagcgtaatagccgggtggcgctgcgctatgaacaggttaacccttatacttttgccgagccgacctcgccgcatattattagcgccgatgaagggcgaccgattgccgcgacgacgctttccagcggtttacgcgaactggagcgcctggccgactgggtgctggtggaagggtcgaaccgggggatcctctag

SEQ ID NO: 16546 - DNA, 406 bp, Glycine max
  Peptide Sequence Number=SeqID_108231
ggaagaagcacagattggtgctgatcgttctagtgcaacctctaataaagctgagatttataacgaggaagcacataatgcagcacaaaagcataaaccaaagagggtgaagagtgttaatgctgatgcagaagcttttgctgaagcactagaacatacaaagaaaagagatacaggccatcaaagtgtgtcattggagaataagacaggagattcaactgtgctaaagataggagattcagctaaagttgtgataaaacaagacatgaagggaagaaagcataaatatgggtttaacaacaataaacgtgagaagacagagaagaaaagggtggtggatgatgaaactggtgacaaacatgagctgtatgaagtcctaagaataccatctaaaacaaaaaactga

SEQ ID NO: 16547 - DNA, 375 bp, Glycine max
  Peptide Sequence Number=SeqID_108232
atgacattaacctataagaataggagtatcacgaggccctttcgtctcgcgcgtatcggtgatgacgcggatgccgggagcagacaagcccgtcagggcgcgtcagcgggtcttgtcgggtgtcggggctggcttaactatgcggcatcagagcagattgtactgagagtgcaccatatgcggtgtgaaataccgcacagatgcgtaaggagaaaataccgcatcaggcgccattcgccattcaggatgcgcaactgttgggaagggcgatcggtgcgggcctcttcgctattacgccagcatggcgaaagggggatgtgctgcaaggcgattaagttgggtaacgccagggttttcccagtcacgacgttgtaa

SEQ ID NO: 16548 - DNA, 648 bp, Glycine max
  Peptide Sequence Number=SeqID_108233
atggctacctcaccaaaagaaactgcagcttctggttcacccgcagtaccatcatctccgcaccaggaacaacctgaattcaacatccaacccatccaaataattcctggtcaagcttctgtccctgagaaactggttcccagaagacaacagggagtgaagattgctgaaaaccctagccttgcaacaagtcttagggaagtagacacggagatggacaagaaaatccgcagtattgtgagtagcattttgaaagatgcttctgtgcctgatgctgagaaagatgttccaacatcgtccaacccaaatgtttctgtgcctgatgtcaagaaagatgttccaacatcctccgcgccaaatactgaagccctcccttcacccagtgaagaggaatcaacagaagaagaggatcaagcctcagaggagactcctgcaccacgggcaccagaaactgctccaggtgacctcattgacctggaagaagtcgaatctgatgaagaacccattgccaacaggttggcacctggcattgcagaaaggttacaaggcagaaagggaaaaaacccccttaagaggtctggacgaatcaagactatggcacagaagaagagtactccaatcactcctgccacatccagaagaagcaag

SEQ ID NO: 16549 - DNA, 681 bp, Glycine max
  Peptide Sequence Number=SeqID_108234
atgtggatggatcggtttgctcttaccttgaacgggagtcaggaacttccccgattattagccaaggccaaggcgatggcggacacttactccgcccccgaagaaattcatgggcttctcggctattggaaaaacaccataactaaacgcgccacaaggcatccctatcgcaccagatccaaatctagaacgatgggtgatcaagaggagacacaggaacagatgaaagccgacatgtcggctctgaaagaacagatggcttccatgatggaggccatgttaggaatgaggcagctcatggagaaaaacgtggccaccgctgccgctgtcagttcggctgccgaagcagacccaactctctcggcaaccgcgcaccatcctccctcaaacatagtaggacggggaagggacacactggggcacgatggcaaccctcatctgggatacaaccgagcggcttacccttatggattgtcgcccaactactcaccacctgttctgcaagacgatgcgggccatattgcttctcccgtccttgaaagagagcctccccaacagcccgatgaggtccacgaagaccctcaagactatgctcgcagggatgtcgagttctatcccccatccccgaatggccggcacccagcacgttgcctcagcccaacatcacgacacaaccaatag

SEQ ID NO: 16550 - DNA, 258 bp, Glycine max
  Peptide Sequence Number=SeqID_108235
atgacattagggatcgcgcctgctagacacccattggacccgaagaagtccaacagggtcttggagttgccaagctctaattacgggcctttgtcagttctacggagtgcctgtctacccccagcaaagtcatcaggccccctactaatcgagctttcatcaagaagtactgcttccccaggcaggcgcaaggcgaaacaccacagcagcctgaggatggccgacagcgggcaacagacgcaccgccatcacctctag

SEQ ID NO: 16551 - DNA, 458 bp, Glycine max
  Peptide Sequence Number=SeqID_108236
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccaaattgtggatgtaactgtttcgaagcaaagggccagagtcagaactacgagtcgaagtctgataaagcacgtggagattggcttttacattttgcaccattggaggtgggtgatggcactatggaaaagtcacaacctcggaccattggagtcgggaaacctgtcgtgccagctgcattaatgaatcggccaacgcgcggggagaggcggtttgcgtattgggcgctcttccgcttcctcgctcactga

SEQ ID NO: 16552 - DNA, 270 bp, Glycine max
  Peptide Sequence Number=SeqID_108237
atggaggcttggaataggttgtgtgatatattccaagataacaaacactttcgtgccgttacacttgagtatgatttcacccacacaaccatggaggctttttcaagtgtctttgcttactgtcaacatctcaagtcactgtcagatcaactcaagaacgtcggctttccggtcgataacagcaggttggttctacaattggtgtccggtctcactaaaccctacaagggagtggtcacactcatttgtcaaagtgatcccttgccttag

SEQ ID NO: 16553 - DNA, 406 bp, Glycine max
  Peptide Sequence Number=SeqID_108238
gtcgactctagaggatcccgatctccttctagaagcttcattgcctaacaagccaacttacaacagcaagccccaagagactcagcataaggatgcacaggtcaaagttgagtatgagaaaagattgtatgaccaagtgaaggtgcaaattgcaaagaagaatgaaagctatgccaagcaagccaacaagaaaaggaaggaagtgacttatcaaggtaatccttctggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaaccttcgtagcctgtatcaaatga

SEQ ID NO: 16554 - DNA, 49 bp, Glycine max
  Peptide Sequence Number=SeqID_108239
atgactgaacatggtgattatattgacttgctcttggttgtttatgatt

SEQ ID NO: 16555 - DNA, 207 bp, Glycine max
  Peptide Sequence Number=SeqID_108240
atgtggtttgaaatctcgaggcattacaattacattaactgtaatgttgaggccatgcgaaatgttgagaacaaagctaatgcggttatcgtacgcatgtgggtgaataatgtgcacgaaaatgtcattggttcacgtgcattagaatctcgatgcgtgacagtaccacagttgatgttaacgtgctttggaatctcgacgccttag

SEQ ID NO: 16556 - DNA, 429 bp, Glycine max
  Peptide Sequence Number=SeqID_108241
atgtcagccagtgatcatgccattctgagggacagaacccatcaacccacaaagaagagcctgttggagctaacatcacacgatgctttgttggcacaaaacttgctatctaagcaacttgagatcctaacggaaacacttggttataccatgcgtggtgaagctcatgagataggccaatgcatctcaattgaagaaaacactcaagaaattcatttcatggggaatcagcagaggcaagggtatactcaaggaggattttcaggcttccagcaaggtccttataatcagcaagggcagtggaggacacaccctagcaaccagctcaataaagaccagggtggatcctcaaacaggccaattcaacaagggcctaacatctttcagaggatgactaagttggaagagaccttgactcagtttatgcaa

SEQ ID NO: 16557 - DNA, 465 bp, Glycine max
  Peptide Sequence Number=SeqID_108242
atggcttctatcacggaggccatgctaaaactccagaaaactctagaggataatgccacggcaaccgcctccaatgcagttagggaagcagaaccagtgcttcagcccacgataaacttaggccgggttagaaacccgacggtgttcgatcggaggtacagtccgcaagcttatccttatggcttgcctccggacttcactccccgtgacgctccagaagatggtgttacagttgaggctccaactcccactccagaggcatcatattctagctcaaaagttttagaaaagtcaggaagagctagaacaggtgccttagtaagcttttcttttagcaaagctgacgcaatcctcccaaggaaaggaccagtcactagagccatgagtaagaggctccaagaggattgggctagagctgttgaagaagaccttagggttctcatgagcctcagggtagatttctga

SEQ ID NO: 16558 - DNA, 345 bp, Glycine max
  Peptide Sequence Number=SeqID_108243
atgactagaggcaatccctctgacttacaaccctttgatcctgagatagataggacatttcatagattagttaagcatcattttataccttttgagcctcctgattttgagcattataattttgaacattctgattttgaacattctgagaacatggcacaacctccaccccgtgagaggactctaagggaaatggatgcacctgatttcacctacgaaagcttgtgcatccaataccctgataaggatgtcccatatgttcttaaaattggactgatccatttgcttccaaagtttcttggccttgcagaagtaggaatagtgggggcaagatatgcgggttag

SEQ ID NO: 16559 - DNA, 474 bp, Glycine max
  Peptide Sequence Number=SeqID_108244
atggtctcccgcgactctcgtcaaccgagaggagcgaaattagtgtcatacactgattttcggggacctttgcttgatgacatgcgaccattctttggtccttgtgaggtgcttggcacccatcattgggcaatttgtgaaattttgggaacaacaagtcatttgcatgtggagattttatggtcacccgcgactctcgccaaatcgagaggagcgaaattagtgtcttatctttactttccttttatctccaataaaagacaagtaaagaggggcaactgtcataccctaatttcgtccggggacctttgctcgatgacgtgcgaccattctttggtcctcgtgaggtgcttggcacccatcattaggcaattggtgaatttcagacatgccggaaaccaaaaaatattgatgcacatccgtaagtttcctgacacaccggaatcaaatggaagcgtcttgcataataagtga

SEQ ID NO: 16560 - DNA, 526 bp, Glycine max
  Peptide Sequence Number=SeqID_108245
atggggacaaatcaaatcggaaaaagattctatcaagtcaagattaagggcctagatgtcacaagccttaaggagttgggacggttgatgggacccctccaaaggcaagccttccgcaaagtgtatggaaagattttagatttgaccacaacggaggtatttacgaaagtcgttgtatcctttgcccaatactatgaccagccattgagatgcttcacgtttggggacttccagatagtaccgactattgaagaatttgaggagattctaggatgccctcttgggggaagaaaaccgtatcttttctctgggtttcttccctccttgagcaagattgcagctgtggtcggagatttggcgagagagttggatcgtatgaagcaaactcgaaacggcgtagtaggcctaccgcgaaaatacttggaaggcaaggcaagggatatggcgaatcaagaggagtgggtcccgtttgcggatatactagctttgctaatctttggggttgtcctctttccaaacgtggacg

SEQ ID NO: 16561 - DNA, 323 bp, Glycine max
  Peptide Sequence Number=SeqID_108246
ggcaatgcattgctcgatcgaatgccccggagtacctccgtgatacgcataggtcacgtcggggttgtaccacctcgagaaaagagattggtagattcttccaagggtcaccaccaccaactgggtacatctacttgggttgttatactgagaacaagagagggtacatctcttgtggatcagttcaagtggagggtacatccacttggttgttcaaagagaacaagggagggtacatcccttgtgaatctttgtcttgtaaaggattttacaaggttgaaagaaatctcaagaaccattggttgcttggggactggatctag

SEQ ID NO: 16562 - DNA, 799 bp, Glycine max
  Peptide Sequence Number=SeqID_108247
gtcaggtttggtgaagattgatgctgatagtctcaacacattcttggagacgcctatggtattagctaaaggggagaccttacccgcttactccagatattgcagattgcctacagactacagagagaaaaaggttgccttatgcatacctggccgaggtgtcctctcatactccaacttggcccccacatcacacacgtctgacttgacagtggatagagctaggctgatctttggcctagtctctcacttggatatgaacatacgggtgctgatttcttgccaaatgacctctatagcccagtctaacacttatagacttaggttccctactctaatcactgcattatgtagagccagaggggttgtctatgatagcctcacttttgaggcgagggcgagggcaaggccagctgagcttccttctacttctatagctcctactccagcatccacttcagcaggcccttttgtcccaatggtggcacctctagactctattctttcagtagagcagtttaatgagatcgtagcctggtccgggacccaaccttctcttcacaaggaagacgaaggtcccacagcccaagtgagacaggtagctgctgccacacctgagcgatcccttgaggctacttcagagccttctgcacaaggggaggatataccctcacctcagcctgcagcagacccctccactcctcttttagagatgccacaggacccgactacatcattcctggctatggacacttctcctccagctactctagtattgcatctgacagatgaggaggat

SEQ ID NO: 16563 - DNA, 123 bp, Glycine max
  Peptide Sequence Number=SeqID_108248
atggggtgttacatgatccacatggtcaacatcctcggcaatagctacagttacccgttttttgtgtcgatgttgtcagccttcgacgatgagaggcttcttcctcatcaccatgtattttaa

SEQ ID NO: 16564 - DNA, 738 bp, Glycine max
  Peptide Sequence Number=SeqID_108249
atgactaggggcaatccaggtgatttacaaccctttgatcctgaaatagatataacctttcatagattagttaggcataatgtgcatcctggtcattctgtgcattttgagcattttgagcatcctgatcattttgagcattctgttgctggtgattctgaatattctgattttgagcattcggctattaattttcatactgagaacatgactcaacctccacctcgtgagagaactcttagggagatggctgcacctgatttcacttatgaaagcttgtgcattcaatatcctgatgagggtgttccatatgttctcaagactggactaatacatttcctgcccaagtttcatggtcttgcaggtgaagatcctcataagcatcttaaggagttccatattgtttgttccaccatgaagccccctgatgtccaggaagatcatatctttttaaaggcttttcctcattctctggagggagtggcaaaagattggctatactacctccctcccttccagaatgctgctggtccaagcaagccatatgttcctcctccaatacagcaacatcaacaacaaagacaacaagcaactgaggcccctcctcaaccttccttagaagagttaaatccgaaaaatgtgagtgccattaccttgaggtctggcaagcaaattgaagtgcctccaccagtagtaacacctgcacctgaacctgtcaagcttcattctacaccttaa

SEQ ID NO: 16565 - DNA, 240 bp, Glycine max
  Peptide Sequence Number=SeqID_108250
atgatgacaaaggggatgacaaaaagctcaaagatcaatcaaagaacaactcaagtaaatcaaagatcaatcaagaaaaattcaagagttcaagataagaatcaagaagaattcaagactcaagaagaaagtctagagacaagaatcaagattcaaggttcaagatctcaagaatcaggatcaagattcaagactcaagattcaagaatgaagagaagactcaatcaagataagtattaa

SEQ ID NO: 16566 - DNA, 201 bp, Glycine max
  Peptide Sequence Number=SeqID_108251
atggcggactgggtaacaggtaaagtcacaaaaatacagttctggaccgatgcgctatttagtctcaccctgcatgctcccgtccacccgtttaaagccgggcaatttgcgaagctggggctggatgtcgacggcgagcgcgtacagcgcgcctactcatacgttaacgcccctgataacccggacctcgagttttatctg

SEQ ID NO: 16567 - DNA, 734 bp, Glycine max
  misc_feature (454)..(454): n is a, c, g, or t
  Peptide Sequence Number=SeqID_108252
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccgaggttcaatggctatgatcaaaatggtatacctgcaaatgccagggttaatgtcacggtcaattgttcttgtgggaacagccaggtttcaaaagattatgggatgtttattacctatccactcaggcctgggaataatttgcatgatattgccaatgaggctcgtcttgatgcacagttgctgcagcgttacaatcctggtgtcaatttcagcaaaggctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaagtcgttcgctccaagctgggctgtgtgcacgaaccccccgttcaggccgagcgctgcgccttatccg

SEQ ID NO: 16568 - DNA, 279 bp, Glycine max
  Peptide Sequence Number=SeqID_108253
atggttttcgaaagtgatccaccttcccctagatccgctaagctaatggcttcattggctaagcaaatggataagttgcaaagaaatgttgagagaaggatgggagagagatttgatgagataagaagaagcactcaagagttgagtgggagaatggaagacatagagaggagaggaggcatcgtaggtcaccttattcttctcaaggaagtgatgatggctatgaagaaggtagaaggcatagacataggaggaatagggatgaaatggatgatgtga

SEQ ID NO: 16569 - DNA, 431 bp, Glycine max
  Peptide Sequence Number=SeqID_108254
acgtccggaaagagtgtgctgggttacgagaagaaaatgcagctaccgcaagagcccttgaacaagaaaccaagagggctcgcaaggaagagcgtggccgtgacaaatttcatggagctttgtgggagaccaacatgttagccatcgtcagcaagtaccaagaagaactaaatctagccatgacccacgagcataaagtggtggacgagtatgccaaagtgtacgcggaaatgtctgggcgctcctccactcaccaatttcctagtcgaaaaccaggagggcatggtcgtaccaaatccgacccactcggagaatcatctttgcatatcgcaacgacttggccttcgtgtcctagacccgcgcttataaagctcctactgatgtggcagggcaggcgcccttcgacttctcatcccaatcgcgagccttga

SEQ ID NO: 16570 - DNA, 135 bp, Glycine max
  Peptide Sequence Number=SeqID_108255
atgaggacgcgtagccctctaaaggcgagggcgtgcaaccctctgcaggcgaggatgtgcagtcctctgatggcgaggacatatagtcctctaaaggtgatagacgcatgcaaccttggtcgtgaaatttggtaa

SEQ ID NO: 16571 - DNA, 447 bp, Glycine max
  Peptide Sequence Number=SeqID_108256
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaaggaacccaaaagattctttagaactcactagtgttcaagagcttcttgacaagatcaatagcaactgtgaccctgtcgggaaacctgtcgtgccagctgcattaatgaatcggccaacgcgcggggagaggcggtttgcgtattgggcgctcttccgcttcctcgctcactga

SEQ ID NO: 16572 - DNA, 390 bp, Glycine max
  Peptide Sequence Number=SeqID_108257
atggccaagtttgatccagaaatagtccttgagttttatgccaatgcttggccaacagaggagggcgtgcgtgacatgagatcctgggtaaggagtcagtggatcccgtttgatgccgacgctatcggccaactcctaggatatccgttggtgttggaagagggccaggaatgtgagtatggccagaggaggaaccggtctgatgggttcgatgagaaggccatcgcccagctactatgcataccggggcaggattttgcccggactgctgcaaggaggcgagtgcgaatcatgcgcaccaacttgaccaccctgacccagattcatgttttctttcatatttcttttgtcatttttattctatgttattgttttgacttgagagactaa

SEQ ID NO: 16573 - DNA, 606 bp, Glycine max
  misc_feature (56)..(56): n is a, c, g, or t
  Peptide Sequence Number=SeqID_108258
atgacatatcttgtcagtgcggaagatggcataaatctccgcgtgtcaactagctngtcgccgcgattgacgaaggtcacagaagacgacgttagtctctacgtgctatcaggcttttcatcttacagacagcaaaaagtttatacgataaccactcgggtatttccgcctgtcagcgtgactcaaaaacagcaaaaagtttatacggataaccactcgggtatttccgcccgtcagtgtgactctaaagtcagtatgacagatcttgtgagcgcggatgatgacgtaaatctccgctgtgtcaacgggctttgtcggccgcgattgacgaagggcgcagaagacgacgttagtctctgcgtgctatcaggcttttcgtcttacagacagcaaaaactttatacggataaccaatcgggtatttccgcccgtcagcgtgtctcaaaatttagtatgacaaatcttgtgagcgcggaagatgacgtaaatctccccgtgttaacgggcttgtcagccgcgattgacgaaggtcgcagaagacaaagtttgtctctgcgtgttattaggcttttcgtcttacagacagcaaaaagtttatacggataa

SEQ ID NO: 16574 - DNA, 501 bp, Glycine max
  Peptide Sequence Number=SeqID_108259
gctgaaatgaccgcctctgaggaggacttgattttgatgtgggctttccttaccggtcgtcagatcgactgggctcacttggttaggtaccgaatgcataaggcattacgggccaatgcgcctctcccttatcctcaattggtcactctgtttctccgtcattttcaaattcctcttgatgatgaaccttttgttcaagtcaagcattcctttactataggtgttggtgttgtaacttcatttggttaccgtaaagatcatgatggacgcgtacctcaacaagacgagcgtactccttctcctcctcctcaacaagatgattcctcagcccttatgaatgaagttcttttagagttacgaggcctccacacatatgttggtgaacgattcgattccttggacggtcgctttgaaggcatggatacccgtatcacccagcttgaagaagatgtgacttatcttcatcggtgcttcgatcttccaccaccttctaagtcttag

SEQ ID NO: 16575 - DNA, 533 bp, Glycine max
  Peptide Sequence Number=SeqID_108260
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccatagctgcacagaacattcactggttgtcatagatgagcttgggagaggtacaagtacacatgatggtatggccattgctcatgcgacgttgtattatcttctgaagcaaaaaagaagcatggtcctctttgtcacacactatcccaagatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 16576 - DNA, 498 bp, Glycine max
  Peptide Sequence Number=SeqID_108261
atgacgtttctattttcgtccaactttttttcccggattgctcctgtttgccactgtttgcaaaaccaaaaagccatgtctcggaaagaaaatctgatatgtgagttacacaccagaaaaggaacatggaaaatagttgtctgtatcactgatgtttggcaagctcgaaagcaaaatagtaaacatacaattgagatggtgttgatggaccaaacgggttcaaaaattggggctactctctggcaagaactgttcactgaattgcgggacgagttacagtgtggttcttcgtatttgattcagaacctgaggattgttgacaaccaatctgaatacagagtcagcctagttccatatttggtttatttcctaaaatctacatctgtcaaggaaatccaccgtccagaaattccttttaatatttatctcattgctccttttactgatataatctctggcctcgcaccccgccatactttagtgggtcagtttgtttag

SEQ ID NO: 16577 - DNA, 636 bp, Glycine max
  Peptide Sequence Number=SeqID_108262
atggccccgaggaaacttgcctcaaagagatccaggaaggataaagcggccgaaggaaccagttccgctcccgagtatgacagtcaccgctttaggagcgctgaacaccagcagcgcttcgaggccatcaagggatggtcatttctccgggagcgacgcgtccagctcagggacgacgagtataccgatttccaggaggagatagttcgccggcggtgggcatcactggttacccccatggccaagttcgatctagacatagtcctcgaattttatgccaatgcttggcctacagaggagggcgtgcgagatatgaggtcctgggtgaggggtcagtggatctcgtttgatgcagatgctatcagccagttcctgggataccctttagtgctggaagagggccaggagtgcgagtatggccagaggaggaaccggtccgatgggttcgatgaggaggtcatcgcccatttgctatgtataccggggcaggattttgccaggactgctgccgggagacgggtgcggatcatgcgcaccaacatgaccaccctgactcagatctggatgactttgctgctcagcaacatccagcccagtgatcataattccgacctccccctgccgaagtgtcagctg

SEQ ID NO: 16578 - DNA, 288 bp, Glycine max
  Peptide Sequence Number=SeqID_108263
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctcgccggtcagccatacggcggtgaatcattcccgggccttatacacaccgcccgtcacactatgggagctggcaaaggaaggaataggtataattga

SEQ ID NO: 16579 - DNA, 78 bp, Glycine max
  Peptide Sequence Number=SeqID_108264
atgggtgattttgcgaagattttcaaccgttcttcgtcgttcgtcgttcgttcttcgtcgttcttcggtcttcaacca

SEQ ID NO: 16580 - DNA, 549 bp, Glycine max
  Peptide Sequence Number=SeqID_108265
ttgagattgcctgctatcagacaaccattgatattgcaatttaaagctgccttccattgtgacaagtatgatgggaaaacctacgaaattcaagtcagacaacacaaaggcaaactttactttgctgatggcctaacaagattgaggacagaactgcagatttatgaatctgtcacgataaatttcctggcctacgaccacccctcaaaatttgacctccacttcactccaccattagaccagcagaaatgcaaaaggcgccgtgcaacaagaaaacacatctggacatatgaaatcacccaatcaatgctaggcgcaccatatccactgcaactttcagcctctgtcacacaatgcctaatccactgtggtgatcatatgacaattctcagaagattcggacctccactgcaatggaatgtagttgtgcttgacaaaggcatcggtgataagtatgtcactctcccttggtataaattccttcaagaaggtgattttagccatggagacgagctctcattctactataggcgtgctgagaagatctag

SEQ ID NO: 16581 - DNA, 111 bp, Glycine max
  Peptide Sequence Number=SeqID_108266
atgttgcctaacatcgtcgaagaagaagaagctgacgatgttcatgctaatcttgccatctaccttgaagcagacaagaaaagccacacggctaagatcattggcgactag

SEQ ID NO: 16582 - DNA, 416 bp, Glycine max
  Peptide Sequence Number=SeqID_108267
gagtacatgagctcagttgaaggtgggcaactggggatgagtggtacctggagatatgtcgcgggggtcaagagaccttggggacgtcaggcgagctcctggcagtcaaccaataaaagaacaaagaccacaaagcaaggaggcttgtgtggcggctggccagctattattcttgagtggtatctggaattggcctctagaaatcgattaccaagggatgttaagatggcctctggtaatcgattaccaatgggagataggacactggtaatcgattaccttttaggtgtaatcgattacacagtggaatttgtaggtttctatgtgcagaagttgtgtaactcgagtttgagcactggtaatcgattaccagagaggaaatcccttgagaaggatattttgactatgcgtagccg

SEQ ID NO: 16583 - DNA, 127 bp, Glycine max
  Peptide Sequence Number=SeqID_108268
atgctacaactacagtgcctaataaaagccaagggaagattagggacacctacctcgaacggaaatggtgtccaaccgaaagaagccgcaggtgggctcgcggtggaggagaaggctcgcggaagag

SEQ ID NO: 16584 - DNA, 333 bp, Glycine max
  Peptide Sequence Number=SeqID_108269
atggctgcaagtgacattgctattctcaaagatagagcccacgtaccaacaaagaaaagtcttctggaacttacatcgcaagatgctttgttggcacagaacaagttgcacggtgtgccatctgtggtggagctcacaattttggctgctatatccccaatgaagaaccagctcatgaaagaccagggtggtccatctacaaggccacaacagcagatgcctagtctctatgaccgaaccacgaagctggaagaaactctagctcaattcatgcaagtgttaatgtctaatcagaagagcacagagtctgctatcaagaatctggaagtctag

SEQ ID NO: 16585 - DNA, 162 bp, Glycine max
  Peptide Sequence Number=SeqID_108270
atgggtgccaagcacctcacgaggaccaaagaatggtcgcacgtcatcgagcaaaggtccccggacgaaattaggggctttaaggataaccctgtttgttgcctccaactgaccattggtctaggggtgtttgatagaagttacgagatgcttgaaacctag

SEQ ID NO: 16586 - DNA, 731 bp, Glycine max
  Peptide Sequence Number=SeqID_108271
atgggatcgaatcaagcacccttgtttaagaaaaggttctatcatgtcaaaattaaaagcctagaggttgccagtttgcaagaattggggcaattgatggatcagctccaacgtcaagctttccgcaagagatatggaaagatatgggatctggctatgatagatgtctctattgaagccatggcatccctcactcagtattacgatcagccactaagatgcttcacgtttggggactttcagttagtaccgaccgtagaagagtttgaagagatcttgggatgtccactaggaggaataaagccatatcttttttcttggttctatccctccatggcgagaatatccaaggaagcacttggaggagatagcgaaggctttggcggatcaagtttggcaggatgtgaccttcgcttgagaacttcgaggtacttgacacccatcgttaggcaatccgtgaagttccgcgacatgtcaggagtcgaaagaagcattaatgcacaatccataaagttccgtaacattccagaagccaaggaggcgacgaaggcggtgccttctggtgagagcaagccagctcgcctgggcgagctaggcgggaacctcctccccctttttcctataaataggcgaaaggggccgagatgtttccgtgagcaaatccgtgaaggtttttcgtcgttcttcaccgttcttcatccgttcttcgttcgttcttcgttcttcaacgg

SEQ ID NO: 16587 - DNA, 423 bp, Glycine max
  Peptide Sequence Number=SeqID_108272
atggtggagggacttggcagcacaagtggtacccccatggtggaaagggagatgataacaatgattgtagaaacgctgccggttttctactatgaaaagttggtgggctacatgccctatagcttcgcaaatttagtatttgcgggcaagaggatcgaagtaggcttgaaaagagggaagttcgattatgtcgctcctgctggcatgaacaataggagattcaaggcaagtggggcaaagaagaaggaaggagatgcccacaccgtgactcagctcctacttggccgaagccctaacaaacccctcacaacacttccaatatgcccaacatcaaccaagctttttagcccacatcgaaaactcttccaatccggtgcccgtctagcaaagggcacccgctcaaccaccaagggcccccactaa

SEQ ID NO: 16588 - DNA, 669 bp, Glycine max
  Peptide Sequence Number=SeqID_108273
atggctccgaataagcttccagccaagaggtcaaggaaagataccattggagagggttccagtgcggccccacaggtagatgtggagtttgatggaaacaggttctggagtgaggaacagcagcaatgctttgaggccattaaaggctggtcattcctcaaagagagaagagtccagccgagggacggagagtatgccgagtttcaagaggaaattgcccggaggcaatgggctcagcttgtatcacccatggctaagtacgatcctcagatagtcatggagttttatgccaacgcttggcccacgaaggagggagactttgcccagagtctagcggggagacgggtgcagatcatacgcaccaacatgaccaccctcacgcagatttggatgatgttgttgctcagcaacatcctccccagcgaccataattcagacctccccctgccgaagtgtcagctgattgcaaggatagtgcctcctagacacccagtggactcagagaagtccaatagggccttgaggttttctgctttgatcacgtgcctgtgccaattctatggagtgttggtcaaccccaccaagcttatccggcctcccatcagcaaagccttcattgagaaatattgcaagcccagggaggcacaacagcaggaggagggccagtag

SEQ ID NO: 16589 - DNA, 492 bp, Glycine max
  Peptide Sequence Number=SeqID_108274
atgcatagacctcctataggtaatttagttcctctgggcttggaaattgaagccactataagaaggaaccgagctgaaaggagaaggaaattgttgcaagacaggacaatagcttccattctagaagaagaagctcaatcctctcattctacatcatcttattcactatcatcaagcgaatccactacagatttaccagaagcctccgtcatggctgaagaacatcaacacagggttacccttgaagattactccagtagttctgtgccgcaattctttaaaagtattgcatggccaaaagtcctagcacataatataaactatcctcattctttgaatcatctgatacagggtaacctatttcatggattaccaaacgaggaccgctacacacacttagcaacatacatagagattcataacactgtaaagattgtaggagtgccagatgatgccatcagactcagtttattttcattttctttggcatga

SEQ ID NO: 16590 - DNA, 324 bp, Glycine max
  Peptide Sequence Number=SeqID_108275
actacggaggagcgatggagacagtttaagtttgatttgacatcaaaatgggcacttgcagctgacaaggacagtgtcgatgacactgtatgcgaaaagtacaacattagcaaagagaagtggacccaattttgtcaaagtcgtagagaccattcgtgggaggccattcagaaacaaaatattgcccctcacctgttgtcacgtgggggttatgaatttctagaaaacaagttgatggaggagaagaaaaagaaacaactagaggaagctgctaaatctggaagcactgatatcgtcattgatccttcatctcccattagatga

SEQ ID NO: 16591 - DNA, 471 bp, Glycine max
  Peptide Sequence Number=SeqID_108276
gatgtacaatttgaggtggagctcatgaatctggatgttggacaatggaggaaccaccctgggaatcaattcaatagagaccaagggggatcatccataaggccacaaccacaagggcctagtctctatgattgcaccacaaagctagaagagactctagctcaatttatgcaggtttctatgtctaaccaaaagagcacagagtctgctataaagaatctggaggtccaagtgggacagctcgcaaaacatttggcggataggccgtcaagaagctttagtgctaacactgagaaaaatccaaaggaagaatgtaaagctgtcatgaaaaggagcagaatgacaaaccatgtggatgaaagaaaagctgagaagaagatggaggaacataaacaacagttggctgttaaactggcactggaaccggttgatgatttagttgaacttgaagaaattgttgaggaagcataa

SEQ ID NO: 16592 - DNA, 408 bp, Glycine max
  Peptide Sequence Number=SeqID_108277
ctaaagggtctgaatggggaagaaggagaagtgcccgaggagagtgaagaggtgcaagccttgaaggctgagctcaaaaagacaaaagtagcaaaggagaagctgaaggtggcagtcactagagttagaaaagaatgcgataagctgaaggatatcaacatgaccgccgctaaagcgctaaagcgggaaacaaagaaagccagaaaggaggagtggagtagagacaagtttcgaggggctttgttaggcaacaataatgatctcgaacttagaaaagccgaaaaagacaaatcaaggatggagaatgtgatgttaaaggataagttgaggaattgtcagaggtcaaagggaagtttgaaagagcagttgagcaagacggaagataatatgttgatagtcattgattag

SEQ ID NO: 16593 - DNA, 453 bp, Glycine max
  Peptide Sequence Number=SeqID_108278
atggagacgcttcagaaggtccgcaaggcatggggggtggtacaaaagaaggacaaagagcttagaggcagtgggccaattggtggctaccgtgagtggttggaagcccatgtgcaaggtttggattggctcccaagtttgagaaccgctaaaagggaggaagttgaggcaccggaggaagacgaagaggtgcaggctcttaggacagaactcgagcaagctcaaacagtcaaagaaaggttcaaatcagtgcctcttaggatccgaaaggagaatgccgaactgagggatgtaaatgtagctaccaccaaggctttggaacaagagaccaagagggctcgtagggaagagcacggccggaacaagttccgaggggctctgtggggtagtaataacgagcttaaactccgaagggaggaaagggaccaatcgcgggtagacaggatgagttga

SEQ ID NO: 16594 - DNA, 472 bp, Glycine max
  Peptide Sequence Number=SeqID_108279
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgagtaaagagggaggtggttgccgcccaactcgcccaggcgagcagggttgcttccaccagaaggcaccgtcttctgttggaacccctggaaggcccaatcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 16595 - DNA, 446 bp, Glycine max
  Peptide Sequence Number=SeqID_108280
ttaggccaccacttcaagaactctgtagcaccgcctacatacctcgctctgctaatccggttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 16596 - DNA, 355 bp, Glycine max
  Peptide Sequence Number=SeqID_108281
tggtcaaacggaggtctcatgccgacaaacaatggtccccgaacaaaattagggtatgacaggcatccattgatcttagaagagggacaacgatgcaagtacactgagagaagaagtcagttttcaggtttttatgaagaggccataggtcagctactttgctccccgggacatgattttgcactgagcgtagcaggaaggcagttggtctacaacatcatgacccaaatcaatgttcatgtggcacaacttatctcaaatgccatccaccagttcataggtgttgcacctccgagacacccagtggacccagagaagtccaacagggcattgggattttcgacattgatcacag

SEQ ID NO: 16597 - DNA, 177 bp, Glycine max
  Peptide Sequence Number=SeqID_108282
gaagtttgtgatgacattgctgagaggttggagccccatctgagtctaggggtggtcacgcctggctcatcgacacatggcgtgatcgaagaatgccttaagttggccaggagtgtgacacagaaccatcttgtatatgttaggtctagacgcaggcggcgcacggatcaggcgtag

SEQ ID NO: 16598 - DNA, 243 bp, Glycine max
  Peptide Sequence Number=SeqID_108283
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttatgcatggaaactggaaagggagtgaaaatggatgacgatgaacaatcaggatggacaacaaggaagacctag

SEQ ID NO: 16599 - DNA, 190 bp, Glycine max
  Peptide Sequence Number=SeqID_108284
cgcaaggccgaggggtcactcagggttgatgtttgattgtcagattgagaaacaaaagccacaagaaaaggggcaaaatggttattttctagaactttctagacctaaaacttgcccaggccagcatctagctcacctgggccatgggaaagcttcagccttaaataaccagctcgcctgggcaagctga

SEQ ID NO: 16600 - DNA, 325 bp, Glycine max
  Peptide Sequence Number=SeqID_108285
ttctacgaagtacctgtcacctccagaaagggcttcaaggacccctactaatcgagctttcatcaagaagtactgcgtctccaggcaggcgcagggcgaaacaccacagcagcctggggatggccagcagcgcgcaacggacgcaccgccatcacctctagagttcacctcagctcatccacaaaaaggtagcatgataccttggatatgcatgtgtcgcaacctacccttcggcgggagggcgacgcgtgactcgcgggatgcgtgttccacgaaaggaatacgcgcggagtcgccaccaacgttttatttgaggaaaacgtag

SEQ ID NO: 16601 - DNA, 708 bp, Glycine max
  Peptide Sequence Number=SeqID_108286
atggaggccatgaaagagcaaatggccacaatgatggaggccatgatgagcgtaaagaagataatggaagccaatgcggttgcaattgccgctaccagcattgttgctaaggtgaacccgacgtccccatccggcatcaaccaaatgaatcatccaacctcaaatatggtaggcaaagatttgggaagtatgggcggcccccattatgcgcaaagtcaaaacaagcatgccttcccaccatgtggcttgcctcctaactatacaccatccaatgtagcgtacacttccagtgagaatgtcaataactccactcccatactcattgagagccgacaaccccaaactgatcatgcacatgtctctcaacccatgggtaagacacatgaaatgccccaccacaatctagccgacttcgagccttgcctcggatatgccactgaagggcaggcaattggtggtatacccctacaaaaccctttggagggccctcggtatcacccacaactacacctcttgcattccacgacaagtaaaaaccctcatgctatggcaaaaatgggaaagctggatcatctagaggaaaggctcagggccattgaaggaggtgaagatcatgcctttgctaacctagaagagttgttcctagtacccgatatcatcacccctcccaagttcaaggtgctggacttgacgagtgggatcctctag

SEQ ID NO: 16602 - DNA, 521 bp, Glycine max
  Peptide Sequence Number=SeqID_108287
atgttctgtgtgcaatgtgaacaaaccatccgtaccccggcaggcaacggctgcgcgtatgctcagggcatgtgcggcaagacggcggaaacctccgatctgcaggatctgctggtggcggcgctgcagggcctctccgcctgggcgctgcaggcgcgttcgctgggcatcgtcgatcacgagatcgacagcttcgccccgcgcgccttcttctccaccctgaccaacgtcaacttcgactcccagcgcatcatcggctacgcgcgcgaaaccctgctgctgcgcgattcgctggctgcccgttgccggctgctggatgccggcgtgcgcgtcgatcacccgatggcggcgctgcagctggccggtgacgatatgcctgcgctgctgcaacaggcggcgcagtttgccctcaacggcgacaaggccgaggtcggcgacgacgtccacggtttgcgcatgctgtgcctgtacggcctgaaaggcgccgcggcctatatggaacacgcgcacgtgctcggcca

SEQ ID NO: 16603 - DNA, 573 bp, Glycine max
  Peptide Sequence Number=SeqID_108288
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcctcgttgcagcgttacaccaaggctctaacaaatttgcaaagggctcagctagtggagaagacaaggcaaaagccccaagttaggagacaagctttggaagatgcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccgggtaactatcgtcttgagtccaacccg

SEQ ID NO: 16604 - DNA, 492 bp, Glycine max
  Peptide Sequence Number=SeqID_108289
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccatggcaccctacgttgtcgagatttgcacacccaccccgcgccatcaagattcgtacaccttaaccccacgttgtcaagatccatgcaccccaccatgcattgccaagattcgttcacccaacctcaagtcgtcaagattggatcaaaaccatgggatcctctag

SEQ ID NO: 16605 - DNA, 114 bp, Glycine max
  Peptide Sequence Number=SeqID_108290
atggtgattttccaccatggagatgcagcggaagataaaggagaagaggtagcttccttgagaagctttcttgagaaaacttccttgagaagcttctttgaggggatcctctag

SEQ ID NO: 16606 - DNA, 267 bp, Glycine max
  Peptide Sequence Number=SeqID_108291
atggcttacactcacattccggattcaacaagcgattctcctcaaatttcagccagcccgtatcaattagacttcacactttatgcttcggggtcatacaatgctcaatggaatgccccagggctcctccacgataagcacacgttgcattcgagtcgtatcctcagaaaagtggaggttgatgaaccttggctagggttatggctaccattgaattatcaagtagatgtgggagcaagtcagcataggacactggaattggggtga

SEQ ID NO: 16607 - DNA, 357 bp, Glycine max
  Peptide Sequence Number=SeqID_108292
atgagttatgtcaccgaatcggacatcggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcactgaatggcgaatggcgcctgatgcggtattttctccttacgcatctgtgcggtatttcacaccatatggtgcactctcagtacaatctgctctgatgaaatgttatgaccattcgtatatgtcgagagttccgttgttcaacttctaa

SEQ ID NO: 16608 - DNA, 183 bp, Glycine max
  Peptide Sequence Number=SeqID_108293
gtccagagcaagcatcctttcccgccgtatggcctacctcctaactatgcaccacccaatgctgtacatgtgcccgagcagaacgtcgaccactccgctcccataccccttgagagccaacaacctcagtctgggcacgcacatgccgctcaacccatgggggagacacatgaggtaccctga

SEQ ID NO: 16609 - DNA, 534 bp, Glycine max
  Peptide Sequence Number=SeqID_108294
atggttgaatacaacggtaataaaggggatcagtgcccgctgcatccaggggagttgcatgatgtagaaatgttcctagtatccaaggagctattgcagggattgatagatgaaggtcgaattgaaattggccacgtaaggagggaggaagcaaaggtgttcatgcagtcaagcgacaccaacccgggtaagcctaaacctttgggatccgacggaaggcaggacacgtctgtcatgcgtgttagggctagcatgccgattggtaagatcacaaatatttttggtatgagtggcatgactcatagtggatgtatgtttgctcctctcgaactacaggcaaagtcgaaggacaagggaaaggcgaaggaggatgtggttgaaagggagaaaatatgccctgtgacgaataacgaggcccctatcagaaagcttgtagaggaagagggcaattttggcaagaaggagatatctgctaaggtagtaatgaaatttctgaggattattcagcagagtgaattgaaggtaatcaagtaa

SEQ ID NO: 16610 - DNA, 972 bp, Glycine max
  Peptide Sequence Number=SeqID_108295
gcgggcaccaagccgatctccggtctgccgacgcctccgggcaccccggcctggggcagcaaatggaaagcggcggtggcggatgcttacactcaccacgtttcgatggacgcccacggcgcgcaccagtcgtaccgcaacaactatctggatctcgatcccaactacaagaacgtctttggccagccgctgctgcgcatgacgttcgactggcaggagaacgacatcaagatggcgcagttcatgtacgacaagatggcgccgatcgccaaggcgatgaacccgaaactgattgccggcagcccgaaaaacgccaacagccacttcgacaccaccagctaccagactacccacatgaacggcggcgcggtgatgggggaagatccgaagaccagcgcggtcaaccgctatctgcagagctgggacgtgcacaacgtgttctcgatcggcgcatcggccttcccgcaggggctgggctacaacccgaccggcaccgtggcggcgctggcttactggtctgcccgcgccattcgcgagcagtatctgaaaaacccaggcccattggacgccaccgtcagcagcgagttgatcaagcgcggtgaatacctggcgcgcgccggagattgcgtggcctgccacaccgacggcaagagcggcaaaaccttcgccggcggcctggcgatggagacgccgatcggcaccatctactccaccaacatcacgccggacaagaaaaccggcatcggcgattacagcttcgaggatttcgacaacgcggtgcgtaagggcgtagccaaaaacggcagcaccctgtatccggcgatgccgtacccgtcgttcgcgctggtgaaagaagacgacatgcgcgccatgtatgcctatttcatgcacggcgtgcagccggtggagcaggccaacaaggattccgacatcccgtggccgctgtcgatgcgctggccggggatcctctag

SEQ ID NO: 16611 - DNA, 196 bp, Glycine max
  Peptide Sequence Number=SeqID_108296
atgccgatgcgaggacgcaacaacaccatcgtcaacacccatagaagacgaacgaagcacgcgattggaaggttaggaagaagaccaacgaaggtcacaaagaagacgcagaataagacgcacaaaaagacgcagccaagctttttcaagaggaagaagaaggattcgaagaaggatgtgaaggtcaccaatgaag

SEQ ID NO: 16612 - DNA, 228 bp, Glycine max
  Peptide Sequence Number=SeqID_108297
atggaactgattgagaacatggcagccaacgaccatgccatcttgcctgatagaacgcacattcccacaaagagaacatacgtggaggagctcatgagtctggtggctaataggcaaggatttcatccaggtggttttgcaggatatcagcagggaggaaactttgctcataaccaaggtcaaggctggcagtcacaccctggaaatcagtttaacaaagaccaatga

SEQ ID NO: 16613 - DNA, 204 bp, Glycine max
  Peptide Sequence Number=SeqID_108298
atgaagaaacaacaatggaagagaaggtcaagcaaaaaaattaatggagcttcaatgaggtccttcaatggtgattttcaccatggagatgcagcggaagataaaggacaagaggtgagaggacccaacttggataagaagtttagagaggaagcttcaatggaggaagagaatgagagagagagaaggggacgtgggaattga

SEQ ID NO: 16614 - DNA, 318 bp, Glycine max
  Peptide Sequence Number=SeqID_108299
atgggttctccacctgcctccactcctcctcctccttcttcggacgcatcagcttcaccgtctgccgtgaagcggacacacaaagcctcacgtctacgatcgttgtccactagaccacctggagctgatagaccagtggtgcatgttgatcctgctactgggaaggccgacggtccccacaggaagaaattaagaacatatttggggattgtggcgcgtgataaggtggacgccacctacgagaactggaaggaggtccctacttctcagaaggacctgatttgggaggatattcagccaaaatattgtaacaaataa

SEQ ID NO: 16615 - DNA, 159 bp, Glycine max
  Peptide Sequence Number=SeqID_108300
atgactaaagcacgtcaaaagggggaaaatgggggagatgcttgccacccagctcgcctaggcgagcaaggtgacttcctccagaagcaaccgccttctggaggatcttctggagggcccaagtgggcctggttgctatttgcaccccatttcttctaa

SEQ ID NO: 16616 - DNA, 258 bp, Glycine max
  Peptide Sequence Number=SeqID_108301
atgtataaaatttcgttacctccactcaaaagactagttctcccttcttcacatgcttttattgtgatatgtttctatagtctgacagttgggattttgaaaatagtaacttctggtctcccgctaagcgagaatggtgcgctaagcgcaattccaaccgaggggaattgcgttgagcaacccaaagctgcgctaagctcaatcccaaccgaggggaattgcactgagcggcccaagggtgcgcttagcgagccctag

SEQ ID NO: 16617 - DNA, 228 bp, Glycine max
  Peptide Sequence Number=SeqID_108302
atggctccgaaaaagctttctgcaaaaagatctaggagggacaccgcggctgaaggaaccagtgccgctcccgagtttgatagccaccatttcaggagcgtcgagcatcagcagcgtttcgaggccatcaaagaatggttgttccaccgagagagacgcgtccaactcagggacgatgagtacacggattttcaggaagagatagctcaccgacgttggacgttgctg

SEQ ID NO: 16618 - DNA, 310 bp, Glycine max
  Peptide Sequence Number=SeqID_108303
caatcactatgcatggctccaaactcgtgggtgaaggatgcatgaacgaaaacgcaattcatggggctccgaaaaagggtagagaatggagaattgcactaagcaatcactacgcatggctccaaactccaatcactacgcatggctccaaactcgtgggtggaggatgtatgaacgaaaacgcaattcatggggctccgaaaaagggtagagaatggagaattgcactaagcaatcactacgcatggctccaaagtcgtgggtggaggatgcatgaacgaaaacgcaattcatggggctccgaaaaagg

SEQ ID NO: 16619 - DNA, 360 bp, Glycine max
  Peptide Sequence Number=SeqID_108304
atgatacatgaagagacccaaattgggtgcggtcgtgccctcctgagttcgagttggggaactggaaaattgtcaagcaacctggaattttcgtggcaagcacagtgttatttatctgacaatgagtcatgtgagggtaatgatactgaggacccaagcgtcaattttgagcaactggtaaaccaagttgaggatggggaagatgaggctttggggcttcccccggatctaaaaagaatggtcgaacaagaagacagggaggtaaagccacaccaagaagaaatagaggttgtgaacttgaatggtggcgaggaaagaaaggaggtgaaggttggcacaggcatgtccacaaacacctaa

SEQ ID NO: 16620 - DNA, 807 bp, Glycine max
  Peptide Sequence Number=SeqID_108305
atgactggagtcagtgtcattgtcatcgtattggtagtgattgccatcgccaaaggcgtgcgcatcgtaccgcaaggtgaggagtgggtggtcgagcgtttagggaagtttgccggtattctcaaaccaggtctcaacgtgatcaatccggtgttcagcactatcagctacaaggtgacgaccaaggatattattctggacgtgcctgagcaagaggtcattacacgcgataacgcggtgatcctggccaatgcagtcgcctttatcaaggtgaccaatattgagcgagctgtctatggcattgaaaattttcgcgaagccatgcgtaatatggtgcagaccagtttgcgctcgattatcggcggcatggacctgaaccatgccctgacttcacgagacaggatcaaagcggagctaaaagaggcgattgccgatgaggctttagactggggcctgacagttaaaagtgtcgaaatccaggacatcaagccatcagccaatatgcagcacgcgatggagcaacaagccagcgccgagcgggagcgtgtggcggtggtgacgcgtgccgaaggccagaagcagtccctgattttgaatgccgaagcaaggcttgaagccgcacgcaaggatgctgaagctcaaatggtgggcgccaacgcctctgccgaagcgatcaagatgattgccgaagccgtcaaggaaaataattcttcagcaatgtttttgctgggagaccgttatatacagtcgctgcaaaaaatggcggattccagcaacagcaagatcgtggtcatgcctggcgatgtt

SEQ ID NO: 16621 - DNA, 483 bp, Glycine max
  Peptide Sequence Number=SeqID_108306
atgcttccttttgactttcggcatgttatggaacttcacggattgcctaacgatgggtgccaagtacctcgaagtgatcaaataagggtcgcatcccaacaaacggatggtccccggacgaaattaggtgattgttcatcacaacacaagctatgcttcaacaacacaacccatgctcctaggtttctgatgaatgtccttgttgttcatatgaagaataagtcgtgctccttcaacactagtcatgctccttcagcactagtcgtgctcctgggtttgaaggctcttcctcaactactggttctagcacaagggccaaggtgtccggaggatgttctatctttccatgcgagtttcaaccacctcctcaacagacaccaccatagcaaggttgttgtcaacaggccattcgtcacccatctccatcaccatcgccattcaccacatgctgaagagcttgaaggtgaagcccttgatccatag

SEQ ID NO: 16622 - DNA, 291 bp, Glycine max
  Peptide Sequence Number=SeqID_108307
atggattgtgatttgtttgttgaagacaagcctgctccagaacacaatgtttgcttacaggtaatggaaggaggtcaagaggttctgaaaggtttcaatttcttggaaaaaggactgaaaaataactcagaaaactttttcctgaaaaatagtcctttcgctaagcgcaagcctcgcgctaagcgcaactctgttcatgctctaagccgtgagtctcaagcgcttagcgcccaacccttgcatctaaggctgatttggtctgctaagctggccaaggttgagctaagctaa

SEQ ID NO: 16623 - DNA, 153 bp, Glycine max
  Peptide Sequence Number=SeqID_108308
atgtggacgtggccaagaatagctccacgatctcgcatgtcgggctgtgagtaccctttggtaagaggacatgagagggggcctacaaaacaaaagattttgatgctcaagggttgctacggtggtgtaacaacccttggagataattgctag

SEQ ID NO: 16624 - DNA, 518 bp, Glycine max
  misc_feature (454)..(454): n is a, c, g, or t
  Peptide Sequence Number=SeqID_108309
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcnacgaacccccgttcaggccgaaccgtgcgccttatccggtaactatcgtcttgagtccaacccg

SEQ ID NO: 16625 - DNA, 362 bp, Glycine max
  Peptide Sequence Number=SeqID_108310
atgggatcaagtcaaatgccttcgcttaaaaagaggttctatcaagtcaaggtcaaaagcctagggatcaccagtctaaaagagttagggcagatgatgggtcagctccagcggcaagcttttcgcaaagcttacgataaaatctgggacctagccatggtagaagtctccatagaggccattgcctccctcgcccagtattatgatcagccgttgagatgccttcacctttgtggacttccagctatcaaccatgatagtctaaatctcggcgcaggaattagaccacagaaagcaagtcgaaaatggggtggttggaataccgagaaaatatttggaggcaaaagcaagaatcttggcag

SEQ ID NO: 16626 - DNA, 683 bp, Glycine max
  misc_feature (377)..(377): n is a, c, g, or t
  Peptide Sequence Number=SeqID_108311
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagagttgaacttctttcttggactccaagtcaagcagatgaaacatggaacctgggtaccgagctcgaattcgtaatcatggtcatagctgtttcctgctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtcccaaccg

SEQ ID NO: 16627 - DNA, 596 bp, Glycine max
  Peptide Sequence Number=SeqID_108312
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccccctcgaggagctcaacttcaacgaaaacggaggcttcaatctgtggcagttacctgcggatatcgacagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 16628 - DNA, 285 bp, Glycine max
  Peptide Sequence Number=SeqID_108313
atgtcacgaaactttacggattacgcaaccatcccctttttgatttttggaatgttacggaactttatggatagcgcaataatgtttcctttggactcccgacatgtcacgaaacttcacggattgcctaacgatgggtttcaagtacctcaaagcgatcaagcgaaggtcgcatcccaccaaacaaatggtccccggacgaaattagggcttgtaatgagcttcaaaacaaagaaaagggaacataggctcaaaggggctagcaagaagtatcaacaagagtaa

SEQ ID NO: 16629 - DNA, 201 bp, Glycine max
  Peptide Sequence Number=SeqID_108314
atgattatgaggggccaagacatttatagtagccaagatgaagctactacttcaccttcctctagtggaagtgaagaagcaaaaagggaagaatatagtgaagaaatctacccccaagaagaaggacaacctttaatggttaaggaggagtgtaaggaggtattattaggcactgatcggagccatacccaaatcaaataa

SEQ ID NO: 16630 - DNA, 396 bp, Glycine max
  Peptide Sequence Number=SeqID_108315
atggaggattcaatcgggaaaataacaaggatcacatttcccagtcaagagggtccgctcttgacggtgaagaacacgttggagaatggaggattcaatcccatcgggaaaataacaaagatcacatttcccagtcaagaggatcacgtttcccagtctagagggtccgctcttgacggtgaagaacacattggagaatggaagaatccaatcggggaaaataacaaagatcacatttcccagtcaagagggttcgctcttgacggtgagaaacacattggagaatggaggaatccaatcgggaaattaacaaagatcacatttcccagtcaagacggtccgctcttgacggtgaagaacacattggagaatggaggaatccaatcgggaaaataa

SEQ ID NO: 16631 - DNA, 558 bp, Glycine max
  Peptide Sequence Number=SeqID_108316
aaccgcgtaaaagagaggaagttgaggcactggaggaagacgaagaagtgcagacccttaggatagaactcgagcaagctcaagcaatcaaagaaagggcttgtacggaagagcacggccggaacaagttccgaagggctctgtggggtagcaacaacgagcttaagctacggagagaggaaagggaccaatcacgaatagacagtttgatcttgaaagatgagttgaaggtttgctcgaggtccaaaagaagtttgtctcaacggttatgcgagacagagaccaatatgttagccatcatcagcaagtaccaagaagaactaaatctagccacgacccacgagcatagagtggcggacgagtatgcccaagtgtacgcggaaaaggaggctagaggaagggtgatcgactcgttacatcaagaggcaacgatatggatggagcgatttgcttttaccttgaacgggagtcaagaacttccccgattgctagccaaggccaaagcgatggcggacacctactccgcccctaaggagatccacggacttctcagctatt

SEQ ID NO: 16632 - DNA, 282 bp, Glycine max
  Peptide Sequence Number=SeqID_108317
atgcatatgacacagatgcaatttacgaatacgggagcccgagaaattgtttccttcttggatacaacgtttgggcagcgtggcacccaacggaaacccaacaaaggagtaagtcacggtaaaacattgcacaaggttaaatggcctaactctctaaaaacagtccccagtggagtcgccaactgtcgcaacctacccttcggcgggagggcgaggcgtgactcgcgggatgcgtgttccacgaaaggaatacgcgcggagtcgccaccaacgtttatctga

SEQ ID NO: 16633 - DNA, 457 bp, Glycine max
  Peptide Sequence Number=SeqID_108318
cgcccaatacgcaaaccgcctctccccgcgcgttgtccgattcattaatgcagctggcacgacagcggatcacaatttcacacaggaaacagctatgaccatgattacgaattcgagctcggtacccgaagtacaaccggatatacaactggatgaccgcataggcaattgggtagatgatcgtgtagatgttggatttcgcttatgcaatccaccgcaagatggattagtgacaagaagactatttccgatgcaacttgtgatctgtgccggggagcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16634 - DNA, 677 bp, Glycine max
  Peptide Sequence Number=SeqID_108319
gaactcaggaggcgcagatgggaccaggtgctgactcaccttccggagaagcggatcgacgtggctctggtgaaagagttctattcgaacctttatgatccagaggaccacagtcccagattctgcagggtgcgaggacaggtcgttcgttttgatgctgacaccattaacgacttcctcgacaccccggtttttttggaggacggggaggagtatccagcatacaccagatacctcagcactcaccccgatcctgacaccatcgcggccacactgtgcactccaggggggcgctttgtccttaatgttgatggtctcccctggaagctcctggaaggacatgatgaaacttgctcagacatggaggcctgcttgatctacggtttggtgagccgcatggacatggatgtgggcagctttatatcacagcagatcagccagattgcccagtccagcacctcgaggctcgggttcccaacgttgattatagcgctgtgtgacattcagggggtggtttctgataccctgatctttgagtcactcagacctgcgatcaacctagcctatgtgaagaagaactgctggaaccccgccgacccatcgatcacgttccctgggcctcgccgcacacgtaccagagcttcagcatcagcttccgaggcccctcttcctaccca

SEQ ID NO: 16635 - DNA, 288 bp, Glycine max
  Peptide Sequence Number=SeqID_108320
atggatcgaagttggatgaatcaaagtcgcatgagcccagaatatgaggatggcgtcgagaaattcttgcaatttgcttcagaaagaggtcgaccgaatgaagaaggaaaatattattgtccttgcatcaactatttgaatacatgcgtagtggtgaatgatgcaaaagatatcttaggcggtgttgaggaaaaaagcccagcgtttcaagaacctcgggatttgaggtcaaatccttttcaagggagagggaatgatgcaatcctaccccgcaagggcattggatag

SEQ ID NO: 16636 - DNA, 469 bp, Glycine max
  Peptide Sequence Number=SeqID_108321
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagcccttgaaagtcatgacagatatttggggttccctactttgataggtaggtccaagacccaacttttcgagtttatctttgatagagtttggaagaagctcaagggatggaaaggaagagctttgtcacaagcaaggggggatgtcgaaggaaggaagcctcagggtaccgagctcgaattcgtaatcatggtcatagctgtttcct

SEQ ID NO: 16637 - DNA, 289 bp, Glycine max
  Peptide Sequence Number=SeqID_108322
atgaaggccaacatggaggccatgaaggaccaaatgacgtccatgatggaggccatgttaagtatgagaaggatggaggacaatgtggccgcagttgccgccaccagtgccaccaccgaggtggatctgactcacccatccgacataaaccaaacaagccatccagtcccggacatggtaggtcagggaggagaggtgttaggcagcacgggtggtccccatgtggtgcaaaataagaattcttgcccaccgtacggcttacctccaaactatacaccacccaatgcac

SEQ ID NO: 16638 - DNA, 1138 bp, Glycine max
  Peptide Sequence Number=SeqID_108323
atggcaaccacgctgtttaaagattttcagtttgaagccgcacaccgtttgccccacgtgccggagggccataagtgcggccgtctgcatgggcattcgtttatggtgcgtctggaagtgaccggtgaagtggatccccacaccggttgggtgatggatttcgccgagctcaaggctgtgttttccccgatctgggagcggctggatcaccattatctgaacgatattccaggattggaaaatcccaccagcgaagtgctcgccgcctggatttggcagcagctcaagccccagttgccggaactgactgcggtgatgatacttgtgggtctgcatcgacagccgccagttgcgcgcgatgcaggtttcgatgcacaggcgggtcgcctcttctttctggctgatcggctgcagcgcaataatgcgcgccttgtcgtcctgcagcgtcgccagcagcgcgtccagcgcctcgatgtcgcgctcgcgcgccaccggatgcttcacctcgtcggcgcgccgcagcgcctgatccagcaccttcatgccgccgcgcatattcaccttcggcgaaaccgtcacccaagtgttggcggaacagcgcacctcgtgggtgccgctggtctcaatctggcagccataaccatgctgttcgaacagctcggtcagcggcgccagatcgtagatgcagggttcgccgccggtgatcaccacatggcgcgcggtgtaaccttgttggcgcatcaccgccaacagctgctcggcgctggcgttgccccaggcgtcgctctcttctgttttgaccaggatccgttgcaggtcgacttcccgattggcttccttttcccaggtatgtttggtatcgcaccaactgcaccctaccgggcagccctgcaagcggataaaaatggccggcacgccggtgaaaaagccttcgccctgcaaggtttggaacatctcattgatcggggtgccatgactcattccaccagcgagttgaacattcagcaggccatcgacgacagcaagttttcgctgtttcactggaccctgatcattctcggattcctgatcctcgccatcgacggtttcgataccgccgccatgggctatatcgccccctcggtcgccaaagactggg

SEQ ID NO: 16639 - DNA, 289 bp, Glycine max
  Peptide Sequence Number=SeqID_108324
tataagagaagaggcagaggagacacaggtgagacaggtagctgctaccactcctgagcgatcccttgaggctacttcagagccttttgcaccagtggtaaacttaccctcacctcaacctgcagcagacccctccactcctcttcaacagatgccagaggacccaactacaccagtcctagctatggacacttctcctcccactactctagtgcttcagctgacaaataaagaggatgatcaattttgtcaaaaagttgtgttaatgatcagtgaccaaactggttag

SEQ ID NO: 16640 - DNA, 273 bp, Glycine max
  Peptide Sequence Number=SeqID_108325
atgggtgccaaatacctcgaaacggtcaagcaaaggttgcatgccatcaaaaaatggtccccaaatgaaattaggggacaggaaaatattctcatagctaggttccctgaccataactatggtgtcaaaacgataaattttataataactcccctcacctatcgtgagcttctcgttggttcctctttgcgtcacttagaggtctctctcatttgtgcttgtcagtccaacacaagtctctattatgccaaaacgaaaggaattttagcatag

SEQ ID NO: 16641 - DNA, 249 bp, Glycine max
  Peptide Sequence Number=SeqID_108326
atggatacgatactcggtcttatcgttttaatataccacttgtgcgaatcggtaagttttagctcaggccgctattttggtggcaacaacaatgatgttgtttctcatcttccatttgatgtaggatttgaggttgtagggataattgcaacagttggggattctgtcactgacttgaaagttggtatgccttgtgcattcatgacttttggaggctacgctgaattcttaatgatgggtagtgcttaa

SEQ ID NO: 16642 - DNA, 252 bp, Glycine max
  Peptide Sequence Number=SeqID_108327
atgaaggtcacagccctcaaacaaaccagtcacgacatgattgcacacataggtaaagctcgggctgcagtggaagagttgaagaggttccttgtggctgattcgctggaagaagtgaataaaaagttggataagttctatatggttctcatcttgaggagtctccattcagattttgatcatgtgcgtgatcaagttcttgccggagatcaagtaccatcgatggattcactcaattattttccctcatga

SEQ ID NO: 16643 - DNA, 384 bp, Glycine max
  Peptide Sequence Number=SeqID_108328
atggagttgctgttagagtcaaagatgaggcagggagggtggggggaggccttctcttccaccgcgagcccagctgctgcttctttcgcttggacgccattgccgttcgagaagacgagagcaggaggtgccagaaaaaatggggaaagggggctgacggcgaggcttccggaagacccgttatgggttcttccgaaacttccggaagaacatgttccggaaacattccggaagaagtgttcttccggaagaaaccaaacgttttccggaagaacccttcttccggaaacattccggaagaaaggttcttccggaaaacgtttgggatttccggaagaagtttccggaagaggaataattccggaagaacaattcttccggaaa

SEQ ID NO: 16644 - DNA, 1027 bp, Glycine max
  Peptide Sequence Number=SeqID_108329
atgatgcttgccactgatgacatagagtctccaacatccacattgtgcttccccgagagtactgtgcaaatgaataataataataataacactatggtctcaaccaaccacattggtgagggtgcaattgaaactgtgaatggtgggggtgacagtgagtcgtggaggtacttcaccaaacacaacaatgaagaagaactcgttgaaactgatgagaagagaataatgtacgacacgatgtcatgtttgcaagacgatgatgacattatggtggctgttgaggcattaagaggtgcggttgctacgtgcacccagcaaacagtgaagtggcgaaactgccattcagcaattattcttccggaagaagtttctatttggaaactttccggaaaacctttttccggaaattttccggaaaaccttcttccggaagaagaatttgtgacttccagaagtacccacaaactacttccggaagaacgtcatccggaatgtttccggaagaaccgtcttccggaagtttccggaagaagcttcttccggaatttccattggttgtcccgtgaagtatttgaagatttggtggtcccgtgtttcgtatttgaagttttgttagtggctgttcttcctatttcgtcggagatggacgcagatcaatggaggtatgactttgcggtgtcacaagaagttcatatggattatgattatgataatcaagaagaatgtggggtgaatgaaccacatgtcgattgttcaaatgcttttaatacatctcaggtattcgctactcgagatgatgttttgcaatgggctcgaacagttgcccatgaaaatgaatttgttgcagtgattatgagatctgacacagagaccggtagcagagaaagaagttcatttttcttaattgggtgtgaaaggagtggtacgtacaagtgtagaaataaagaattcgttagaaatgacaccgggagtaggaaatgtggttgtcccttcaggcttcgtgggaaaccagtgcatggaggggaag

SEQ ID NO: 16645 - DNA, 1371 bp, Glycine max
  Peptide Sequence Number=SeqID_108330
atggaggttagatcagagggtatacaagtgaggtgtgataaacttcagagtcccgtgattcctaggacacgtttgaggatttggttcattcgtgtgtgctcaagcattgtggtgtggacgtgtctggttcagttagtgacagtgagtgaactatggcattcacatttgatttctgggattactaatggtatatatcacataacccaagttcagcttccaatacaagaggataatggggttgctcaatcgcctcctgtttttcttccgccaattgctcgatttttgaatctcacattggttgttccagagcttgataagacatcattttgggcagaccctagcaattttgaggacatttttgatgtgaagcatttcatttattctttaagagatgaagttcggatagtaaaaagagtgcccaaaaagttcagtagcaaacatggatacgccaccttggagatgcctcctgttagctggtcaaatgaaatatattacttggagcaggcacttaaattcactcctcaaattgagaatttggggcacaaattgattcagatgcttcatgagaagggaccttttgtggcgttgcatctgagatatgagatggacatgttggctttctcaggttgtacttacggttgcactgataaagaagctgaagagctcaagcagctgagatatgctttcccttggtggagagaaaaggagataatttctgatgagaggagatcacagggtctatgtcctttgacaccagaggaggcagccttagttttgcgagccttaggttttggtagggagacacagatctatattgcagctggtgagatttatggtggtgaacgtagacttgcacaattgagagctttatttccacgaattgtgaaaaaggaaacattgctaacctgggatgatttgcagcagttccagaatcattcatcgcagatggcagccttggattttatggtttcagcagccagtaatgcatttgttcctacctatgatgggaacatggcaaaactagtggaaggtcatcgtaggtattctggttttaaaaagaccatcttattggatcgaaaaaaggtggtagaattggttgatatgcatcagaatggaaccctttcatggattgagtttgcagatgctgtgagacgggttcacgagaagagaattgctcagccaactcggcgaagagttatattagataagccaaaggaagaggactatttctatgccaaccctcatgagtgcctgtgtgaggaaacaaattgtgatgacttgctaggtcctcgtaactctagtcagatcactgctcccaagaccttagattacaagaattttgtaggaaatcagggaaaggaaagcacatga

SEQ ID NO: 16646 - DNA, 264 bp, Glycine max
  Peptide Sequence Number=SeqID_108331
atgggggatgtagtggccatgatggatatccctgggaaatacttgtacttgggggcatgtcactcggtttggaatttccatgagactcaggctgctcaccatggggaagggggtgggagttgcctgtgcatgacaggggagaaaaaggaatctcatgaagatagtataagtggaggcttcaatttcttctccgtctctctgacgtttgggaattctatcgagatagtcggaggaataactggaggaatctcagggaactgctag

SEQ ID NO: 16647 - DNA, 522 bp, Glycine max
  misc_feature (12)..(12): n is a, c, g, or t
  Peptide Sequence Number=SeqID_108332
atattgattgtntctgagcatcagattgccaaggaaatcactgccaaacaagtccagcattggccaaagaaagggaagctttcagcagggaagctaagtgtgaagtatgcaattctgcacaggattggagctgcaaactgggtcccaccaatcatacttccactgttgccacagagagaatctcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagcctccacagagaagaaaatggagctggaactactgatcaaaaggctctcagagagtggcattgatgatgaagaagcagctgaggaagaaggagaagcagctgaagaagaagaagaagctgctgaggaagaggaagatgcagcagaagagacagaatcagatgatgattctgaagccaccccatga

SEQ ID NO: 16648 - DNA, 396 bp, Glycine max
  Peptide Sequence Number=SeqID_108333
atggcattttcgaaacatgccagtctgactggcattttcactgttggttttttgttagtacatcatgttagggcttctgctgatcagagagaacgattaactatgtccgtggagagattaaaccagtcgagtgagaggattagggacagccacagaaccttgctggagactgaagaacttggaatcaacatcatccaagatttgcacagtcagagagagactctactgaactctcataaaaggcttcatgggatagatgatgctattgacaagagtaagaaggttttaactaccatgtcacggagaataactagaaacaaatggatcgttgcatctgtgattggagctcttgtttttgctatagttattattctcttttacaagctatctcattag

SEQ ID NO: 16649 - DNA, 321 bp, Glycine max
  Peptide Sequence Number=SeqID_108334
atggcttctgcaaacaattttcaacctcctcctccccctccaccaccaatctactccgatggtgatggcaattcctccgttcactccgacggaggttccactaatctcttcgataggggtccctctgttcacttcgacgatggatccactgatcacttagacagtgactccagtggctgctacaccgcttcagttgttctttactctgatggcaatttcggcaactgcatcttcttcgtctttgtaaccttcctctttctcgcatgcgatctttgcgaaactcagaaactcagactacttgttgtagtgtcagcaagttga

SEQ ID NO: 16650 - DNA, 291 bp, Glycine max
  Peptide Sequence Number=SeqID_108335
atgcaactacggaagaaggttcttccgtggaatccctcggaagaagtttcctccgtggaatcccgcagaagaaggttcttccgttggattcaacggaagaaggttcttccgcagttcaaattagcgactgcggaagaatcttcttccgttgaatccagcgaaagaagttcttgtgcgactttccatggaagaaccttcttccgcagttgcatttttcaactgcggaagaaccttcttccgtggattcgtcgcggaagaccttcttcgtttcctgccatttacaccatttcg

SEQ ID NO: 16651 - DNA, 381 bp, Glycine max
  Peptide Sequence Number=SeqID_108336
atgatgtccacagctgattctgtcacattgacacagttcattgaaaggatgagaatttttaaatttctttttggactgaactctgagtttgatctgattcaggttcagattttgggcaaagaaaaacttccttctctcttagaggtgttctacattctactagcaagggtcccacaaaaggctcatcctcttcatttgggaagcctctcacaaaggctaaccgtgatgattgatggtgtagctattgtaggaagccaggtcatactaaggagacatgatttagacttcatggaaaggagaaggtacttgagcgcattggaggattcaaaggtgccacacaaaggaatgctaatcaagcaatgtctgcttccgaaggtatag

SEQ ID NO: 16652 - DNA, 333 bp, Glycine max
  Peptide Sequence Number=SeqID_108337
atgaaacataagattcctagaattgctataaatgccaatcaagttgttaacaagatgaaaaggtggtcaacaaagcctaacgatgttgttgacatgatgaacaccagtgggtttggatgggatgacacaagaaagtgtgtcacttgcgacagcagtcaaaaacatcctaaagttggcaaccatgttaataaagagtttaaagagtttgagaagttgcaaagtatttttggaaaagaccgtgcaaatggttgtggggccgagggttgtgtagatggaatggaaaatgaaattggtgagaaccaagttggtgatgatgatgagtggctacactaa

SEQ ID NO: 16653 - DNA, 174 bp, Glycine max
  Peptide Sequence Number=SeqID_108338
atgaaggtgagggcgtgtagccctctgaaggcgtgggcgtgcaaccctataaaggcgaggacgtgtagtcctttgaaggtaaggacgtgtagtcttctcaaggcgaaggtgtgtagccctctgaaggtgaggacgtgcagcgctctagaggcgaggacgtgtagtcctctaaag

SEQ ID NO: 16654 - DNA, 1272 bp, Glycine max
  Peptide Sequence Number=SeqID_108339
atggttagaacacgaggtctaggtcgtgcgttaggcaccggtcgaggcagagagactactcaggatgtgcctaaggctgatgttccttggcattgtcggcccactgcttcagcacgtaggcaacgagttcgtgtgcctgaggatgttgcccagagacctgaggatgtgcctcagttgcatgaggatgctcctcatgtgtctgatggtaccccagatatgacaagtgctgcggatgctgttgacacagagggagtggccactgaggtaagcttggggtcacctactgcagatgagggattccccggtgggccacgcaacccattggttttgaccggttatgctgagcatgtcgcacacaacatctggagtggacaatgttctgttataactagtgatcctagactcatatccgcctttgtcgagaggtggcatccgaagactagcagcttccacctcccggtagcttcaacccatgtacatgtcgtgcacctccaggctttcaaggatctcgcccagacagggggattcgcctggggtgcggctactttggtccacatgtacgaccatctgaacgacgcgtcacaggcctctacacggcagatgggcggttatattacacttcttcattgctggatatacgagcactttccttcagtgcacagatgctccgttgatgctgcttatgatgaggggagcccccgggcttgcaggtggcttacgggtaaggctcacatgacggggatcaagggagccccgtatcggacacgcatggatgccctcactgtgactgacgtgtcctggatgccctatgctgagcaccggggagtcaggggcttcgacttgatatcgtcatacacaggccaactgagatggggtcagcttgtcatgtacactcgacctgagcgggttactcgacagtttgactacattcagaccgtccctccgtcgtcggttactgagtctctaacgagtgatgagatagacgaccggtggatccatttttcagaccatttggtaggtgcatgggagatttgtgtagttcctaggcaggtggcgccatactacatggagtggtttttccggatatcccacccgtttgtcacgcctatcgaggagactcttgagtcgagacagctgcctccccctcatgttgaggagttcgtcgagccacctatccctgaggtttcagtcgcgtctgatctccctacgcattcagtgccagaggtgacgcctcaaatgacagtcttaggccgcgacagagacgccccatag

SEQ ID NO: 16655 - DNA, 1257 bp, Glycine max
  Peptide Sequence Number=SeqID_108340
atggaattggaggctgatcatcaaaatgggatccgaagcaggcccaatttccctctgcagctgttagagaaaaaggacgttgatgacgtcaccgaacaaccttgttccaccaccagcgtggtaactactgctgctgctactattacttctggtaacaacgacctccacgtggcggagcagtcgaagaagcctccgccaaagcggagttccacgaaagaccgccacacgaaggtcgatgggcgaggccgccggattcgcatgccagcggcctgcgccgcaagagtgttccaactcacgcgtgagctgggacataagtctgatggtgagaccatcgagtggctcctccagcaggcggagccggcggtcatcgctgccacaggcaccggcaccattcccgccaacttcacctcccttaacatctccctccgcagctccggctccaccatgtcggcgccttctcactacttccgcggaaactacttcaaccctagcacgttctccacctcagccgccgctgcttccgcggcggcggtggcacagctaaggagccgcgcggagtgggaccggaacatgagcatggtgatggaggattctcgtaggagcatgctggagaacacttcttccatctccgcaattttgaatttcaaccctatgggtaacgtcaatgtaattcaacaagcgaaacaagagcttcgagaagaatccgccgccgccggtggcggcggcagtcttgattcggtggcttcggattccgatggaagcttagggagaaagagaaggccagagcaagagctatcacaaatgggaagctacttgatacaatcaagcacagggtcgcttccgtcgagccacgcttccaatacggcggcgttttggatggtggccggtcacggcaaccaagccatgagtggtggtggtggcagcgatggtagcagcgataatcccatttgggcaattccctctgttgggaatagcggtgtgtatagaggagctatgtctgccccaggtggcattcatttcatgaattttgcttctccgatgaaccttatccccggagctcaactaggttccgccatggttgggggcggaagtggtggcggcaacagtggttctcaacttctaagtgaaagcagattccggctaacggcgtctcggagtctccggccagcgccgggcaacctcacggcggagacgatggacgtgattcctccggtcaacattcctgagggtaaaaataatcacaagtgtatgatctga

SEQ ID NO: 16656 - DNA, 186 bp, Glycine max
  Peptide Sequence Number=SeqID_108341
atgtctaacttggcatcaaaactaaaagcacttaagctagagcttggtgaagacttgacctctcagaataaaaaaaaggaaactaaggatgctctcagcaaaagaaacaaaagaaaaatgaagaatttacttgctacttacaagaagtctggacacaacaaaagtgtccaaggtgctttcatgtga

SEQ ID NO: 16657 - DNA, 936 bp, Glycine max
  Peptide Sequence Number=SeqID_108342
atgctttgtgatgataaatatgaagatttgggtcgaatgtataacttgttctgtcgtgttactgatggtcgtgcaaaaatacgtgaagtgatgacttcacacattagagaatctggtaaacagcttgacacatatcctgaaaggttgaaggatcctaaatccttgaattcctcatttgaatacttcattaacttgaatcctcgttctccagagttcatttcactctttgtagataataagctttggaaaggactcaagggagttagtgtggagattactcttggcaaggtgatgatgctattctggtacttgcatgaaaaggacctgtttgagaaacatgaaaacctctctagaaacattgctgaacttttatatgccaaccaccccgagttaagcaacggtcctacgcttgccgtgcaggttttgacaacagggttttggcctactcaatctactgttacatcagacttaaaagctacctttggtaaaggtcagaaacatgagttaaatgtctccacttaccaaatgtgtgtcctcatgctgtttaacaaagctgatagactaagctacaaggaaattgagctagcaactgagattctggcttcatatctgaagaggtgcctgcaatcattggatttggttaagggaagaaatgtgcttaggaaggagcctaagagtaaagatgtaggtgagaatgatgctttctttgtgaatgatgagttatacaggataaaaataggaactataactgcacaaaaggaatcagaacctgagatactggaaactcgccaacgagtggagcaggaccggaagtcacagattgaggctgccatagtgaggataatggaatcaaggaagcaacttgatcataacaatctcatgacaggttacaaagccagctgcagttgcggttccttgcaaatccaacataggtaa

SEQ ID NO: 16658 - DNA, 1482 bp, Glycine max
  Peptide Sequence Number=SeqID_108343
atggttatcttagcagccacttccaataacaagatccatcagttgcaaactttcaactctcagaacaataactaccacctgcgcgatgcgtccttctcatcgtacttgaacaacaaaaaagagatcctggctgaatcaggccatggctatgtcagcagcagaaaggagcctcttggagtaaagaaggaagatgatggagagattggagtatttgaagctgaaaagtacttcaatggagaagagatggaaagccccccaagaattgctgataatgacgcaaacaagcacctgccccagaaagatgaacaaacagttcttgtaactagaaagtacaaagttcagtatggaactccaagtgtaaggtctgagtcaagcttgaatagccaaagtgcactgttgcaaagtgctgtcaggaattcctcaaggaacatgaaaagcaaattgcagaggaagagttttctagctggtcttggttgcaaatgctattgttctgacaagaattctgttgatattagtgaccatacaggtgaaatcagtttcagcaaaaatgccactcatggaaaaacaacttcaagaaatatgttcaatgctgagccagaggctaatcattcatttaaaatgactaagcctaatgcagcagaaatttcgattaacaaagatgtctactttcaaaggccagagaagttaggggtgggattgagcaaagaaaacagtttagcactctcagctgtgaattctatctcaggaaatcatctgctgaaaatgcaacttcagcaagtagagaagtcaaggaattcattggaagtgtttggctccccaatattgagtatcaggaacaagtctttaagctttgataaaaggttggcaaagacctcttcttgggacgatgctcctaagattgaagaaactgacttctcagcaaaatctggaggaaactacaatgatgctgatagtgatgcaagttcagacttgtttgagattgaaagcctcacaggaaaatccaacaccttccttggtagatcaacatccaatgttgtttctagctgtgccagtcccacaacttgttatgcaccaagtgaggtaagcattgaatggagtgtggccactgccagtgccttggagtactcagccatgtcagattatgatgatcaaaggtcaatagcaaccacaaggagtccaattaggacatccatagtttcctcaaatgctaaaccaaaagtcatcaaagagatgcagaggcggcgtcctagcatgctgttgggttgcaagagccagaaagctgtaggagttgctgtgaatgccttcacaacatatgagaaaacaagttctaacacgaatagtcgttgcaggtcggacaccttccctcaggtgacagagacaaaggaaggaagttttggtgcaagacataagcaacatgcttatgcaacaaccccacttcagcgctcactctcaccacatccttcacaactcttgtacatttag

SEQ ID NO: 16659 - DNA, 261 bp, Glycine max
  Peptide Sequence Number=SeqID_108344
atgtatacggaatacacaactcgcaaggtcctagttatggaatggattgaggttcgtgcttatgcattggttattcctgagttgattgatcttaaagatgacctacaaaagcatttgcttattgaatccgcttgtcccttgaacatcaacaatgcattattaatggaatgtccttcagctcctgccacctccattggaggcactggatcatctgtgataatgatattgttatatctaatgtcaatggagaagctgttgtaa

SEQ ID NO: 16660 - DNA, 2244 bp, Glycine max
  Peptide Sequence Number=SeqID_108345
atggatgatcaaggggtaaggaagggagaagaaattacaccaactttaatgaaggcaattcaagaatccaagattgctattgtgatcttttcagaaaactatgcatcattaactttttgtttacaagaacttgtgaagattatggagtgcttcaaacacaatgggagactggtttggcccgttttttataaagtagatcaagttgacatgggccatccgaaaggaagctatgtagaagcactagtcaagcatgaaacaagaatcagtgaaaaggacaagctgaaaaaaatggagacgctctgcagtgcaacttcttgctcgcaacctcgcacttgcactcttgctttcacactcgcaaccccttgcgcttactcgcactcacaacctcactttctctctcaagctcgtctctctcacgtgcttttctgtgtcatcgtgagagaaaccatcgaggcacatgacctagttcgttatggcggtgctgatgagggttttgagatcgtcggcatactggtacagagttttcttgttagggtagagctcgaggttgtgatatgcttctttgagctcatcgagagtttcgtctatggttttgagtcaattgtggagtgcagttgtcttgcgtttcagttgaatgacgtcgtagtggttggttttgtgagtgatgttgggcttgaaggctatgacaaagaagcagagttcgggatagaatgtaccaatatgggatcattcgagattcaagaggtctctaaaaggatcaatcgtatccctttaggtgttgctaaaagcccagttggcttagtctcgcgtgcagaagggatttatggaacaggcagaattggaaagacaacacttgcatgtgcagtgtacaatttcgtcgctgatcaatttaaaggtctctcttttttatttgatgttagagaaaattccgacaagaatggactggtataccttcagcagacacttctttctgatatagttggggagaaagacaatagttggggaataattattatcacaactagagatatacatcagctacattctcacggtgttgaaactgaaagaacctataaagtagacggattaaatcatgatgaagcccttgaattgttcagctggcatgctttcaaaagtaagcaagttaatcctagttttcaaaacatttcactgagaataatacagcattttgattgccttccattaccattggaaatactaggttctgatttatttggtaaaacagtgccggaatggaattcagcattagatgcttatgaaagaattcctcataaaagtattcagaaaatcctaatagtaagttatgatggcttagaggaattggagaaggaaatttttttagacttggcctgctactttgtaggatacaaacaaagaaatgtcatggccatactacagagtggtcgtggcatcactctagattatgctatccaggtgttgattgacaagaatcaccctcagcccggtgaacgcagtagattatggttctataaagatattgttcgtgtattaaaagagaacaatggatctgacaaaactcagatcattgtgctagacttgcccaaagataaagaggtacaatgggatggaaacacattgaagaagatggaaaaccttaaaatactggtggtaaaaaatacttgcttttctagaggacctagcgctctcccaaaacgtctaagagtgctaaaatggtctagatatcctgaatcaacacttcctgctgattttgatccaaagaaacttgtcatatttgacttgtctctgagtttctttacattcaagaatcaaggaaacatgaaatttaaatctttgacggatatgaagttaagtgattgtaaattgctagaagaagtaccagacttgtctggagcaactaatttgaagaaactgcatcttgataattgcaaggagcttcgagaaatcagaggcctgccaccaaacatagagtatctttctgctatcaattacacattgttgacttccaagtctaaggaaaggttaatgaataaggatcagctatcccaagttcgttcaatctcagtagcaggggtccatctcagagtttctggttttgtaacaagttcccaacaattaatctctgtgtcgtgggatgtttccaatgttgatgaaagtaaatctgctgctcatacacatacagagaatgggtggaactgtgttgagatttcatttgagaatgaaggaaaaagtggtattgaatag

SEQ ID NO: 16661 - DNA, 204 bp, Glycine max
  Peptide Sequence Number=SeqID_108346
atgagttttactgaaggtagggttgtattgattctagaaggtggatctaaccttgatttcatctcaaaatcaatgcatgcctacttggaagttttgctagcagacaagccgattattgaatctgtgccagggacatcattcaattcttatcaagtggatcaacagcagcgggaaacattgccattcgagaagtcttatatgtaa

SEQ ID NO: 16662 - DNA, 174 bp, Glycine max
  Peptide Sequence Number=SeqID_108347
atgtcgcagtctgatgtgaacactgtatgttttgctgatgaaactagccatcttatttactctgggagtgatgatagtttctgcaaggtgaagctcaataaagaggaatttaggtatgatgatggactcaactacaacaagaagtcaaattttgatgcctctttaagcaagtaa

SEQ ID NO: 16663 - DNA, 186 bp, Glycine max
  Peptide Sequence Number=SeqID_108348
atgaataaaggtcatatgatgcatggtgtttttcactctaatggattcgggcatttgctttgtgtcaatggattggaaatgggttcgagtttagctgggaaccagatcatggagttttggaaccgtttgtgctacggattgcaagcaaggttaaccctgttccaacaactttttcttatatgttga

SEQ ID NO: 16664 - DNA, 549 bp, Glycine max
  Peptide Sequence Number=SeqID_108349
atggcagaatcaacacattccaaatctagcctgaaccgtctcgaggacgccattgccaaactcactacaactcaactcatcttcgctgctacccaagccttcgtgcaagtgagcgtggaaattaagcgagcatatgagatcggggaggatccattgttgttgagcaacattttttgtgatgaatacaatgttgatatggatgatcttcagtgcgaaacaccatctaaggaatcccgtgtttctgaaaaccttaacaagataaaggacaggataacccagattatcaacaatggctatgcgtacgaagttgatggtaatgttttctatgttgatgataaatgcccaaattatggtatgctatctagacaaaggctagcacataatacagctggagaaaaagtagtggtaggttcaagaaagtgtcacccaactgattttgcattgtggaaggctgctaaactaggtgagcctagcaaggacaacccttgggatcttggaggacctggatggcacatggaatgctcacttgaaggactcgtatcaccttga

SEQ ID NO: 16665 - DNA, 243 bp, Glycine max
  Peptide Sequence Number=SeqID_108350
atggaagggagcaagaaaatacttacggggaagaaggaagctgctggaaaagggggtgttatgcaagggggttggcgcaacatctttatgtgtgtacttgcgtcactatgccctgtgcagcacctgcgccctgcaccctatgcctatactgaccaaaagtggttgtgccactgcagctgtagcaacccattgcgcatagctgttggcacaacagctgaatgccacatgtcagctccccattga

SEQ ID NO: 16666 - DNA, 3024 bp, Glycine max
  Peptide Sequence Number=SeqID_108351
atgggtactaagagtctcttaatgcttaagtcccacattgattccatcaacatacgagttgtgaatgattttgtttgtgtgaacatgttgtgggcctttgcttctctgcgggtgtttgtttgcaactatgttttctatgagtttggattggtgatcagatatattttcaggtttcttcatttgggagatgcagaagatgagatcattgttcagaaactaaaacacgttgaaaggaaccaggtttctgattctgagattgatgggttccaagaggagctggctagttttctgttttggagtgaagattttcatgaagagacagaggcagaaacagagagctctgtttctttcatggaggttgctcctgaaagtgagaaaagagatggagacacagattgctctgctttttccatggagattattgctcttgaaagggagaaaagagatggagaaacagagtgctctgtttttatggacacccactgtgatgttcatgaagatggggtgaaaacagaggtgcctacagagagctctgtttcagaagagattgactcggacattcgtgaagatggtatgagtaggggaatagaagaaaaaggatcttcttttatgaatagtgacactgacaactacgttactcatgacaataatagggaaatcgaaagagaaacgcaggagcttggtttcatggagactgactcagatgttcatgaagatggtaaaagaaatgatgaagatgaaacagagaactctgttttcgtggagaatgactctgatctccatcgaagaataatggagagagaagaagaagaaataaaagaacatgtttctgcggagattgatactgttgttcatgaagaattcaagaaaattgatgaaaatgaaactgggagtggtgttttaatggagaatgtctctagtgaaactgtaaatgatgatggtgcggaaacagatgaaaatgatgagggctttgttcatggagaagatacaaagatagaagaaaaagaagaagaaacatatgggcatgtttttgtggacactaactctgtaacaaccacaagtaagtgtgagtacttatcaggaaaagatataagtgggttcatggaggaaccaacaacattgaggttcagttttcgagaatttcacatgggtctagatatttcaactgtttctgacaatgcatatgccagtccaaaaattattaccgacaaggaattttcagagtttggttcagagaaaaagcctgtggctcaagcacaaacagaggactctgttcaagaagaggtttcagcaccttctacccatatcccacttcactttgagagtaacatgtttggtggatccgattcatctgatgaagattattttctttacaatgaaaactcagtgacatccgattcggagtcggagtcatctagctcaagtggtttgaactggggcaacagcaacaaaatggatgattcaattgtataccagtttctgggtggtaaaaatgatggtgaaggatttcaacctgagattctgaagctgatgttgagggaagaaagaaaagaagttgtggaggagaagcaatcttcatgtgatggaaaagtttcagaatttaatgctcatgccatttattctggagatgggtatatggaaatggaaccttgcatgaagggtttgaattccttaaatgcacatggttttggtggtaaagaatctggaaaatctggggttaaagatcaaaaagaaggttcacaaaatggatatgtgtgcagtggcttgaagaaaagtgaagaaattaggtgggaagatgaattgagtgattcagaatctgatgagggtgactttgaatgggagcatgatgatttagttgaacagctgaaattggagttgaaaaattcaaggcaaggaggacttgccacaattgtagaagaagaggaagaggcggaggaagaggtggtggtggtggaggaggaggaggaggagcaggaaagagtgtccccaagagtggttgaagatccaaagccagtggaaattgaagagaagcttgaatacgaggatcaaattgatgaaattgataaagtttacaagagctatgcagagaagatgaagaaacttgatatcttgaattaccagaccatgcatgcattaggtctgcttcaactaaaagaccctctaaaattaatttcatttccaaaatccgcaatccaaggtgcaaagcctgtaatctctcagaacttgtggccacgcaaagcttcaaagaactcatcagatccattggtaaagcttgttcatgaactgcagagagatttggaattagtatatgttgggcaagtttgcctctcttgggaaatcctttgttggcaacacaagaaagcccttgagttacaacaatatgattcacaagggtctcatagtcataggtataaccatgttgctggtgagtttcaactttttcaagtcctagttcagagattcatagagaatgagccatttcaaggccctaggctacagaactatgtcaagaaccgttgcgtgattcgcaacttgctccaagttccaggcattaaagatgatagtaaagttgatgaggaggaggatgcaattgctagtggaaagttggcagatatcatcaaggaatcaatgcgggtgttctgggaatttgttcgagcagataaagattatgggaatgtgatctttaaagcttctcggcacaacagaattgatcttaaagaccctatgatttctggtcttatggtggacattaaaacacaactacagaaaaaggagagaaggctcaaggacatagtgagaaccgggaattgcatagtgaagaagttccaaaagcaccatgaggatgaacttgatcatgagcaattggttgctcgggtggggttgagattgatttcaagggtggtaaacatgtccaaattgagaaaagaacagctaatatggtgtaatgagaagttactccgaatcaagtttttgagcaggaagattgttcaggtggaaccttccttcttgctttttccatgttga

SEQ ID NO: 16667 - DNA, 718 bp, Glycine max
  Peptide Sequence Number=SeqID_108352
cttttgatactgcaatatctagcagttctatccatttctcaggaatttgatttcttctactttgttcagcagtggccaggagcatactgtgacacaaagcagagctgctgttatcccaagactgggaaaccttcagcagatttcagcattcatggactttggcctaactacaatgatggatcatggccctcaaactgtgaccctgacagtgtctttgataaatctcagatctcagatctcattagcaacatggagaaggattggccatccctgagctgtccaagtagcaatggcatgaggttctggtcacacgaatgggaaaaacatggtacatgtgcagaatctgagcttgatcagcgcgagtactttgaaacaactctcaaactgaagcaaaaagtaaacctccttcggatcctcaagaatgcagggattgagccagatgatggattttacaccctagaaagcatttcagaagctataaaagagggaactgggtttaccccagggatagagtgcaatagagattcagctcgtaatagtcaactttaccaagtctacatgtgcgtggacacttctgggtcaaatcttattgagtgccctgtgcttccaaggagcaagtgtggtgtcgagggaaggatcccagagtatgaagaacctagggatttgaggtcaaatcctttccaaggtggaggggatgatgcaatcctacccctcaagg

SEQ ID NO: 16668 - DNA, 243 bp, Glycine max
  Peptide Sequence Number=SeqID_108353
atgaaggcttttggctatagagcaagtaactctgatcacaccttatttttgaagagaggaaatgaccaagatgagatttctagtttgcaacaataccatgcatctaaatttgagatgaaacaacttggaaacctcaaatattttttgggtattgaagtagctagatcaaaacatggagggaatcttgtaacttggaggagtaaaaaacaacccgtagtagtaaaatctagtgcagaagcataa

SEQ ID NO: 16669 - DNA, 782 bp, Glycine max
  Peptide Sequence Number=SeqID_108354
agcctaacaccgacaccctctccaatataggaatcgatgcttctttatttctttggatatttcttatggctccttctgataaaaatcaatcggcgaaacgtgattctgggacttcccctgctacccatatgcacgaagcgctcacccttgaacggcttaacggcaccaactatgtcgagtggtcattgaatgcgcagaataagatcagaggcagagaaccatgggaagatgaaaactgcctagtcaagtcttggcttctggactccatgacgaaggaaatcagatccctctttattcgcttagctatggcaaaggacatctgggacactgtgcagcaaacatactcagtcaaccaggatgcgtccagatcttatcaattatatcgtgaggaatgccctaaagatgttgagaagtataacaacatgattaattctcaacgagtttatatctttttggctggcctggattcacatttggatgcagctatgcttgatagtgagtctactatggggactgcctttgttgttaagaagtattctaagaaaggaatccgcaagtgtacccactacaatggggataatcatgtcgtggagacatcttttaaactccatggctatccgaattggcatccaaaaggcaaaactactcccaataccaaggtagacgctacttccaagagccatatttctattgcggctggatttttgaccaagtcaggtatatctaactctgttcttaatctttttgttgttactaggggtagtgagtggataattgattaa

SEQ ID NO: 16670 - DNA, 129 bp, Glycine max
  Peptide Sequence Number=SeqID_108355
atgaggtttggtcgtcaagcgtgtgaggaaaaaggtttggatgaggttgccaaaggtccacacaatgtcactttgcgaaggatcaaggcaggggtggtgcgtggtggtggaagagtcactactacataa

SEQ ID NO: 16671 - DNA, 1440 bp, Glycine max
  Peptide Sequence Number=SeqID_108356
atgtctgaggttgttattaaagactctgccataaagctgtttggtagaacaatttctctgccccgcaacaccaaaaacgaggtttctcctgatgaacctgctcctcctgaagattcatcttcatcttttccacgtgaagtgagctccacaacggaatatgatgctggggataagaaaccatcaaggaaagaactcacctcaacacaagaagacgtggaggcctcacaccaaaccctagaggaaacaaaatctccgacatcatcatcatgcaatctcgagaaccccaagaccccctcaacagaaagagaaacttccattctgaaatccttcaaaaacggacaccaaagcgacacaacaacaacatgcccatcacaggacaaaactccaaagaaaccagacaaggtgcttccatgccctcgatgcaacagcatggacaccaagttctgctactacaacaactacaacgtcaaccaaccgcgccacttctgcaagcattgccagagatattggaccgccggaggaaccatgaggaacgtgccagtcggtgccggccgccgcaagaacaagaacactccctctgtgtcgcattttcgccaaatcatggtgcctgagggccttcagaacggatcattgcacggcgctgtgttgacctttggatcagattctcctctatgtgattccatggcttctgtattgagccttgctgagaaaacaacacaaaatggtgtcctaaatggtttccattcacctaatactaatactattactagtaataaaggggatgaatattatgatactgttatgggttcaactttgagtgaaaagagacacaatgcaactactagtactaactcacatgaaaaatcattggataatcataagagttatcatcatcaaggtttcactcctcaattgtgcttcccaggttcttcttcttcttctccttggccttatccatggaaccctacaaagactccttcagctttttgcaaccctgtgccattctacactacacaagcattctggggttgcatgccaccaccctcttggagtgtaaattaccaatctgcccctagttctggcccaaattcccctaccttagggaaacactcaagagatggggatatcttgtttcaaaaacctagcacagacatggcagaaaataacaacaacaacaacaccgtgttgataccaaagacactgagaattgatgaccctactgaagctgcaaagagctccatatggtcaacactggggatcaagaatgagaagggaaactccctcaatggaggagggcttttcaaggcatttgcatcaaagggtagtagtgatgagaagaagaataaccatgtgatgatggttgaagcatccctatccccggtgttgcaagccaacccagcagctttgtcaaggtcccttgtcttccatgagaggacataa

SEQ ID NO: 16672 - DNA, 183 bp, Glycine max
  Peptide Sequence Number=SeqID_108357
atggcctatctacattataaatggatacaaattccaagcaacaaaactcgcaatagaatcactggtaatatattaaatcaaactgagcaagaggctccatacaaggatgatgagcttgtagggcttcaagttttgctgcaagttgaccccaaatgtcattatctatcttcttgtggatgttga

SEQ ID NO: 16673 - DNA, 792 bp, Glycine max
  Peptide Sequence Number=SeqID_108358
atggaagacattttaaagatggaagatctttttaagaggtggactgagtatcttgacagcacacgatcaagggtcagtcacccaccaccggtaaattgtgatttttgtggaggagagcattgcaatgacgactgtcatctctactccatgaaaaactcttggtggagacatgagttacacccttacaatcaatatgaagaagaaggaactcctaatcttgagggtgtgttcgcagaattcatggcataccatgctagctctataaccaatcaaaactcaatgcaaaaccaggaaattcaggttggcatggcaagagctactccatggaaaattatcggtgggagcaagagttacaaccctacaatcaatatgaagaagaaagaaaaaacaattgaatctactcaacgagcatttaaaagtctcgaaattcaagttggtaagctagtaaaagaagtggctaaatttgtggccacaagagaagaaaactttgtagaggttgaagctcatgaggaaagccttgtagaagagcatgattcaagagaaaaaggtgaagaaaaaagtgaggagaaagcacaacaatggaagaagtgctcacaagtagaaattcaacaggaaagtattctccaagtcaatacccctcctcatcaactgattgtcaaggaagaaaggcatggagaacatgagaaatccataagtgtcattctttccttgatcactagcacttctcttgcaatgacatggaaggtgtttccgaaatacatgagtttcatggagtctctagctaagaggtga

SEQ ID NO: 16674 - DNA, 177 bp, Glycine max
  Peptide Sequence Number=SeqID_108359
atgaggatgagaaagcatatatggcagaactttgagagatccaagcaagggtattcatatgtaaaggcagatcttgattcttcatgtaagaaagccaaacctctagcaatactaaggcagatcttgtgtctttttggccaatccaattttaatcaaaattctccactaccttcgtaa

SEQ ID NO: 16675 - DNA, 219 bp, Glycine max
  Peptide Sequence Number=SeqID_108360
atgacatcaccatgcgattgcaacgctgctaagcttcatgcaatggacctgtcggtggaggacaaggaagtgaaccaaaaagaaaatgctctttgttcttggattcaagcgccacaaccatattacgttcccattgatgaaaattgctttttgtcaatggtggcgaaacaagaacaacgacgggattttctccaagatgaagaaaatatagattggtag

SEQ ID NO: 16676 - DNA, 141 bp, Glycine max
  Peptide Sequence Number=SeqID_108361
atggacaaggcagaggcaattgtggctctgataccaaatgttaggctaaaccttttaacctgtgatgttgcaaactacaaaagagagggctactacccatgcctaccttgccctgttaccatccctgacaaaggccaataa

SEQ ID NO: 16677 - DNA, 579 bp, Glycine max
  Peptide Sequence Number=SeqID_108362
atgggtaaggctcatatgacggggatcaagggagccccgtatcgaagacgtttggatgccctgactgtgattgacgtgtgttggatgccctatggtgagcaccggggagtcagggcctttgacttgatatcatcgttcacccgccagctcagatggggtcagattgtggtgtacgttcgacttgagcgggttcttcgacagtttggctaccttcagacggtccctccgccgccggtttgtgattctttgatgggtgatgatatagatgaccgatggctgcatttttcagaccatttggtgccttcaggggagctttgtgtagttcctggacactacatggagtggttttttcagatatcgcacccatttgtcacgtggatcgaggagactattgcaccgagacacccatttgtttcagtcgcgaccgatctccctacgcattcagtggttcactgcgaaggatgtcaggggatggctcaggatttaggagcgattgctgaggatttggagcgggtcatcaacctcaggatggtgacgccgcagatggaagtcttaggccgcgccagagacgccgcatag

SEQ ID NO: 16678 - DNA, 585 bp, Glycine max
  Peptide Sequence Number=SeqID_108363
atggctcaagtttgtttgctcttggtggggcttctcacaatgttctcctctgcctatggctatggatatggtggtggctgggttaatgcacatgccaccttctatggaggaagtgatgcctcaggaacaatgggtggggcatgtggatatggcaacctctacagccaagggtatggaacaaacactgctgctttgagcactgctttgttcaacaatggtcttagttgtggctcatgctatgaaataagagcaggaattgtgcctgtgtcctacagaagggtaccctgcaggagaaggggaggcataaggttcacaatcaatggccactcctactttaacttggtcctcataacaaacgtaggaggtgctggagatgttcatggtgtggccatcaaagggtcaagaactgggtggatgccaatgtccagaaactggggtcaaaattggcaaagcaacaactatctcaatggccaaagcctctcattcaaggtcaccactagtgatggccgtacagtggtgtcctacaatgttgcccctgctggttggtccttcggccaaacctacactggtgctcaattccgctag

SEQ ID NO: 16679 - DNA, 771 bp, Glycine max
  Peptide Sequence Number=SeqID_108364
atggtggggtgtaatagtggcaacgacgacgataacgacaatagagacaatagaatggtggcaatgatggtgggtggtagtggtaacaacaacgatgacggaggtgatgacaatggtggtagtggaggcaaaaaagtggtggtggtgacggttgtggtgatggagacaataatgatgaggtgtggtggcggccgcaacagagttggtgaggacaatgatagtgatagtgatagtgataatatgctaatggacagagccattggtggcgccatcgcgattcttggaagtcgtcatcatcgtcttgaactcctcaaagttgacgcaaccgtcagtgtcggaagaatgggtcaatatatacaacaaagcctctatgatttcgccaaaatggttctcatcaacatcttcgctcacccctacgccacggttcgtcatgccgacgctgataaatgggtcgacactcaaattggccactacattggaattggtactcccttcttcttcttcttcttcttcttctcctcccattcattcaaggtgtgcgacttgtactgtggagatgccgacgctgataaatgggtcgacactcaaattggccactacattggaattgttcttcttcttcttcttcttcttcttcaattctctcttccattggagcacgctattgagctcgttggcggagatcttgccgttgccgttggcttcgaagcggttgaaaactgtctcgagttcgttcatgtcttcaaagtagagaaagaatttagcttttga

SEQ ID NO: 16680 - DNA, 657 bp, Glycine max
  Peptide Sequence Number=SeqID_108365
atggcgtatgggaggtcgtacctgcatatgaggtgtttccagggcctatggcaatggtcccagtatgtccattccccacatggcgaagggctaaatggagcttggactatagagattcttaggaggagtgcacctcctggtaaagtcgagggcatcttccttgagtgtcacccagtagtagccggcttacaccactttggagggggtcatccagtttggttcctcctcttttctagtcataacttctcaatgtctatggtgggagtttggagtgtctcctggatgatagtcttgaggtgctcggccttcttggtgttggctagcttggagagtaggtctgctctagttttgctttacttgggtaacattgtaagggccttcaaggatgattcttgccccgcttcattttacgtaggacgcaccgtcaacgtaaaggttccactagtctgggtggttgtcatttccagccaccatccttcctgtgagttcaggctttcacaaaacctgcttgatggggtagttcattttgactaccacttgatgactctagaagtagggcttgagtcgtcaggtcaagcacttctcggcgtcatggagtatacggttagtgaaatggatagggagttggtgcttccctttctcttgtacgaaggttaa

SEQ ID NO: 16681 - DNA, 347 bp, Glycine max
  Peptide Sequence Number=SeqID_108366
ctcctccttccgttggctcatggtggttttattatccgcattgtggtggtggtttgttacctacattgacttcgtcattgtcatggtgggtgttacggtggcaacgacgggaagatggtgcaaatggagaaaaagaggacacaaaggataaaggaaatagtgtgttgcggatttgcaatactagaatggaggggtgttgggtgggggtgggacgcagatgtattgggtggttgggtagtttttgtgtctgtttaggtgttttaggaggtgcaggaaacaaagaagaaggtactggaagtgaaagccatggtttgagcaaccacatggatgactgggttctgctataa

SEQ ID NO: 16682 - DNA, 1086 bp, Glycine max
  Peptide Sequence Number=SeqID_108367
atgacttctcgcaagcgccgtgacgtgcccacaccaggggaagcgtccaactgggacttttcccgctttacatccgagatcgcttggcataggtaccaagacaacattcagcttcggaacatccttccgaagaggaatgttgaacttgggcctggtatgtttgatgagttcctccaggaattcaggaggtgcagatgggaccaggtgctgactcaactaccagagaagaggatcgatgtggctctgaggaccacagtcccagattttgcagggtgcgaggacaggtcgttcactttgacgctgacacgattaacgacttcctcgacaccccagtcatcttggaggacggggaccaaatacctcagcactcaccccgattctgacaccatcgctgccacattatgtactccaggggggcgttttgttcttaatgccgatggtctcccctggaagctgctgaggaaggacatgacgacactcgctcagacatggagtgtcctctcttattatgatctcgcgcccacttctcacacatctgatgttaatcttgacagagcacgcttgatctatggcttgggggtggtttctgataccctgatatttgagtcactcagccctgcgatcaacttggcctacgtgaagaagaactgctggaaccccgctgatccatcgatcacctttccagggactcgccgcacacgcaccagagcttcgacatcagcatcagaggcccctctttctacccagcctccgtctcaaccttcttctcagagaccgcgaccttcacctgcctccacctcagcatccctaggcatgcatggtcagatgctgaggtccattcacgttggacaacagctcatcatggagaacatgcataggctatccttacacctgcagatggacccaccgctcatcactccagaggcttatcgtcagcaggttgcctggccaggagaccagccctccactgacaggggggaagagccttctggagccgctgaggatcctgcggtcgatgaagacctcattgctgacttagccagcgctgactggggcccatgggcagacttgggtggaggcagttga

SEQ ID NO: 16683 - DNA, 582 bp, Glycine max
  Peptide Sequence Number=SeqID_108368
atggctttttctccacttcgctcaccacttcatttccccgagcgtccacttttcacttccattcgccccattccaaaccaaacattcatctccaacaaccctcaccgaacaccacgaaccacactctcactcgctcccatcaccctcactccatcactcaccttcgcctcaaggtccacacccacaccctcaccctcctcgaacgacaacattgtctctaaagacctcattcacgcattattctgcttcgtcgttggtttctccgcactcgctgcattccacgctcctcctcctgcatttgcaattgcagctccatggacttattgggcaaagagaggcaccgtggagaaagagagagccaagagtcaccgatactcagactacaccgataggctgcttgagacgatgtcgtttctgttgaaaaccattgacgaggttcagaacgggaatggcgacgtgagcgaggcggaggcaacgctggaggctgtgaaatcgaagaaggaagggctgcggaaagagactaatgggaggctctaccgacactgtggaaacggtccggggagattgtcgacgagatattga

SEQ ID NO: 16684 - DNA, 1107 bp, Glycine max
  Peptide Sequence Number=SeqID_108369
atgaagaagatccaaggcctacaagctccacatggagcttacatcattgttgatgctatggaaaagtacaatatgcacttggctaattcaatcatggaaagaactgaagttgcttgcagagacttgagcactactaatgtaatgattttgcaaatccatatggagagagtggttggtgtagaacatgccaagaatgtgcattttgaaacaacatggcctgagatatgggaggatacaaatggacaagttgacatatttgttatgggaataggtagtgatggcacagtctttggggttgggcaatatcttaaatccaaaaatcctaatgttaagatatatgaagtggagccaagtgaaagcaatatcactactaaaaaaattcttgaaccttctcatttcgagaacatcaaggtctccacctccttctcattcgtcaccgcactcacctcccctttccctccctcaaacgcacagtttcaagaacccaacggtgcaacccttttaggtccactcctccaattcctacatgagaccgtgctgattattgtgactgaaactggctggccgagctccagcgccgccgctaacaagttcaacgcaaatttatggtatgccgagatatacctcaaggggctcgtgaagcatcttaaatctggaatgggaacgcaattgctgaaagacggtgtgacagaggtttttgtttacgagatgtttgataaggaggaaggaacaacagggaggagctggggggttctcttccctaacagaactgcaaagtaccactgcgtcgatttctcgtgctcctcggttgcttctgggagtcttcatatcgcggtgatgatcatcatcttcttcttatcgcttttgggaatcattgcagagtcgcaaggggcagattcctcggaccatgtatacaccattgtggaaaacatggctgagacaagtaagaatggagccagtactggttgtgctcaggaacttctaggaggtgaagaggaggaagagaaatctgtggtatcggtggaaaatcaacttcgtaaggaaatgactgtatatgagcaattcttgatggctttcattcacatgggggctgggaaatctatttaa

SEQ ID NO: 16685 - DNA, 162 bp, Glycine max
  Peptide Sequence Number=SeqID_108370
atgcaagaacagctccatgtggagcttgtaggccttggatcttcttcatcaatggattcctttgtttcttggaagatgaatggcagcggaatggagaaggaaaagagagaggaaatgccacttcaaggagaagatgagtctagaagaagttcaccaccatag

SEQ ID NO: 16686 - DNA, 523 bp, Glycine max
  Peptide Sequence Number=SeqID_108371
aaagcttcaaggtatgtgtggaggaggcttgggagagaataaaggttcgaggttggagaaggctttcgacggccaacgtaaaactttgtcgaatctctatgacatggatcaattacgtaataatgtgaatgctaggtcgttgcccggaagcaacgcgctgtatggctcgagtacagtgtcaaaagagcaagggccgctgcatcgccgcccggatgtagtgaaaagtaagcaagggttcccacattttcgtgaacgggtgtgggtaaagaagctagttcacgacaggaggattcgctttggtacatggaatataggcacacttactggaaaatctatgaaaatagtggatgttatggtgaggaggaagatcaattttatgtgcctacaagaaactaagtggacaggtgaaaaagcgaaagaattagacaactcgggatttaagctgtggtatacgggaaaaatcagattaagaaatggggtagggattattgtggacaaggagtggaagaaggatgtcatggat

SEQ ID NO: 16687 - DNA, 222 bp, Glycine max
  Peptide Sequence Number=SeqID_108372
atgggtgatcaagccacaaacattttccaccaacttcagtgttttaaaggctacttggacgtttcaacttttgaaggctcgcttagcgagattgactcgctaagagagaggtttcccaacacgctaagcgagctgtatgcctcgcttagcggatgtcactcgcttagcggatgtcactcgctaagcggatttgcctcgcttagcgagacatcaactacttga

SEQ ID NO: 16688 - DNA, 480 bp, Glycine max
  Peptide Sequence Number=SeqID_108373
atgaattttgcagcgagaaagcctgtagaattcaccccaattccagtgtcttatgctgacttgctcccatgtctacttgataattcaatggtagcaataaccccaaccaaggttcatcaacctccatttcttcgagaatacgactcgaacgcaacatgtgcttgtcacggagaagccccggggcgttccattgagcattgtagggctctgaagcgtaaggtgcaaggtctaattgatatgggctggctgaaatttgaggagaatcgcatgattttcaactttcaccggaagtgggtgcaagccattggtcagtttgctcaaacgacctatgctcctgagtttgggacttccaagaccgttggtgggggtgtcgtaaaacaacgagaatcctctacaacaagagacccatggtctcttaatccctttttagaaataagaagaagagaagaagaggcctctcgtaaaagaggtagattgtaa

SEQ ID NO: 16689 - DNA, 420 bp, Glycine max
  Peptide Sequence Number=SeqID_108374
atgaaacatggagctagtcaagctgctctttcaaggttaggagtgaagcagcacagacactcagtggatgagaaatttgatgaccttgacctcttagagacagaatcacttgcaggctttatgctaatattggaatcagctaaacccaggaaattctacttaacaaatgttaaaatagttatttccttcaacatccagaatattcagatatattggacatttgtttcccttgtttctacaatcacacaagggaagctcttattcatggtcataagtatgatatttgggaatctagaccctataatagagacataccttcagccaattggttcaacacttggtgtacaagagaagtatgttgcaagtcctttggcagataatccaacagtggctcagattacaaactggaacgaaacataa

SEQ ID NO: 16690 - DNA, 162 bp, Glycine max
  Peptide Sequence Number=SeqID_108375
atgaatgaaggcatgaagcttacctcgggtggcagccagaggcaactcagagtgggattgagaaagaagagtcacgatcacgagcaatttgcggcagttggtgctcaggcagaaggagaaaggagaaacgatagggttttagtgcgtgaggggatgaagtaa

SEQ ID NO: 16691 - DNA, 450 bp, Glycine max
  Peptide Sequence Number=SeqID_108376
atgggcgaagatcaggagatgcatgacagtataatgtctgaagaagttggagtcaatcatgaattggccaagtcattagttggatatccatatgctggtcgatttactaaggatgaaaagattattattgctaatatgacaaagtcaatggtcaaaccaagaaatattcttctaacattgaaggaacacaatgctgccaaagaaaagaaggcaaaagctgctgatgacttgcttagtgagatggatccgctcagcgagatgcatccgcttagcaaggcatctagctcgcttagcggatgggaaaccctagaagaggataagacaaagatctgctcacccagtgcacaaccagctcgcccaacgaggacgttatctcttctcacgctcagcgcgcccactctcgctaagcgaaaattcactaacttgcgcttagcgagatatgctcgctaa

SEQ ID NO: 16692 - DNA, 336 bp, Glycine max
  Peptide Sequence Number=SeqID_108377
atgtatgattttatgtctctatacgcactttggctttttgttgatgccaaagggggagagaaagttgcgattaaatcaagaactcatataattaagtttgtcatcatcaaaaagagggagattgtagaagcaagtttcatgatgatgaaccaagcaattttgatgatgccaaaagcccaagtgattgattcaagacttcaagatcaagcatcaagaacccaatccaagattcaagattcaagagaagaaatcaagaagcaacaagtcaagacttcatataggataagtattaaaagattttttcaaaaaccaaatgttggatcaagtggcctttga

SEQ ID NO: 16693 - DNA, 231 bp, Glycine max
  Peptide Sequence Number=SeqID_108378
atgtctgtggaaggagaaatactcatcgcacgtagacagtggaatgaaggcttcaatccctgctccttctctctaacgtttgggaaccctaacagagcaaccagaggaggagctctagagagcacgataaatgtcacaattgataacggagaatgcttgagcgactatatcgaggtaagggatgagtttatcgcaattggggttagaatgaacaagtgtaaggattcttag

SEQ ID NO: 16694 - DNA, 237 bp, Glycine max
  Peptide Sequence Number=SeqID_108379
atggcagcggaatggagaaggaagagagagagaagacaccacttcaaggagaagatgagtctagaagaagctcaccaccataggaggtcatggataagagcttggaggaagaggaagaaggagatgaatgaagggagagggagaaaagagcacgaaattttgtgctcaaaaagagctctgaaatctgaacccactaatccaagatcaatttcaagattctccactaagtgtgtttag

SEQ ID NO: 16695 - DNA, 423 bp, Glycine max
  Peptide Sequence Number=SeqID_108380
atgtgcatcgtgcgtaacaacaacgcttgcgtgtgtgttcaggggagacgcaatctgtgggatatttcactcgctctggcaaacacggtggtggactctcgctcaatctctctcgcagacgcaaacgcggagctttgcttcgaagctttctctcttgctctctcttttgctaggttatcaagtgtgaatcatatgggggttcgttttgcatggaagctgctaacggtgttggcgataaagcttgaccctccattgccattggcgttacaggacgtgacgtggacggtaccgccatttccactggcgatacgtggtgacgtggacggtactgccattgccactggcgatacaggccacggtcacaactttgcagtgtttagggctacagctttgcagtgtttagggcaacagcatgcagagtag

SEQ ID NO: 16696 - DNA, 621 bp, Glycine max
  Peptide Sequence Number=SeqID_108381
atggcgggactgatccacgttgcaaatgtcccgccattggtattggcgggttgccctgtcagcagctttctcactagagctagtggcggcatactttgtaccgcagttggtgctggcggcacccagccacgaacctttaaaacagatgtgaaaatactagacaatgaaaccatcactgttgatggtaagcccatcaaggttgtttcaagcagggaccctcttaagcttccttgggctgagcttggaattgacattgttattgagggaacgagagtgtttgtggatggccctggggctggcaaaaacatccaagcaggtgccaagaaggttattatcactgctcctgcaaagggtgctgatatcccaatttatattgtcggaataaatgaaggggactacactcatgagacctctaacattgtaaggggacggtgtccttggatgctatgctcaccgcaggtcatgcatttgaaatcaagcgattacatggagctggaaacgctctgcatgctttgtgaagcaggctttctgaccctagcaatgtgctacacagctgggatccaactctcgttaatgcttgtacttggtttcatgttacctgtgactccagaaatctcgtga

SEQ ID NO: 16697 - DNA, 270 bp, Glycine max
  Peptide Sequence Number=SeqID_108382
atggacgaagatcagtggatgtatgatagtgtaatgtttgaagaagttgatatgaatgaccaaaatgaagatgaagctggtgtgaatgaagaacaagtgtttgctacccatgatgatgttctgcattgggctcgatctgttacttatgaaattggatttgtggcggtgattatgagatcaaacataaataatggtattagaggaaggaccttatttgttttagttagttgtgaaatcagtggtcagtatagggctaagaagcaggatttg

SEQ ID NO: 16698 - DNA, 282 bp, Glycine max
  Peptide Sequence Number=SeqID_108383
atggagtgttgggaggggggggacaagcttcaaacagagagaatttgggggagaaggagggagtgggggggttggggtggggtggggtggggctttaacgttggctgggggggggtggcgcctggtcccgaggcgcctagggtcgcgcctggtgcaggggcgccaccggtcgcgcccagtgccagggcgctacccgtcgcgcctggtgcaggggcgctacctccctgtgccacgtgtcgcgtgcacagtggaggcgccggggtggggggcgctttgcaataa

SEQ ID NO: 16699 - DNA, 312 bp, Glycine max
  Peptide Sequence Number=SeqID_108384
atgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggctaa

SEQ ID NO: 16700 - DNA, 267 bp, Glycine max
  Peptide Sequence Number=SeqID_108385
atgttggatcaatttcattcgtgcatgcaggattctattgaaaacattattgatgtcaaagcggatgataattgtggttatcgggcaatagttgcgttattgggtatgggtgaagaattgtggtcattggtgcatacccatctgcataaagaactgacaagctggttcgaagagtatatcaacctggttggtggcatagagagatttgaggaattaaagtgttccctacttgttgacggattatctatggttaccatggacaagtga

SEQ ID NO: 16701 - DNA, 534 bp, Glycine max
  Peptide Sequence Number=SeqID_108386
gaaggaagaactggggttttgtcctcatgcgaaggattctcaattgttcccttaatgggaacaaggggttgtatcaattacaaccccatcctcgccataagacaacttggctaccccatgagaggagcgccatcagagaaaagcatcatgcctttcattgttgggggtttcagtgaccccaatgcaagagtacttcaaggagctgcaagagaggaagagactgaaactccagaggagagtgaggaagtgcaaaccctaaaggcggaacttcaaaaagcccaaatagtcaaagagcagttcaagtcaacggccatcaattacaaggaaaagctaagcctagcagcgactcatgagcaaaggctagaggacgagtacgccaaggtgtcaatcctacaagcggaaagggaagctagggaaagggtgatcgattcattgcacagagaagcgatgatgtgcaaaaataggttcgcctttactttgaatgggagtcaagagctcccccgactgctagccaaggccaaggcaatgggggat

SEQ ID NO: 16702 - DNA, 180 bp, Glycine max
  Peptide Sequence Number=SeqID_108387
atggtcgggactgatgataggaataaagagaaaataaccacttttgacatcatgggggagaggagactttcgttgaaacttctgcttgctgccttgaatggaaaggattctgcagtagttatgtgcagattttgcaggctcatgggtactaccactgctgagttgttgttgaatcggtaa

SEQ ID NO: 16703 - DNA, 693 bp, Glycine max
  Peptide Sequence Number=SeqID_108388
cctcactatgatactcatagattcacctctgaggacgcctggaaccgctacgctgacaacgttcttgtccggttcatccttctggaaagttacgtgaagctctttgtcacagagtttgatgagttcaggacagagctagtcagaagtaactggcacaagacgctgaccaacctcatggaggggagcatagatgtggctctcgtgaaggaattttatgctaatctttatgtcccgggggataagcctccaaagcaagttagggtcagagggcatttaattaattttgaggcggattccctcaacactttcctggagactctggttattctagagccaggggagactcttcctacttactctaagttctgcaaactaagaccagaccctcaggagctggctgcccaactttgtatccctggtaggggatttgttctgaatgctgagggcctgccatggaagttgctgaggaaggacctcactactctagcgcagacttggagcattctgtcttatttcaaccttgcccctacatcacacacttctaatctgaacttggacagggcaagcctagccattaacttggcttacataaagaagaacagctggaacttggacgacccaacggtcagctttccagggacccgtaaggccagggctagaggatctgagagtccatcttctactactccctag

SEQ ID NO: 16704 - DNA, 192 bp, Glycine max
  Peptide Sequence Number=SeqID_108389
atcatggttaggaccagaggattaggtcgtgccttaggtcaagttactggcagaggtgtgggcagaggagatcgtgatgattccgatgatgctccgcagcgtcgacggcctactgcatccgcacggaggcagcgagtcgctgtgactgcggatcacatcgatgagccagtcatccctgcgccagatgtttag

SEQ ID NO: 16705 - DNA, 621 bp, Glycine max
  Peptide Sequence Number=SeqID_108390
atggccgcaacgtcgccacctggaacgccggcggcgccgcctcgtcagggcgcttccaatatgagtattcggaggccgagctggccgaactggcgcgccgcttccaggaactggcgcaacggagcgcgcaggcgcatgcggtgttcaacaccaacttcgaggaccagggcatgcgcaacgccgcggccttcgcggcggcgctgggcggcggacaggaccgcctgggctgaggccctcgcgccgtgtggtcgcggcgcgcaggctgcaagcgccggcagcccgccaccggctttcaaggccctcaggccggctgcgccaccagcgcgggcgccgcgggcgtcatgcgcgccacttcggccaggctttccagcagcacctcgaacttgcgcgcgatgtcgtgctccggcacgcaggcatagcccagcagcaggccgggccggcggccttcggcgccgacgtagtagcgcgacagcgcgcgcgtcagcacgcccttgcgccgcgccacctcgaccacccgcaggtcgtccaggtgcggcggcagcgtcagcaccaggtgcaggccggccaggctggcgtcgcggtgcagccagtcgggccccaggcgccgttcgatcaggttga

SEQ ID NO: 16706 - DNA, 519 bp, Glycine max
  Peptide Sequence Number=SeqID_108391
atgtccccacgtgcttcccggtggttgacgtcgaaggcgcacatgaagggaatcacaggagcaccttacagggcacgttgtgatgctttgaccgtcacagatgtgtcctggttgccgtacactaagcatcgagggcttaggacctttgatttgatttcatcattccagggtcagctgagatggggtcctatggtggtcacagctcgaccagagagggtggtacaacagtttggttacattcagagcatccctccgccgtctgttagtgctcgattgtcacatgatgatatatatgacaggtggatgcattttgcggagcacgtactacctgtgggtgagctttgtctagtgcatgggcatgatgattacgacggatatgaggcaattgcacagaggttggagcgtgtgctcaaccttaggatggtcactgcaggcacaaagttatatgagattatgcaggattgcctgacgatcgccagagggggagccagtgctgatggaagtgttagggctcgttag

SEQ ID NO: 16707 - DNA, 204 bp, Glycine max
  Peptide Sequence Number=SeqID_108392
atgttccctcatgggaagatgcccaggaaatgggtttttagacctgaccttattccaacataccaaacgccactaatatatgtttttattctttttataggtgttgagggaagaggcccagagtttcaagaacctttggatttgaggtcaattccttttcagggggggaatgatgcaattctaccccccaaggggattggatag

SEQ ID NO: 16708 - DNA, 273 bp, Glycine max
  Peptide Sequence Number=SeqID_108393
atggagggaggcataggtcccatactagacctcactcccaaagaagagaaaattatagagggtctcaagagtgaagagaataaagttccattggctacccctagcttccaagcatatgccctccattggtggactccccttgttagggaaagaaggattcatagggatcctctagtagagtattggaatgatcttaagagtgcccttaggaacaggcacttcccctcctactatgaaagggagcttatggacaagctccaaaggcttcgataa

SEQ ID NO: 16709 - DNA, 691 bp, Glycine max
  Peptide Sequence Number=SeqID_108394
atgtctaccgaccagcaatttccaacacccaataatttagggatcgcagtttattcaaataatgcagaagcaattggtaatacacctttagttcgtatcaatcgtttgattaaaactgatgcaactatattagcaaaagtagaaagtcggaatcctgcattttctgtgaaatgtcgtattggagcggcacttattgcagatgcagaaaagcgtggtgtgttaaaagaaggcatgcatattattgaaccaaccagtggtaacacggggattgcattggcttttgttgcagcggctaagggttacccaattactttaactatgcctgcaagcatgagtcttgagcgtagaaaagtgttaaaagcactcggtgccaatttagttttaactgaaccagcgaaagggatgaaaggtgcagttgatgaagctgtgcgattagcagttgaacaaccagatgtttatttcctacctcaacaatttgaaaacccagcgaatccacaaatccatgcggatacaactggtcctgaaatttggcaagcaacaggcgggcaagtcgatattttggttgctggtgtaggtactggtggcacaattactggtatttctcgttatttcgaacaagttcaaaataaacctttgtactctgtagccgttgaacctgctgagtctccaattattactcaaactagaaatg

SEQ ID NO: 16710 - DNA, 330 bp, Glycine max
  Peptide Sequence Number=SeqID_108395
atgaccatgattacgaattcgagctcggtacccaagaatgtgaagggcaaatgtaaatcgttaattggtcaaagaaatgcttgggaatatgtcatgaatgcctgggaaactcttgttgattgtccttcggagcagcagtttgatgagtacttgaaaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16711 - DNA, 711 bp, Glycine max
  Peptide Sequence Number=SeqID_108396
gggttgcatcattacaatcccgtcctcgccataagacgacttggttaccctatgaaaggggcaccatcagaggaaggcctcacaccttttattacacgaggtttcaatagcaccaacacgggggtgcttcagagggtccacaaggcatgggaaatatcccaaaggaagtacaaggaacttatgggaagtagcaacgggcccatcgacagttaccatatgtggttgaaagcctacgcacaagatctggattggctcctgagtttgaggaacactaagggggtggagattgaaactccagaacaagacgaagaggagaacgccgaactaagagacgtcaatatagcccccaccaaggccttggagcaagagaccaagagtaacagcgagcttaagctccgaagagaggaaagggaccaatcgcgagtagacggtttgattccgaaggatgaattgagggtttgcctaaggtccaagaagagtttgtctcagtggttatgcgagaccaaaacaaacatgttagccatcatcagaaagtaccaagaagaattaaatctagccacggcccacgagcacaaagtcgcggacgaatacgcccgagtgtacgcggaaaaggaggctagaggaagggtgattgactcgttacatcaagaagcaacgatgtggatgaaccgatttgctcttactttgaacgagagtcaagaactcccctaa

SEQ ID NO: 16712 - DNA, 201 bp, Glycine max
  Peptide Sequence Number=SeqID_108397
atggcattgtatgcctatggacgcgaacccaagatccctggcccagattggcgtggcccaaccgtaggagctgcagcatttttcagtgcccaggaggaagcaggatatgggcatggaggcggtttggccattgagccaaccaagcgaggccaggcggcccaatggctgtttgctgccaatttaaatggcatgagccaataa

SEQ ID NO: 16713 - DNA, 582 bp, Glycine max
  Peptide Sequence Number=SeqID_108398
atgggtaatttctcccaggacaattggagatgggatttgcagtggaggagaaatctttttgatcatgaacatgacttggctgtgagctttatggaaggcattacatctatatgtattcagagaaatgtgaaggacattatgatgtggaaagctgaacctaacggtgtgtactccaccaagtcagcttatagcctaatgctgaagctaaatgattccggttcacaagacagacaggctcccaccaaagggaatctgttaaggagacatgtggatattcaagatgctggttgcccactctgtggccaagggcaggaggaagtggggcatctcttctttaattgtaaaaggacaataaatatgtggtgggaatcaatgggatggatcaaggctgtaggaccccttctagcctccccattaaatcattttgttcaattttgtgttgggtttgggacaaacacaaatcagagtagatggagtgcttggtgggttgctctaactagcattatatggcatcacaggaatcttctgattttttggtgggttgctctaactagcttggggttttttggagggcagcactag

SEQ ID NO: 16714 - DNA, 123 bp, Glycine max
  Peptide Sequence Number=SeqID_108399
atgaagaaaaaagtgaggagaaagcacaacaatgggatgagtgctcacaagtataatttcaacaagaaacaatgtgcgctcaacgcgcaagtgcaggctcagcgcacatgggcaactggctaa

SEQ ID NO: 16715 - DNA, 207 bp, Glycine max
  Peptide Sequence Number=SeqID_108400
atggctcacttagcgggccaattctcgcttagcgcaattccctatcgggttggaattgcacttaatgcgccctttgcgtttagagagacaacaaaagttgttattatcaaaatcccaactaactcccttgagactcaggctaatcatcataggggggggggggagttgcctatgcacaacagggtgacctcaacacttgctgcctag

SEQ ID NO: 16716 - DNA, 924 bp, Glycine max
  Peptide Sequence Number=SeqID_108401
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgagttgttcttgattgatattggttcttgtcgtgtgcttgttgagttggttgacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 16717 - DNA, 309 bp, Glycine max
  Peptide Sequence Number=SeqID_108402
atgttgctgctgatattctctctcgttttgcaagaatacaacaaaatgaaactttgtaaggtttcctaccaaaacataaagcaggagatgaagttcggtaatcaagaattgctgataaccaaggagttcctcttcttacaaaagcctctccttctggaaaaggctatacaacttttgtcctgctatcaggatcgcataaaggtgtttataccaatttcaaagacctttgcctcgcaaaggagggtattcaaagcccaatctataaaggtttctattcaagggaagaagcagaaaaagcccttgaattaa

SEQ ID NO: 16718 - DNA, 483 bp, Glycine max
  Peptide Sequence Number=SeqID_108403
tttccattggtggtcccgtgaagtatttggagattcggtggtcccgtgttccgtatttgaagttttgttagtggttgttcttcctatttcgtcggaggcactgaggcccattccggaagaagtgtttctggaaaacacttccggaagaacttcttccggaatgggtctgagtaacttccggaagaaggtctcctggaagttactgaggcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 16719 - DNA, 644 bp, Glycine max
  Peptide Sequence Number=SeqID_108404
atgagtacaaagaaagcagactttatctggttcaatggagagatggttaagtgggaagacgctaaggttagcgttatgtctcacgcactgcattacggcacctctgtgttcgaaggcgttcgctgctacgactcacacaaaggtccggtggtgttccgtcaccgtgaacacatgcagcgtctgcacgactccgccaaaatttaccgtttcccgatcaaagccagcgtggatgagttgatggaagcgtgccgcgaagttatccgcgtcaataaactgaagagtgcctatattcgtccgctggcctttgtcggcgacgtgggtctcggcgttaacccgccagacggcttcaccaccgatgtgatcatcgctgcgttcccgtggggagcttacctgggtgccgaagcgctggagcaaggcatcaacgccatggtttcttcctggaatcgcgtggcgccaaataccctgccaaccgcggcgaaagcgggcggtaactatctctcttccctgctggttggcagcgaatcgcgccgccgcggttatcaggaaggtatcgcgctggatacccaggcgctgccgggcatcacccgcgacgccatcatcaagctggcgaaggatctcggtatcgaagtgcgcgagcatgtgct

SEQ ID NO: 16720 - DNA, 672 bp, Glycine max
  Peptide Sequence Number=SeqID_108405
atgccactcagccccgtgatattggttaccttggctgacaacgagttgatctcggtggcctcttccttcctttcgcttggaggtgcatacctccacagaactgcgtggctgtttcggtatggaaacgaaacagatgctgctcttcactcccctcatcgccgacttccagccggcctcgatctatcatctgttgcaacaggccctccactgctaaacatgtttccatataaacctcctaggggtcgtcacatttttcaaaggcttggacctgcacagcctacccgactcgacgacattaactgctccccctccatgattggcgagcgggttcgttttcacgttgggccggtcctcttgaaacgtcagtcatccggcgtctatcaaatgttggaacttgtatttaagagccaggcatttttcggtggagtggcccggggttttccaatggaggttggtagatcttctcgagagatatcacagccatctggagttggccttgggggaaagttcctcattgcattggaaccgccgccaaagtgggcgttgctggcttggcgaatcggggttggagccggagcttggggggcctccctctggatgggcgcggacgctctaggctgtacgggtgctgaattggaagagtccccgacacgagctgagaagctcgagtga

SEQ ID NO: 16721 - DNA, 768 bp, Glycine max
  Peptide Sequence Number=SeqID_108406
atggctccgagaaagctttccacaaagagatctaggaaggacgccgtggccgaagggactagtgccgctcctgaattcgatagtcatcgtttcaggagcgctgagcaccagcagcatttcgaagccatcaagggatggtccttccaccgagagagacgcgtccagctcagggacgacgagtacacagatttcaaggaggagatagcccgccagcgttggacgtcgctggtcactcccatggccaaatttgatccagatatagttctcgagttttatgccaatgcttggcctacagaggagggtgtgcgggacatgcggtcatgggtaaggggccagtggattcctttcgatgtagacgccctcagtcagctcctaggagacccgctagtgttagaggagggccaggagtgcgagtatagtcagagaaggaactgggctgatggatttgacgaggaggccattgctcagctgctatgcataccaggtcaggattttgcccggaccgcttctgggagacgggtgcagatcatgcgcaccaacatgactaccttgacccagacatggatgacgttgctgctcagcaaaatcttgcccagcaatcataattccgacctccctctgccgaaatgtatgccgcctaccaggcaccctctagacccagataagtctaacagggccttgggatttctagcattgatcacgggtctctgccagtcgttcggggttcctgtcacacctagtaaggtgattcgattgccgatcactcag

SEQ ID NO: 16722 - DNA, 261 bp, Glycine max
  Peptide Sequence Number=SeqID_108407
acagccctctctctccctcacgttgcctttctttctccctcattctccattgaagctccagacaaagtttcaacctttggtgcccatttctgctccaaatcgcgaaaggagagcatttttggagtcgtgaagtgcgtggctacgagtgggacttcgaaatttcagcttgagaggattgatggggacccgatgttgagagaaacgaggatatgggctacgtgggagtacgtgagctcagatggaggtgggcaacaggggatg

SEQ ID NO: 16723 - DNA, 186 bp, Glycine max
  Peptide Sequence Number=SeqID_108408
atgacggcttacagcggtcaccagtggtcttgggtggtggaaaatgaggttttaggccccctctacactagggctcgcttagcgcacctctggtcattaagcgcagttccctctctggttggaattgggctcagtgcacctctgggtgctcagcgcaattccctctctggttggaattgcacttag

SEQ ID NO: 16724 - DNA, 177 bp, Glycine max
  Peptide Sequence Number=SeqID_108409
atgtggcatttacctggggtgaaaaacaagagcaagcctgctttgctcaaagaaaagcttactaaggcacctgttctagctcttcctgacttttctaaaacttttgagctagaattgaaaaacttcatagtgccaccctcaactaccccacctatgataaagagctttatgccttaa

SEQ ID NO: 16725 - DNA, 210 bp, Glycine max
  Peptide Sequence Number=SeqID_108410
atggctttaccggccctgtccaactggtattttcctgatgactccgactgtggtttacctgacagattagaccgacctgctgctcaaccagctcgacctgactttgaccgctttctgatcgctggtcaccccagagccttagccctatcctttgctggctggcgggttgccaccttgctctttgctttattgttggatagggaagaataa

SEQ ID NO: 16726 - DNA, 219 bp, Glycine max
  Peptide Sequence Number=SeqID_108411
atgcaggttagctcgcttgggcgagctgagctcgcctgggcgagcaacccttgcacgaaatgggtaaaaagggggaagggggaaggggatggtcttaggcctagggtgcattctgagataatgggggcatgccacattgcccccattcccttgattttcatgcttaaacatgcgcccaccaagtgttcggtgaaatgcctcaatggcatttgcgcatga

SEQ ID NO: 16727 - DNA, 222 bp, Glycine max
  Peptide Sequence Number=SeqID_108412
atgggtaacgaagaaggagtgcaagaacagatgaaggccgacatgtcagctttaaaagatcagatggcttctatgatggaagccatgctaaaaattcaaaaatcaatagaagacaatgctattgcggccgctaccaacaccactagggaagcggagccggtactacagcccgcgatgaactcgggccgggacagaagcgcgacgggcttcaatcggaggtag

SEQ ID NO: 16728 - DNA, 336 bp, Glycine max
  Peptide Sequence Number=SeqID_108413
atgccttacaatagagtcatgaagatatctgggagcttgattacagtgaatttagagtgtctgtcttcaagtgtcaatgggttaatggaaatatcggagtacattaagacaaattgggatttacttagtagacttgcaaaagtgcaagctggacaagtgttttatgtccaagatccatgcgattcgagatggtcaggggttctacaagggagaacaatttctatcagtgaccatattgatggttcgttagttgatgtgagcgagatgccaactttctatcaacaaatgcctttcataaatggtgaagatcaggaggatgttgtacatgaaaattga

SEQ ID NO: 16729 - DNA, 402 bp, Glycine max
  Peptide Sequence Number=SeqID_108414
atggaacgttatctacagcattttgttcgccagaaggcggccaaccacagtgggcaggtgcagatacatgagtgtctctaccgattcagccttagtcagcaagggcagggttctgccctttttgcttgccctactctggagcagtttggggttgaggtcgcatggcctggagactggctcgaggtccaggcaggggaggagcctgcaggatcccccggtgaggcagatgagtcccatatggatgaagagatgactgaccttctcggtttctatagagggagtggagccgcccagacaggggaggaggagcctacaggatcccccggtgaggcagatgagtcccatatggatgaagagatgactgacctgctcggtttcttgggagggagcggagccgcgtga

SEQ ID NO: 16730 - DNA, 416 bp, Glycine max
  Peptide Sequence Number=SeqID_108415
gcatttgatgattgtatacatgtggctgaagccaccactatggacacctttgctctggatgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16731 - DNA, 523 bp, Glycine max
  Peptide Sequence Number=SeqID_108416
cttgcatacggggcagattctgctgctgtggcaatcaccacgacagatcttgttagcaagagtgtggcaattgagtctctggttggaggaactaagctcaaagttggggggatggctaaaggttctggaatgatccacccaaatatggctaccatgcttgggggtaagccaattatgaggattgtggcttcatgtctgcattggatacaggagcaccgagttccaacagcggcccaggtggtggaaggctcctccatgatggacaagaggtcaagtgtcactcaagatgactttggtcgcaacatcagtcgtgatggtggtggtgacaacattgaggtgactttcttgtcgtctacaagagcaaaaggttgtgatggtaatggactattagtctttcacactacaagatccaaaggttgtgatgttgatcatgatttcaagaagtatcttatattcatcatctgtatgataccagacaaagggtttgtgggggcatccaaaacttggcaacaaaacagtggat

SEQ ID NO: 16732 - DNA, 854 bp, Glycine max
  Peptide Sequence Number=SeqID_108417
gcattcggattgaccttgccgaacgagccggtggtgatgccgacgctgccgccattgccgagctcggcgccactgcgggtggtgatgtcgaccaccgcggcggtgcgctcgccgaactgtgctggcaatgccccgtccatcagccggatgctcttgatcgtgcgcgcatccagggtctggccgaagccggagatcgattcgggcaacagcacgccgttgatgcggtactgcagattggcgtggtcgccgcgcacgtgcacgccgccataggaatcctggaccacgcccggcgcctgcagcagcacctggctgagcggcgcggaggcgcccagcggctgcttctggatgtcctcggcggtgatctggtactggctgctgccgatgtccggcgacagtgcgttgcgggcctggtcgagctgggcgctgacggtgaccgtgtcgaggtccttcacgggagcggcggcatcggcggccacagcgagggaaggcaggctggccagggtcagggcgaaggtgatgccgtgcgtggcgaatcatgcgcctgtccggctggccgtgggcatgccgcttttggccgatcgcgatgccctttccccggcgttcagtcatgtgcagacgccgttcgaccctttgcggcagcggtcggctctgcgaccatgaacgtctcccacctccggaagcctgcaatgagcctgtccgccgtttcgcctgtccccgatcccgtcgcagcggccaccggcgctgcctggtcgccggagagctggcgtggcaagaccgcgctgcagatgccgacctacccggaccctgtggcgctggacgctgccctgcacgagctgaagcggctgccgccgctg

SEQ ID NO: 16733 - DNA, 222 bp, Glycine max
  Peptide Sequence Number=SeqID_108418
atggagaattggcaaacagcgctaggcaatgaattcgcggggctccagactcgttggttgaggatgcatgaacgacaatcaattcatggggctctgaataaaagatgcatgaacgacaatcaattcatggggctccgaataaaagtggagaatggagaattggcgaacagcgctaggcagtcaattcgtggggctccagactcgttggtggaggacacatga

SEQ ID NO: 16734 - DNA, 878 bp, Glycine max
  Peptide Sequence Number=SeqID_108419
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtctggaggcctgcgaatttactgcctagcgctccccgcgaatctactgcctagcgctgttcgccaattctccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16735 - DNA, 474 bp, Glycine max
  Peptide Sequence Number=SeqID_108420
atggctggaacattcatcatcatcaaggccactctggatcatggaatgagtcgttttgtgttaactgtctatcgcaatgccattgctgcgattatgcttgctccttggtgcaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16736 - DNA, 296 bp, Glycine max
  Peptide Sequence Number=SeqID_108421
caatccctacgcaaggctccaaactcgaaggtggaggacacatgaatgaaaacacaattgatgggtctccaaaaaagggtggaggacacatgaacgaaaccgcaattcatggggctccgaaaaagggtgagaatggagaattgcacgaagcaatcactacgatagctccaaactcggaaggtggaggacacatgaacgaaaacgcaattcatggggctccgaaaagattgagaatggagaattgcactaagcaatcactacgcatggctccaaactcgaaggtggaggacacatga

SEQ ID NO: 16737 - DNA, 399 bp, Glycine max
  Peptide Sequence Number=SeqID_108422
atgcatagatctcccacaggcaatttagttcctctggacttggagattgaagctacgttgagaaggaacagagccgagaggagaagaaaattacttcaagacaggatagtagcatccattcttgaggaagaaactcatttttctgattcttcatcatccgacttaccatcatcaagggaatccgcgacttatttaccaaaatccgtttccatggctgatgagcaccaccaaagagttacccttgaggactattcaagcagttcagtgccacaattctttaccagcattgcatgtcctgaagtgcaagctcacaacataaactaccctcattctttgattcatttaatacaagggaacttattccaaggattaccaaatgaggacccctatgcacatttg

SEQ ID NO: 16738 - DNA, 211 bp, Glycine max
  Peptide Sequence Number=SeqID_108423
gttaaaagaagaaggaggttcaagcagctggtgtctctctaagcgagccatatgcgcttacgtgttgggaaaccctagaagaggatcagtcagagatgtgcgcgctcagtgcgtcgcaagcttgcccagcgagtcgtttgttccttctcgcgctcagcgcactcagctcactaagccagatttcactaactcgcgcttagcgagcttttag

SEQ ID NO: 16739 - DNA, 516 bp, Glycine max
  Peptide Sequence Number=SeqID_108424
atggcttccatcacggaggccatgctaaaactccagaaaactctagaggataatgctacggcaaccgcctccaatgcagttagggaagcggaaccagtgcttcagcccacgataaacttgggccggaatagaaacccgacggtgttcggtcgaaggtacagtccgcaagcttatccttatggcttgcctccggacttcactccccgtgcctctccggaagatgtgagccaagcccctaccttcgaggggaaacttcctccttatgccgattaccccctgcaagaagacgacgaagaagatacccatctaggccctctgcttcccctcaaggatccatccccccatgaattacctcaaccaaacatagtccgccatgtcccatcttcacccgcacccataaaagaatccgttcccttcacagaagataagggaaagattgatgcgcttgaagagaggctaagagcaatagagggcctcggcaattacccgttctcggatttagcggacctatgtctc

SEQ ID NO: 16740 - DNA, 1335 bp, Glycine max
  Peptide Sequence Number=SeqID_108425
atggggacgaggggttgcattaattacaataccgtcctttccataagacaacttggctaccctatgaggggggtaccattagaggaaggcctcacaccttttattgcgcaaggtttcaatagcaccaacgtcggggtgcttcggagggtctgcaaggcatgggaaatggtgcaaaagaaagacgaagaactttggggaagtagcaatgggcccatcggtggttaccataagtggttgaaagcctacgcacaaggtctgggttggctcccgaatttgagagccactaaagaggtggaggttgaagctccggaagaaggcgaagaggtacaagccctcagaatgaagctcgagcaagcccaagcggtcaaggaaaagttcaagtcagcagtcgctaggatccgaaaggagaatgccgaactaagagacatcaacatagccaccaccaaggccttggtgcaaaagaccaagagggctcgcaagaaagaacatggccggaacaagtttcgaggagaggaaagggaccagtcgcgagtagatggcatgattctgaaagacgaattgaagacttgcctaaggtcgaagaggagtttgtctcagcagttatgcgagaccgaaacaaacatgttggccatcattagcaagtacaaagaagaattagatttggccaccgcccacgagcacaaagtggcggacgaatacgcccgagtgtacgcagaaaaagaggctaggggaagggtgattgactcattacagcaagaagcgacgatgtggatggattggaaagacgccataactaagccggacccaaggcatccttatcacaccagatccaagtctaggatgatgggtgacctagaggaagtacaagaacagatgaaagccgacatgtcagttttgaaagaacaaacgacttctatgatggaagccatgcttggaatgaaacgactaatggagagtaacgcggccaccgccaccgccgctagcacggttgccgaggcagacccggctctcccgactgttgcacaccatcccattctaaacattgtgggacaagggagaagcacactggggcatgtcagcaacccccatccggggtacaaccgaggtgcttaccactacgatttaccacccaactacacaccaccaaccatgcataaagacgcgggtcacgttactcccctcatcctcgaaggggagcctcctcggcatcctgacagggtccacgaggatcctcgagagggcgctcagggagacgtcaactcctactccccatttcccgtggaggggccagcgcccaacacattacctcaacccaacatcacgggagagccttga

SEQ ID NO: 16741 - DNA, 438 bp, Glycine max
  Peptide Sequence Number=SeqID_108426
atgaccatgattacgccaagctcgaaattaaccctcactaaagggaacaaaagctggaagggcttttgtggtattgaacccaagttgttgcttcaaaatgcaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 16742 - DNA, 630 bp, Glycine max
  Peptide Sequence Number=SeqID_108427
atgggagcgcgcaaaacgcaagaagagcttacagactggcgtgaaaggacactatatcgaagcgattgggaggagtatggtcacgaagtttatgatatctatgaagagatatccgagaaccgacgaaaacgaaggcgtcttgacaattcccgggatccttcacctgtcccagccgatgatgaaaacaaccaagcagatggatacaaggttgaaccaaccgctggtgaatatgacgaggacatcaaccctggtgcagatgaccacaaagacatagaaatggacgacgcaaccgccccagaccaaaacaccactatcccccaagatgaagaagatcctgaaatgaacaataccagaatcacacaaacaaccaatcccaaaacaaaccagaaacaaacgaacgaatcagactcatcctcacctaccaacacaaaccttggataccgatcacctatactgacccgtcggaagcgcatacaacccgagcccaaacaggaagaagaaagctcctcttctagttcagatgacgatcttcctgcaacccgagaatatccgtcctcagaacaagacgacggggacggcatgcccctatattcacagccgatgagtccggctaactggcccagcgattga

SEQ ID NO: 16743 - DNA, 279 bp, Glycine max
  Peptide Sequence Number=SeqID_108428
atgtatgagcgaaggaaaacacccttgtcgaccactgtcgcaacctacccttcggcgggagggcgacgcgtgactcgcgggatgcgtgttccacgaaaggaatacgtgcggagtcgccaccaacgtttatttgaggaaaacgtcggaaaaaccggaaaagacgtgatctacgaacttttaagtgaaaggttcgggagttgtatttacgcacggggaagggtgtttccctttgctcctacgtattcctcaatttgggatgagaaaatcagacctacgtag

SEQ ID NO: 16744 - DNA, 273 bp, Glycine max
  Peptide Sequence Number=SeqID_108429
atgcaaggctcacgcatgagcaaacatgaaaacaaaagagatgcttatgcgatgcatgatatgaatgcattttacggacacgagagcccgaaaaattatttcttcttacttgtgcatttgggggcgcagtgccccatgtgtacaattaagaaggtgatatggaccttccggcttcccgtgacaaaggacgagaccaacatacaatgcatgctagagataaaatgcgggagtgacttgattcgcactgatttttggagtaaaaacgtgggataa

SEQ ID NO: 16745 - DNA, 239 bp, Glycine max
  Peptide Sequence Number=SeqID_108430
cttcaataaggtccttcaatggtgattttccaccatggagatgcagtggaaggcaaaggagaagaggagagtggaggcaccatgcactagggaataagccatggaagaaggagcttcatcaccaagaatgtgccttgaataagaagcttgaagaggatgatttaatggaggaaaagaaagacaaaagaggggagcacgaaattgaaggaataaaagagggagagaagtggaactttgaa

SEQ ID NO: 16746 - DNA, 306 bp, Glycine max
  Peptide Sequence Number=SeqID_108431
atgtccaatcaaaagagcacagagtcagccatcaagaatctagaagtccaggtgggacaattggcaaaacaactggcagaccgaccgtcaagcagctttggagccaacatagagaagaatccgaaggaggagtgcaaggctgttatgactagaagcaaaatggtgagcatgaatgaaggtgagaagaggataggtgaagaacaactagtgactgaaccagaaattgacctagtgatggaacctttgagtgagactgaggaagaagtgaaagcagaagatgatcaacagaagaagataccaataatt

SEQ ID NO: 16747 - DNA, 593 bp, Glycine max
  Peptide Sequence Number=SeqID_108432
atgatacctagcgttcgagggctagggaacctccacactgcgcgttccactcgagagttggagctcgagggagagaaagagaaacggcccatgcttaaccacttacgattagctgttattggcatggataaactctaccctactaacaatgcggtggacgtggttgagtggggtcccaaccttcacaggtcagcttggagaggtgcctttgataggactctgacgctcaaggactgttgtagccttgtagataatagccgggagcttatagatattgttgtggataaatatttgcttatagataaaaggttagagataacctattggggagcccagttgctaagggccaggcattcgcgcccttatacccctcaagctctgagccagcttgtgagcgaaagagtagagggtgacgagcttgtcaagcccccaagcatggacaagtgttgtccgatgtcagttgtctatgatggacatgtctttggtgtgtcaggtaaggtgatgcaatcctccaaagaaagggacccatcaccagagccatggctaggagactctaggaagattggaccagcgatgcaggagaaggctctagg

SEQ ID NO: 16748 - DNA, 591 bp, Glycine max
  Peptide Sequence Number=SeqID_108433
atgtcgcgggggtcaggagaccttggggacgtcaggcgagctcctggcagtcaaccgataaaagaacaaagtccacaaagaaaggaggcttgtgtggcggctggccaactatggatcttgagtggtatctggaaattcgcctctagtaatcgattaccaaggatcgtgatggcagcgcagttaatccatgatcgcgtggtgatggagtgcctagagggagtttgggagaccctcgaaggcaatgagaggtgccgattccgtgtcacgattcaactcactgctacttcattggtacatccagaggtaccagcacgcacgcttcagcagcctgtggagtggatactacctacacctactccatatcgactagtggagccagtccaagtgatagaggtgtcatcctctgaagaagaccctgaagaggacctagaggagttacctgctgtggatgctcttaactttccagaggatgatgaggacccactccctgatgtggattctctagaggatatcatgtcagcatctgaggcagactctacggaggagagcagccctggagggacagcgaatagtggagacacttcatcatag

SEQ ID NO: 16749 - DNA, 459 bp, Glycine max
  Peptide Sequence Number=SeqID_108434
atgtcgagccagggggttgtctctgacagcctcacttttgagcgcttgagcccgtttctggagagggtagcctggcctggggctcaaccttctcttcatagggaaggtgaaggtcccacagcccaggaaccccgacaggtacataatgcttcctctgggaccaccattctagagccatttactttccaacaggatgcaggtgaagagcatgttagaccagagactgctgctactcctgaaagatcatttgagggcacctcagagcctcctactccaatagcagacctctcctcaccacagcttgcagctgacccttccactcctgtacttgacataccagaggaccagaccacaccagtcctgacactgaacacctctcctccagctactctagtacttcatttgacagatgaggagtatgctcatgtagaagaaagcttcatgatgaatcaagattga

SEQ ID NO: 16750 - DNA, 353 bp, Glycine max
  Peptide Sequence Number=SeqID_108435
ggctacacgtcctcgcctttagagggcggcacgtcctcgcctttggaggactgcatgccctcgcctttagaggggcgtacgccctcgccttcaaaaggctacatgccttcgctttcagagggctacaccccctcgccttcagagggctacacgtccttgccttcagaggactgcatgccctcgccttcagagggctgcacgccctcgccttcaaaaggccacacgccctcacctttagaggggcgcacaccctcgtcttgagagggctacatgtgatgagaattctgaaactggccaaatacaggctaaaggcccaagtggagaaggatgaaggcccaagtggagaaggataa

SEQ ID NO: 16751 - DNA, 495 bp, Glycine max
  Peptide Sequence Number=SeqID_108436
atgtcaaatcataaaagcactgagtcatcactgaaaaaccttgaggtccaggtgggacaactggccaagcagatagctgacaagtcatccaacagtttcgtggcgaatacagaaaagaatcccaagggggaatgtaaagttgtgatgacaaggagtaagaggtttgttgaggtggagattgaggatagtgttgtatccaagaagaaagctgctggaaagaaaggtattgataaaaagaaagatgatgtgaaagttagagagaagaaaagagaaaaagctgtgaatgaaggtgcgaaagtaccgtatcctgtggtaccttccaagaaggagaaggaccgccatttggcaagatattttcaggaaactggaaataaccatgcccttcggagaagctttacagcaaatgccactctactccaagtttttaaaggatatgttaacaaggaaacacaagtatattcaccaggaaaacattgttgtggaaggaaattgtag

SEQ ID NO: 16752 - DNA, 672 bp, Glycine max
  Peptide Sequence Number=SeqID_108437
atggagggtgaaacaccggaagaagacgacgaggtacaggccctcaagacagaacttgagaaagcccaagcagtcaaagaaaagttcaagtcagcagctgttaggatccgaaaggagaacgccgaactaagagacgttaatatagccaccaccaaggccttggagcaagagaccaagagggcccgtaaggaagaacacgaccgaaacaaattccaaggcgctcagtggggcagtaacagcgagcttaagctccgaagagaggaaagggaccaatcacgagtagacgacttgattctgaaggatgaattgagggtttgcctaaggtccaagaggagtttgtctcagcggttatgcgaggccgaaacaaacatgttagccatcatcggcaagtaccaagaagaattaaatctagccatggcccacgagcaaaaagtggcggatgaatatgcccgagtgtacgcggaaaagaaggctagaggaagggtgattgactcgttacatcaagaagcaacgatgtggatggactggtttgctcttactttgaacgggagtcaagaacttccccgattgctggcaaaggccaaagctatggtagacacctactccaccctcgaggagatccacgggctcctccgctattatcaacacatgatagacttgatgcccatataa

SEQ ID NO: 16753 - DNA, 815 bp, Glycine max
  Peptide Sequence Number=SeqID_108438
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccatgcgatgttgcagaagatgccagcatcgacaccatgttcgctgaactggggaaagtttggccgaaatttgacggtttcgtacactctattggttttgcacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcgcgctatcccgaactacaacgttatgggtctggcaaaagcgtctctggaagcgaacgtgcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 16754 - DNA, 412 bp, Glycine max
  Peptide Sequence Number=SeqID_108439
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatgggccgc

SEQ ID NO: 16755 - DNA, 159 bp, Glycine max
  Peptide Sequence Number=SeqID_108440
atggagatgcagcggaagacaaaggagaagagtctaatagctcttaaggtggttggcccctttcttcttgactcaaattcttcaagggatggcaccaatcctccttccaattccctatatggcaacccacaaacaaggaaacaaagagacaagcaataa

SEQ ID NO: 16756 - DNA, 210 bp, Glycine max
  Peptide Sequence Number=SeqID_108441
atgccatatatcaatatgagggaaaggaggagagtgaagaatcaaccttttatgagatattatagtcatgaatggctaagtgaagattctaatcgagttcctccacatcaagacatggaactcacttgtgaaagagtaaaatgcttcaagaggttctttcttgatgtggatgtaaggaggaaagtgaatattgagtttgccaacttctag

SEQ ID NO: 16757 - DNA, 537 bp, Glycine max
  Peptide Sequence Number=SeqID_108442
atgaagcacttcactgacaccctcatcagtgcccaacatagtaagccagtatacactccgctagcgcccaataccgcaaaaccgccctctccccgcgcgttggccgattcattaatgcagctggcacgacaggtttccccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16758 - DNA, 232 bp, Glycine max
  Peptide Sequence Number=SeqID_108443
atccgacgatgagtcccgtgaaggtactaataccggggacccgaccgtcgatttcgagcaagaagcaagtcagacggagaatgaagaggacgaggatgtaggccttcccccagagctagagaggataaccgctcaggaggaccgagagatgaggccacatcaagaagagacagaactcgtagacttaggaaccggcagtgggaaaaaggaagtaaaagtaggcacgggatga

SEQ ID NO: 16759 - DNA, 327 bp, Glycine max
  Peptide Sequence Number=SeqID_108444
atgtcaatccttaccctcggaagcaaaaagaagagaaggaaaatttccaatcaaagaaaaagagaaagaagatttccaatcaaaggaaaaaaggaagcaaggaaattcccaatcaaagagtgggagaaagaaaaaaggaaagaaagaaaattcccaaccaaagaatgggagaaagtaaaaagggaagaaagaaaaggaaagaaagctcctgatcaaggatcgaaaggaaacagaagaaatatgcagaaaggaaacaatttgcaaagtcaagtcatgacatatctatggttcggaattaggatgaaacacttacctgtgcgagattga

SEQ ID NO: 16760 - DNA, 315 bp, Glycine max
  Peptide Sequence Number=SeqID_108445
aataggcctaactcacaaaaaggtccccagtggagtcgccaaccgtcgcaacgtgcccttttgcgggcgtgcgaggcaaggctcacaggtgcgctttccaaaggaggaaagatgcgcggagtcgccaccaacgaagatattagcacctctcacgtcgacaaaagcggagcttttgctcctacgtaccctccatcgaagaggaaatcagaactacgggaggagcttgccacccagctcgcccaggcgagcaaggttgcttcctctagaagcaaccgccttctagaggaagaaactggaaggcccaagtgggcttga

SEQ ID NO: 16761 - DNA, 135 bp, Glycine max
  Peptide Sequence Number=SeqID_108446
atggtgaaagttggaacctcttacgtgccgatcaacgtctcattttcgccaaaagttggcccagggcttcccggtatcaaacaaggggacaaccaggaatttatttattctgcggaaagtgatcttccgtcacag

SEQ ID NO: 16762 - DNA, 365 bp, Glycine max
  Peptide Sequence Number=SeqID_108447
aacggcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatttcaagagatttactctctggtaatcgattaccagaggatgtaatcgattaccagtggccaaaaatgatttacaacagctattaa

SEQ ID NO: 16763 - DNA, 645 bp, Glycine max
  Peptide Sequence Number=SeqID_108448
atgattatgaggggccaagacatttatagtagccaagatgaggctactacttcaccttcctctagtgaaagtcaagaaacaaaaggggaaaaatccagtgaagaaatttacccccaagaagaaggacaaccattagtggttaaagagaagtgtaaggaggtaagtgtctccaccaagagtttagctaagaaggaaactcattttacaataaagacaaacattaaagaaactttccctcttagacaacctccacattttctcttttgtaaaaagacacttgctagcattgccacacctcgtgggcttgaatttattcctcaagtaaagaagttgttggatgagggtattattaggcaccaagtccctaaaatagctggtatgatgaatgttttgaatggtgcaaccctcttttgtaaaatcactcgtgcacccaacatcttcatggtgtgtgtacatagggacccattaggtagtgatcaagggcttcccatgaaccctaagagagtaaaggtcattcttgagtggcttactccaccaagtgttgaggaaagaattaatgagtttcaagaacctcgggatttgacgtcaaatccttttcaagggggagggaatgatgcaatcctaccctccaagggcattggatag

SEQ ID NO: 16764 - DNA, 423 bp, Glycine max
  Peptide Sequence Number=SeqID_108449
atgagcaggaacaaggaggaagagcacttgtggccgcgtgaatacttttcatcacattggaagcataggcccttttctctgcgcatagctagttcctccagcgtgaggcgtttaaaaggaactgtggaagagttggtacatgccggtgtcggtaataatggaggagtagttaaagatgtagatgttggaggttgtcgagagcttgaggatgctcctgtggtaggtatcaaacccgagatgaaacagcttaaagccatgggagcagtttgcatagcaatcccattggatcctcataagtggttgaagcaaatcgtgagtggagggcgtgaaggaatgcagtccaagacgataattgaccatttcggtgcatccattggaaccaagctaatgcttgtccttccatataaaatgatgcgatggtga

SEQ ID NO: 16765 - DNA, 384 bp, Glycine max
  Peptide Sequence Number=SeqID_108450
gtcagaagaaaatgaagtaaacacaatgaaggagattcttgatacttatggaaaagcttctggagcaagaaagttgtttttagctttgtcaaagattgagtatggacatgtgtcaaccattggtcaactcgtcatctgtctaaggtggggtactatcgcaacctaccctttggcaggagggcgacgcgagactcacaggtgcatcttccaagggaggaaaatgcacggagccgccaccaacgtttatttgaggaaaacgtcagaaaaaccaaaaaggtgtggtctacaaactttaatcgtgaaaggttcgggagttgtttttacgcacggggaaggtattagcaccctacgcgtctgtcacaagggacaacagcctttaaccaa

SEQ ID NO: 16766 - DNA, 633 bp, Glycine max
  Peptide Sequence Number=SeqID_108451
ccgaagccggttgagaaaccgcagcctcagcaggtcgcgcagacgccgcctccggccaaaacgcaaccgcagccgcaacagcagcaggccgcgattccggcgccgaccgggaaagcctatgtagtgcagttgggggcgttgaagaatgccgataaggttaacgaaatcgtcggtaagctgcgttcctcgggctttaaagcctggacatcgccatccacgccggttcagggtaaaattacccgtattctggtggggccggatgcgtcgaaagacaagctgaaggggcaactcggcgagctgcagcagatttctggtctgagcggcgtgggcacggaaatccctacgcaaacgttttctttttctgttagaatgcgccccgaaccggacgacagggcccttatccgcggctttgttcgtgaagcgttatcgctggtgacatggggatgtgccttctttgtcgccagtcattactacacttacctggctgtctggttcacgggctttgaagacgaactggtccgaaatgggattgctatcgcgatattgtttatcgcaacgcttatcgtcggcgctatcgttaactatgtgataggcgctctggtagagaaaaccggtctgtcaggaacagacagg

SEQ ID NO: 16767 - DNA, 403 bp, Glycine max
  Peptide Sequence Number=SeqID_108452
atgtcttacctagcgatcataactccgatccccctctgcctaagtgccagtatgccatccaccaggcaccctttggacccagataagtctaacagggccctggggtttctggcgttgattacgggcctttgccagtcattcggggttcccgtcacccccagtaaggtgatccgattgccgatcatctgggccttcatcgagaaacgctcaaccaccacctcatcaggccgatcccactggatcactgggcatgaagcgttatctatagcacttggttcaccagcaggcagccaaccaccatgggcagagcagtttggggctgaggtcgcatggctcagagactggcctaaggcccaggcaggggaggagcccgcaggatcccccggtgaggcaaaggaggccc

SEQ ID NO: 16768 - DNA, 460 bp, Glycine max
  Peptide Sequence Number=SeqID_108453
atggcatcattcagccagatgcagtcccagattcagtcccagatacaatctcagggacttgcaccgcctcccgagcatttggttggtccctccagtcctcgagtaagcacaaaagggagttgtgttaatccctcaggaaacaatcctgagacgggtgactctgataggtgcgacttgtacatagaagcagatcctgcccgcctggttgccatgggaagagtttatgagggatccattgttgttcataacactcctttgttgcctgaccaagtaaaggtgagtgtggaggaggttacagatgcagatgctccagttcctgtacccactgatgaggtttccttagtggggcagacacttcacaccttccttgcttggccgacacatctggtcaagtctttatcacagcaggtagctgtgtttccggcaaaaccacctccaaagcccgattcgaaggtcgatg

SEQ ID NO: 16769 - DNA, 300 bp, Glycine max
  Peptide Sequence Number=SeqID_108454
atggccggattaagcaaaaaaaagaaatcaacgtacatacggatcagcaatccgtatggccatacgaattgccaatccatacggtattttggaaaattgctgggtgatgaggacatgaccaagagcaagggcaaggttccacttgaaggacttggaggacctatgataagggctagagcaaggaaagccaaggaagctcttcaacaagtgttgtccatactatttgaatacaagtccaagtttcaaggagaaaagtccaaggttgtgagttgtatcatgacccaaatggaggaggactaa

SEQ ID NO: 16770 - DNA, 291 bp, Glycine max
  Peptide Sequence Number=SeqID_108455
atgataacaagcaaaggaacagactctagaagctgctatgttgaatcaggccatctactgcaacaaccttcagacaaacttcttgagttaattgggcctgtgctggtatccgctgaattgctatcaggattcaagtggtttcccttttatgcttgggagatgtgtagaagcaaagcctttgtctttgatgatgatcgtgatgatttgatgaaaatgcgcttctcaagtttaattcaagacaatgattcaagaatacaagatacaacatcaagaagatctctagtattttag

SEQ ID NO: 16771 - DNA, 132 bp, Glycine max
  Peptide Sequence Number=SeqID_108456
atggcactgacatttttgggattttggacagcttgggaaagcagcttgaatgtatggtctgctttgggccagcagcattttggaaggaaggagcaggctgcttttgttgttgctgagggctggaccatctga

SEQ ID NO: 16772 - DNA, 447 bp, Glycine max
  Peptide Sequence Number=SeqID_108457
atgatgatggaagcaatgatgagcatgaggaagatgatggaggttaacactgctacagttgttgttgcgagtactactagtgagatggacctgattcacctgtacagtttcaatcgagtgggtcatccagtctcggatgtagtaggtcaaggaggcgaggcagtggaaaatgcatgtgggcctcattatgttcagccctaccccggatataccactgaagggcatgcatttcctggtgcccccatgccaaaccctccgggggggcctcagtatcaatcaccaccccgacccttgcattttgcgataggaggaaggccttccatagtacttgagaaggataggattgagtatatggaggagaggctgagagccattgaaggaagaggaaattatgctttgctgacatggaaaaattgtgcttggtacccgacatggttattcctctaa

SEQ ID NO: 16773 - DNA, 672 bp, Glycine max
  Peptide Sequence Number=SeqID_108458
atggagcaagcacgctctgtgccatttgttctcatgcattcttctgcgaatagcagccttaaggagttagggcagttgatgggtcagctccagcgacaagcttttcgcaaaacttacggtaaaatctgggacctagccatgatggaagtctccacagaggccatttcctccctcgcccagtattatgatcggtcgttgagatgctttacctttggggacttccagctgtcacccatggtggaagaatttgaagagatcctagaatgtcctctagggggaaggagaccatacctcttctcagggttctatccctcattagctagaatttcaaagatagtccaaatctcagcgcaggaattagaccatggaaagcaagtcagaaatggggtggttggaatactgagaaaatgtttggaggaaaaagcaagaaccttggcaggtagaggcgaatgggccctgttcatagacattctcgcactgttgatctttggaggagtcctctttccaaatgtggatgggttggtggatctagcagcgatcgacgcttttctcgcctatcatgaccacaaggaaagcccggttgtcgctaggctagccgacctatatgacaccttcgaccgaagatgtgagaagagcagtacgaggattgtttgctgtactccagctctttat

SEQ ID NO: 16774 - DNA, 527 bp, Glycine max
  Peptide Sequence Number=SeqID_108459
atggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatgggccgc

SEQ ID NO: 16775 - DNA, 375 bp, Glycine max
  Peptide Sequence Number=SeqID_108460
ggagaagggagacacaaaagaattcaagaggttagtcctttgttcttttggaaaagggagaagggagacacaaaagaattcaggcagttagttcttcgttcttttggaaaagggagaagagagacacaaaaagagttcaggcggttagtccttgtcgaattctttttggcaaagggagaagagagacacaaaagaattcaggcagttagtccttcgttcttttggaaaagggagaagagagacacaaaaagaattcaggcggttagtccttgtcgaattctttttggcaaagggagaagagagaagagtgacacaaaaagaattcaggcggttagtccttgtcaaattctttttggcaaagggagaagagaatga

SEQ ID NO: 16776 - DNA, 873 bp, Glycine max
  Peptide Sequence Number=SeqID_108461
gagactgtattgctgtacgtcgatcgcccgctggaccttgaaaacatcgatgacatccttggcacgattaactcctatatgcgccgacttaccaaactcaaagccatttttggcgggcgcgcctggctggatgaggagttgaacacagccgaaaccctggcggccggcgaagtctatatcgattacgattttgggccgaagtcgccgaccgagcggatcacgatgcgggtccgcattaacaacaaatatgctgtagaggagctggggactggcgcgcatgagtatacgccgccggaactgtcgatcgttaaaacggacctgcgcaccggcgcgcaggacgtcccgacgccgatggatgacggcatggaggcgttaacctgccagatcaagttttacggcatcgatgcggacatgttgtcccgctttggttttgtgactggcaaccgtaaccgttttgcggcttacgagggctatctcagcaacggcggggcgctggggtcgattgacgagattgagggctttgtctcgaagatcacccctgacgcccgggacaatcaaacgctgtcggagaaagcgacaacggtcgaaatcgcgatcaactactacaagcagacccttgaaggccgcgagctgttcgaaatcgacacagagcgctttattcgccgcgtgaacggcgtggatcagctgcgcgccaatacgaaagagatcaagttttactccccgctgaccctcgaagacggcagccagctaacccatgtgctcatgcgggagccgctggtgcgtgaccgtattgagttctcccggatgaaagggaatgacctggagaatgaagtggccatgatcgcgaacctttgcaatatgaacgttgctgac

SEQ ID NO: 16777 - DNA, 444 bp, Glycine max
  Peptide Sequence Number=SeqID_108462
atggtgaaagttggaacctcttacgtgccgatcaacgtctcattttcgccaagttggcccagggcttccgcgtgtacccgaacaggcccaggcatttttctgcgccgcaaggtctccgacatcacagctgtccttcctgttcagctactgaaacggggtggtgttatccgctcacaattcggcacacaagcataccgagccggaagcatcagcgctggcaagtctaaccactcacacccgccgcgcttaattgcgcttgcgctacagggctgcccattcgccattcaggctgcgcaactgtctgggaagggacctgatcggtgccagggcctcttcgctattaatgaatcggccaacgctggcgaaagggggatgtgctgcaagtttgcgattaagttgggtaacgctagcagggtgtatactggcttactatgttggcactga

SEQ ID NO: 16778 - DNA, 366 bp, Glycine max
  Peptide Sequence Number=SeqID_108463
atggctacaccactcaactcccctcctcctcctcctaagtcaacaacattttcatcgtctacgtcaaagaagagaagaaaagcaacacagttcagatcattgactactagactagttggggcgaagagaccagtggttcatgtggatcctgcaactgggaaaagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 16779 - DNA, 342 bp, Glycine max
  Peptide Sequence Number=SeqID_108464
atggaggccatgaaagaagagatggccacaatgatggaggccatgatgagcatgaagaagataatggaggttttatcagtttctgggctgcatgccctcacctttagagggctacacgccctcgccttcagaggactgcatgtcctcgccttcataggattgcacgtcctcgtcttcaaaggattgtacatcctcgcctttagaggactacacgtcctcgccttcagagggctgcacatcctccccttcagagggctacacgtcattaccttcagagggctgcatgccctcgccttcaaagggctacacaccctgttagtgcttagctctactgagctttaa

SEQ ID NO: 16780 - DNA, 540 bp, Glycine max
  Peptide Sequence Number=SeqID_108465
agatacccagtggacccgaagaagtccaacagggtcctagggtttccagctctgattacgggtctctgtcagttctacggagtgcccgtcgcccctagcaaggtcatgccatcatggcatagggatcgcgcccgcaagacacccagtggacccgaagaagtcccacagggtcctagggtttccagctctgattacgggcctctgtcagttctacggagtgcccgtcgcccccagcaagggatcgtgcccgcaagacacccagtggacccggagaagtccaacatggccctgggatttccagctctggttacgggcctctatagtcctacagggtgcccgtttcccccaacaaggtcacgtcatcatgacatagggatcgcgctccgcaagacacccagtggacccgaagaagtccaacagggtcctagggtttccagctctgattacgggcctctggatcgtgcccgcaagacacccagtggacccggagaagtccaacatggccctgggatttccagctctggttacgggcctctatag

SEQ ID NO: 16781 - DNA, 484 bp, Glycine max
  Peptide Sequence Number=SeqID_108466
aaagaccaaggtcaaggcatcttaggggtgacaccttctaagcccaaaggtgataaggggaagacaatagaaaaccaagcccctaaggctagtatgcaagagaagactagctctataaagtgctttaaatgtcttggaagaggacacattacttctcaatgccccaccacaaaaaccatgattatgaggagccaagacatttatagtagccaagatgaggctactactcaccttcctctagtgaaagaggtaagtgtctcctccaagaggttggctaagaaggaaactcattttacaataaagacaaacattaaagaaactttccctcttagacaacctccacattttctcttttgtaaaaagacacttgctagcattgccacacctcttgggcttgagtttattcctcaagtaaagaagttgttggatgagggtttggttcgcaagatcttaaatccttgtgctttgttggtgcccaaaatag

SEQ ID NO: 16782 - DNA, 441 bp, Glycine max
  Peptide Sequence Number=SeqID_108467
atggtgacaaaaaaggttaagaaatatgagaaaatgatgacacatctaccatcttgcaaaaaattagggcaaaagatggatcgggttacatcgctgcttcgtctattgccaaacacatttaagactgttgatgtccttgttacttctagtttcaccttgacaaagatgtcatggaccatgaaagaacacactttacggtgcccttaccgaacccgtgctagagctagagtaatgggtgaagtaatggaggtacaaaagttgatgaaggccgacatggaggccatgaaagagcaaatggccacaatgatgaaggccatgatggacatgaagaagataatggaagccaatgcggttgcaattgccgctaccagcgcagttgctaaggtgaacccgatgcccccatctggccttaaccaaatgaatcatccaacctcagctatg

SEQ ID NO: 16783 - DNA, 282 bp, Glycine max
  Peptide Sequence Number=SeqID_108468
atgaggaaaatcctttacaaatatgtgatcctcctggacatctgggagtttcatggtggagcaggcaatatggaattctttcatatgtttgtgcgggtcttcacctgcaaggccatgaaactttggaagcaaatgaatcagtcgagttttaagaacatatgggacatcctaatcagggtattggatgcacaagctttcgtaggagaaatcaggatgttcaaaattaccaaccacaaaatgctccgaatgctcaggatgctcaaaaggatcaaagggttgtaa

SEQ ID NO: 16784 - DNA, 425 bp, Glycine max
  Peptide Sequence Number=SeqID_108469
atgcatcaccaaaagaggaatactctagaggaggcttcactattatcaagtgagtcagagacccagcatgaccacagatcaaccttagctccttatggctcacacagaaccggtggagtcgccatctatcacaacctacctcacgacgggatgacaaaagcaaaacggataagccaaagtgttcgtctcctagggagaaaacgagtggagtcgccaccaacgtttattcaaggaaaacgtattagaaccccacttgcccgtgacaagggacaacaacctttgatcaagtgtgcacaacttgaagctcgcccaggcgagctgaaccttagccctaaagtaataagctcgcctaggcgagctggttgcttagccatgaagccatttcatggcccaagcgagccagatgctagcatgggcgagctagg

SEQ ID NO: 16785 - DNA, 432 bp, Glycine max
  Peptide Sequence Number=SeqID_108470
atggatcaagttcgacgtcaagccttcaataaggcatatgggaagatctggtatctggcaatgatagaagtgtccattgaagccatcacatccctcactcaatactatgaccaatcactcagttgcttcacttttggggactttcagttggcaccaaccatagaagagtttgaagggatcttaggatgcccattagggggaaggaagccatacctctttgctggattctatccttctatggcaagaatagcaaaagtggtcaagatctcagaacaagagctagaccgagtgaagcaaaataggaatggggtgatagggataccaaggaagtgcttggaggagaaggcagaagctttggaaaatcaaggggggtggacctcgttcattgacatattagcactgttggtgtttgggactatactatttctgaat

SEQ ID NO: 16786 - DNA, 255 bp, Glycine max
  Peptide Sequence Number=SeqID_108471
atggaggataggatcgcgaccgaccaagcgccaccccttccgggcgctaaacaagcagagaacgtcgctgcagggcagcccagttcaagtgagcaaacgttaacccataaggaaggaggggacatggttaatgttcccctaaaaaaaatggcaggtcttaggcctatgctgtattctgaagcaatggggcatgccacattgtccccatcctcttgcaatttatgtccaaacatgcgctcaccaagtgctcggtga

SEQ ID NO: 16787 - DNA, 666 bp, Glycine max
  Peptide Sequence Number=SeqID_108472
atgggcccagttttgccagactcgcagagacccttcttcggagcaatttgcaagattattgttttatttttacaggatgtgcgcaaaaaggcacaagccatccagaagcaaaacactgccccccacgttttctctcgtgggggttatgactatttggagcagaagctcctggctgagaagacaaagaagaagctggaggaagctgcacagccaggaagcgttgatggcgtcatcgaccctccatcctcggtcagacgccacgtgaagtggaagatggcccgcacgaagaaaacaggggagatgacgactgaggccgtaaaggaaatcgctgagaagatcggatccttcgtcccccatggacgtcaggatgttctcactgctgctattggacgtccagagcaccctggacgtgttcgtgttgctggggccggtgtcaccatcaagcaatactttagatcggctccacggatgtcccacagctcttcctccctgcctcctgaagaattgcaacagttgacccagcaaatcagggaccagctagaggagtccatcacagaaaaagtgacgcggcagctcatggcatccttcatcctggtgcagtcccagatgcaatctcagggacttgcactgcctcccgagcctctggttggtccctctggtcctcaa

SEQ ID NO: 16788 - DNA, 160 bp, Glycine max
  Peptide Sequence Number=SeqID_108473
ggtgtcacaaatgaccatgtgtgttcaggaagaagaaaggggaatggtaaaataccacctcaagctaatattaagaaggtgacaaagtgtttcttttgtaagaagaagagactcatgaagaagaattgccacagattccagaaatggcttgagaagaaag

SEQ ID NO: 16789 - DNA, 825 bp, Glycine max
  Peptide Sequence Number=SeqID_108474
atgttccagcaagaagttactattaccgctccgaatggtctgcatactcgccctgccgctcagttcgttaaagaagccaaaggcttcgcgtctgacatcaccgtgacctccaacggcaaaagcgccagcgctaaaagcctgttcaaactgcaaactctggggctgactcaagggaccgtagtgacaatctccgctgaaggcattttagtatcaccgggcatcgcttttggtaaggctctcttgctgaaagaagacgacatcgtcatcaaccggaagaaaatctctgctgatcaagtagagcaggaagtctcgcgttttctggccggccgcgcgaaagcgtccgaacagctggaagcgatcaagaccaaagctggcgaaaccttcggcgaagagaaggaagctatcttcgaaggccacatcatgttgctggaagacgaagagcttgagcaggaaatcatagccctaatcaaagacgatctggcctccgcagacgccgccgcctacaccgtgatcgaaggtcaggcgaaagcgctggaagagctggacgacgagtacctgaaagaacgcgccgccgacgtgcgcgacatcggcaagcgcctgctgcaaaacattctgggcatgccgatcgtcgatctgggctccattcaggacgaagtgatcctggtggccaccgatctgaccccgtccgagaccgcgcagttgaacctggacaaagtgctgggcttcattaccgatctcggcggccggacttcccacacctctatcatggcgcgctccctggagctgccggcgatcgtcggcaccagcgacgtgaccaagcagtga

SEQ ID NO: 16790 - DNA, 525 bp, Glycine max
  Peptide Sequence Number=SeqID_108475
atgaggacacgtagccctctaaaggtgagggcgtgcaaccctctcaaggcgaggatgtatagtcctctggaggtgagggcgtgtagtcctctcaaggtgagggcgtgcagccctctgttggagaggacgtgtagtcctctaaaggtgaggacatgcagtcctctgatggcgagggcgtgtagccctctgaaggtgaggacgtgtggtcctctaaaggtgagggcgtgtagccctacgaaggtgaggacatgtagtcctctgaaggtgagggtaactagtacccaaggaagggcgagtagccctctcaaggcgaggacgtgtagtccgctggaggtgagggcgtgcagccctctgatggtgaggacatgtagtcctctcaaggcgaggacgtgtagtcctctggaggttagggcgtgcagccctctgatggtgaggacatggagtcctctgaaggcgaggacgtgtagtcctctaaaggtgagggcgtgtagccctacgttggcgaggacgtgtagtcctctcaag

SEQ ID NO: 16791 - DNA, 114 bp, Glycine max
  Peptide Sequence Number=SeqID_108476
atgaaggatgattttgttggtcaaaggaggatgaaggatggttttgttggtcaaaagagagacggtagttatagttgtggacatgagggttgtggagacgatggttgtggttga

SEQ ID NO: 16792 - DNA, 447 bp, Glycine max
  Peptide Sequence Number=SeqID_108477
atggccacaatgatggaggcaatgatgagcatgaagaagataatggaagccaatgcgattacaattgccgctaccagcactgttgctaaggtgaacccgatgcccccatttggcctcaaccaaatgaataatccaaacttagatatgacacttgaaattcctcaccacaatctagccgacttcgagccttgcctcggatatgccactgaagggcaagcagttggtggtatacccctacaaaaccctttggagggccctcagtatcatccccagctacacctcttgcattccacaacaagtaaaaaccctcatgctatggaagaaatgggaaagttggatcatctagaggaaagtctcagggccattgaaggaggtaaagattatgcctttgctaacctagaagagttgttcctagtacccgatatcatcacccctcccatgttcaag

SEQ ID NO: 16793 - DNA, 382 bp, Glycine max
  Peptide Sequence Number=SeqID_108478
ccagcccgcatcaattggaccttgcaccttacgctttgaggtcatacagtgctcaatggaatgccccagggattcttcatgacaagcacacgttgcgttcgagtcgtatcctcggaaaaatggaggttgaggaaaccttgcaggggttatggctaccattgcattatcgagtggatatgggagcaagtcagcataggacaccagaattggggtgggttttgtggtttgatgtagggatggtctatgtggataactgggtggtgggtaaggagatgggttgttattggctgagtaatgacattgttgggatgaccaaattttcctcttttcagacccacttcgatccttttgccgacgaagaccatatccgcaaagctggaag

SEQ ID NO: 16794 - DNA, 701 bp, Glycine max
  Peptide Sequence Number=SeqID_108479
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggcaaggataacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16795 - DNA, 273 bp, Glycine max
  Peptide Sequence Number=SeqID_108480
atgactcctactcatgatgccctgctatattacaacgggaggtggaacatgtcacgtcaacgtgactttccaagtcattttgagtattcagaaaaggttatcgaatttgaaattattgagctgaaaactgacgatgacgtgctgaaggtcttagtacactctaactactggaaacaatttggcctaatagaaattttaaccgtttttagtaaactggtaatcaaaatggaagatgacatgtctcagtcacaacataattcaatgcaaaattag

SEQ ID NO: 16796 - DNA, 758 bp, Glycine max
  Peptide Sequence Number=SeqID_108481
gctcaggaaatttttgccaatgatatccaaagcttgtttgatgcaaccatgaaagttacagccctcaagcaaaccagccatgacatgatcgctcatgtggataaggctcggactgccgtagaagagctgagaaagttccttgtagctgattcattggaagaagtgaacaggaaacttgacaagttctacatggtccttattctgaggagcttacattcagactttgatcatgtgcgtgatcaagtacttgctggggaccaggttccatcaatggattccctcatcactagacttctccacacgcctcatttattgaaggatgagaatcctgctgatggaggcggccgcaacagtagaggaggtcgcagtggaaggggtggacgtcctcattgcacctattgcaagaggatgggtcacacccaagagaattgctattcgttgcaagggtttcccgacaaggtcgcacaggtctctagatcagagaaagcagaatctagattctctgatgaggagtatcaggagtatttgaagcttaaatccgagaaacccagcaaccaagctcaatcctcatctgtaccatgtttttcaacagcatgtatctctcagtccattaaaggtcctagcccttggatactcgactcagctaatggctccaaggttgcttctcaaggaagtggtcaagaacatgggacggggcgactgattggagaaggacatgaatcacgaggactttactacttggaatccagtccacctgg

SEQ ID NO: 16797 - DNA, 345 bp, Glycine max
  Peptide Sequence Number=SeqID_108482
atgccaaacgaagcgcgcagcagcatcagtttgcgccctttgcgatcggcaaggctgccccacagcggcgccacggcggcagaaacaataaaggtgacactgaaggtcaggcctgaccagatactgagcgcgttgccgccacggatacccagctcttccacgccggtaaaaaagcagccaaaccagacggatatcagattgatcttccaggattcgatggagcgtaacatgagcgcagatgtcggaaaaaatgaaacgagggttcagtctaacaacctcgtaacattaccggacggcaaaacatggcatgaggatgaaaacgcagtttttcgctgccgggcgtga

SEQ ID NO: 16798 - DNA, 728 bp, Glycine max
  Peptide Sequence Number=SeqID_108483
tgggaactcttacgtgccgatcaacgtctcatttcgccaaaagttggcccagggcttcccggtatcaaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaaactgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16799 - DNA, 452 bp, Glycine max
  Peptide Sequence Number=SeqID_108484
atgtgggacatggagaatgggttgtcaattgcatcatcacgacccctaggctgcaccattggttgctgggctgttgaagacctgcctcactcatttgaatttagagccacacaaaaccaaaatactgaggttcgactctggggacatgaaggtcctataactgcacttgctttagacttgacaaggatttacagtggttcatgggacacgactgttagagtgtgggaccgtcattcaatgaagtgtactgcagtgttgaggcacagtgattgggtctgggcacttgtccctcatgatactactgttgccagcacatcaggttcagatgtgtatgatagtgggactttggtgaccattgttcataatgctcatgttggtaatacttatgctttggcacggagccatacaggggacttcctttttacaggaggtgaagacggtgcaattcacat

SEQ ID NO: 16800 - DNA, 503 bp, Glycine max
  Peptide Sequence Number=SeqID_108485
atggcgaatcaagaggagagggtcccgtttatggatgtattagcattgctaatctttggggttgtcctctttccaaacgtggacggtttggtggacctagccgcaattgatgctttccttgcatatcaccatagcaaagaaatcctggtggtggctatcttggcagacttacttgacacatttgaccgaaagtgcgagaagagtagcgcacggatcatctgctgtttacccactctttctgtatggttggtttcgcacctattccaacaagacataaggcatccatgtccgctccgaagccatcgctcgtgtgtcgaaaagagaagagtagattgggaccaacacttggctgggataggaggcagaacaatcaactggtttcctcgatggaaggaaggaaatgagggagttctcttctcatgtggggactacccaaacatcccattgataggaacgaggggttgcattaactacaatcccgcgctttctataagacagttagg

SEQ ID NO: 16801 - DNA, 336 bp, Glycine max
  Peptide Sequence Number=SeqID_108486
atgtggggcaccccttttatccttgagccaaaccaaaccccgacatccaaaatactgactcaccataatccttaccctcggaagcaaaaaagaaaagaaaggaaattcccaatcaaagagtgggagaaagcagaaaagaaagaaaggaaattcccaatcaaagagtgggagaaagcaaaaaaagaaaagaagaaagttcccaatcaaagaatgggagaagaaaaagagaaagaaggaaagaaagctcctgatcaaggatcggaaaaacagaagaaatgtgcagagaggtctttggaccggacaatatctgaacaatacagaattgtcaccaaataa

SEQ ID NO: 16802 - DNA, 621 bp, Glycine max
  Peptide Sequence Number=SeqID_108487
atgaacgaaaacgcaattcatggggcaccgaaacagggtagagaatggagaattgcactaagcaatcactacgcatggctccaaaaaagtgggtggaggatggatgaacgaaaacgcaattcatggggctccgaaaagggtaaagaatggagaattgaactaagcattaactacgcatggcttatactagtgggtggaggatgcaagaacaaaaacgtaattcatggggctccaaaaaagggtagagaatggagaattgcactaagcaatcactacgcatggctccaactcgtgggtggaggattcatgaatgaaaatgcatttcatggggctacgaaaaagggtagagaatggagaattgcactaagcaatcactacgcatggctccaaactcgtgggtgcaggatgcatgaacgaaaacgcaactcatggggctctgaaaataggggtagagaatggagaattgcaataagcaatcactgcgtatggctccaaactcgtgggtggaggatgcatgaacgaaaacgcaattcatggggctccgaaaaaaagttgagaatggagaattgcactaagcaatcactacgcatggctcgaaactcgtgggtggaggatgcatga

SEQ ID NO: 16803 - DNA, 81 bp, Glycine max
  Peptide Sequence Number=SeqID_108488
atgggtacagttgccaatgttctccatatgaaggtttttcctgtacctccagatccatataagaaaaacatgccaccttga

SEQ ID NO: 16804 - DNA, 357 bp, Glycine max
  Peptide Sequence Number=SeqID_108489
atggcagcgcagttgatccatgatcgcgttgtaatggagtgcccagaggtacatccggagcaacccgcacgcacacttcagcagcctgtggagtggatactacctacacctaccccatatcgactagttgagccggttcaagtgatagaggtgtcatcatctaaagaggatcttgaagagtacccagaggagttacctcctgaacctactatggacgcccttgacttacctgaggatgatgaagacccactccctgatgttgattctctagaggatattgtgtcagcatctgaggcagactctacaaaggagagtggccctggagggacagcgattagtgacgactcttcatcgtag

SEQ ID NO: 16805 - DNA, 438 bp, Glycine max
  Peptide Sequence Number=SeqID_108490
atgcaaaaggcattgcgatcaaatgcaacccttccttatcctcatctaattactctattcttgcatcattttgatgtccctcttgactctgagacatttgttcaagtcaagagatcattttctattggggcaggagtagttacttcctttggataccacaaagagcgtgatggctcttgggtgaagaaggacgttcctacacaggcagcagaggaccgctctccatcaccacctcctcagagggatgactcttcatcccttatgcaaagcgttctcgatagactggatggactatacacgtatgtctgtgagcgttttgactccctggaaagatgcattgatacacgatttgcagacatggatactcatattgatcggcttgaggaggatgtgagtttcatccgtcagtgcttcgaccttctaccaccgccttcatag

SEQ ID NO: 16806 - DNA, 276 bp, Glycine max
  Peptide Sequence Number=SeqID_108491
atggtggctgtgggtgatggagaaaaagcttggcacgttggaaatggttttggaagaaagaaaggagaagaaatgacgtttttccaaagctacttggactacaagactcaaaacgcacaagtgagcaatgctctcgggaacggaaacgtcacgcacactccagacatcttcttagagatcccaacggtcatatcctggaaaagtgtattgggaagctgtaaaccaaatttcaagaagatccaacggttaatgaaagctgggaagcgtttttactga

SEQ ID NO: 16807 - DNA, 395 bp, Glycine max
  Peptide Sequence Number=SeqID_108492
gtgttgtacctcttgatgttgattttttagagtcagaatgcactaaccatgtttcaggaagtacatatacatctgacttactttatgaggtacaggctgaggaaccctcctcttcttctcctaccctggttcctcccactgttcagccaccacccacaccagagttgaagcccttaccagtaaacctcaagtatgcttacttggaggacaaggaaaaatttctagtgatcattgtcgcaacctacccttcggcgggagggcgacgctgggctcacaggtgcgtcttccaagaaaggaaaatgcgcggagtcgccaccaacgtttatttgaggaaaacatcggaaaaaccggaaagggtgttttccttgcttctacgtattcctcaattgcaataa

SEQ ID NO: 16808 - DNA, 397 bp, Glycine max
  Peptide Sequence Number=SeqID_108493
atgaagcttttaatttttcttgatgtcaagaatcacaaaccaaaagaaggaaaggagacactctcttgttttgttactgccttttctcacactcggtgtcttatagatgaaaatctttgtcacagcttagagggcaatgctggtgcactcacaaattttgaggtccttcatttcttacgagctaaaggagcttcaaaggatccaacaagagttaatgccaaagtagcgcagtttgaatacaaggtttatgattatttggttgacactgctgcttcaattcaaacaagagagagcatcaatgagttattgacaagtgttaaacagcatgacctggcaaaaactgaagttctgaacatattaaacattggactagctgctgattttgaactatacccaa

SEQ ID NO: 16809 - DNA, 297 bp, Glycine max
  Peptide Sequence Number=SeqID_108494
atggataccattgcattatcaagtagatgtgggagcaagttagcatatgacaccggaatttggggtgaatcctacaggcttttcgctgcaaaattcatttcttggttggtgttttttgggatggcctttgtggataactgggcggtgggtaaggaggtttgttattggctgagtaatgacattgttgggtttggtgggaaacttggccgtataggaatggcagtcacagcatgggtttctccctctttctcaccctcttcatttgccccagttttctcagtcgtcctagtaggatga

SEQ ID NO: 16810 - DNA, 117 bp, Glycine max
  Peptide Sequence Number=SeqID_108495
atgcatcatcttattcaccgtcatcaaggggaatccactacagatttaccagaagcctctgtcatggctgaagaacatcaacacaggggtaacccttggaagattactcccaataag

SEQ ID NO: 16811 - DNA, 228 bp, Glycine max
  Peptide Sequence Number=SeqID_108496
atgtcccatgctgtcaaggacaatcgagggaaatgggccccgaactacgaagggccttttgttgtgaagagggctttttccggaggagccctggggcaggatcatcttgagctaccttctggggtggggacaaaacgtggacaacagaaaccaatcaaggtacttaggaacggatgcaagtggggatggggtcacgaccgactgatcgttgccctttctctgcgctag

SEQ ID NO: 16812 - DNA, 565 bp, Glycine max
  Peptide Sequence Number=SeqID_108497
aggattgcacgtcctcacctttagaggactacacgtcctcaccttcagtggactacacgtcctcgccttcagagggcgacacgtcctcaccttcagaggaccacacgttctcaccttcagaggactacatgccctcgccttccgaggacttcacgtcctcacctttcgaggactgcacgtcctcgccttcagaggactgcacgtcctcgccttcagaggactacacgtcctcaccttcagaggactgcacgtcctcaccttcagaggattgcacgtcctcaccttcagaggactacacgtcctcaccttcagtggactacatgtccttgccttcagagggcgacacgccctcaccttcagaggaccacacgtcctcaccttcagaggactacacgcccttgccttccgaggacttcacgtcctcaccttcagaggactacatggatgcgaccctcgtttgaccacttcgaggtacttggcacccattgttaggcaattcgtgaagtttcgtgacatgtcggaagtcaaaagaaagcattgttgcacaacccgtgaagttccgtga

SEQ ID NO: 16813 - DNA, 387 bp, Glycine max
  Peptide Sequence Number=SeqID_108498
atgttggtggtgggttgtggtggaggtgacgaaggtgatgtcattggtagtgatgcgacagtgacattggtgggtggtggtggtggtggtggtgttggtggtaacaatgatggtgtaatgttggtggtggtggtaacgatatttgtggtcgtggtggtggcagccagttatgacaatgacaacgatagtattggtggcagtggtgacaatgacgaaggtggtattggtggcagtggcgatggtgatgcaatgttggtgatggtgttaaagtatgactttatccttagaggtatcccgtttagtaggacttatgttgatcccatgggttggagtatccttgcaagactgggtaatcctagtgcgccgctggcaatctcttcttggtga

SEQ ID NO: 16814 - DNA, 207 bp, Glycine max
  Peptide Sequence Number=SeqID_108499
atggggaccaccaagggtacatataatgaattgaaaagttcgatttcgggaacttaccggttgaagaccgaagaacgaacgacgaacgacgaagaacggttgaaaatcttcgcaaaatcacccatggaaacattacggaaacgttacggaagcacctcggcttggattttcttcacggaaacaattttcctcactaattttaagtga

SEQ ID NO: 16815 - DNA, 408 bp, Glycine max
  Peptide Sequence Number=SeqID_108500
atggagtgcagtggaatggaatggaagggaatggaaaggaaaggaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16816 - DNA, 144 bp, Glycine max
  Peptide Sequence Number=SeqID_108501
atggaagttggaagttggaagttggaagttggaagttggaatgaaaattattggaagttgaaagttgaaaatggaggttggaagttggaagttgggaggggaagtggttgtcatcatcaaaaagggggagaatgtaaatcatga

SEQ ID NO: 16817 - DNA, 572 bp, Glycine max
  Peptide Sequence Number=SeqID_108502
tggtccttgtgacagaggctaatggagcttcggttgaggttgacgtatatgcggataagcccatggcaggaggtgacgtacgagacactagggcagacactcctgcaaacaccgacgcacaggctgttgaggatgagcctaagggatttccgggtgatccgagcgacccatccgtgctgaccgagtatgcagatcatgttgcaggcagcgtatggacgggagaggagcgtcctgagttgaagttatcctctcacgggaggaaggtgcatagtttaggcaggcctgttcctgccattgaggggctacggtggcaccgggagacttctagtttccatctccctatgagagaggtgacgatcacgctagacgatgcggtacagatgctggtggagttattgatggtcactgcagaggctgccagggctgaaacagggcaatgtcgtggaccgtatgtacgcctgcaatggatacgtgatatctatcaacgtcgatgccaggccagacattggacagctgcggctcgcacgcccttcgtgacctcagttagactaggaggtacgcctggggagtag

SEQ ID NO: 16818 - DNA, 384 bp, Glycine max
  Peptide Sequence Number=SeqID_108503
atggccccaaggaagcttgcctcaaagagatccaggaaggataaagcggctgaaggaaccagttccgctcccgaatatgacagccaccgttttaggagcgctgagcaccagcagcgcttcgaggccatcaagggatggtcatttcttcgggagcgacgcgtccagctcagggacgacgagtataccgacttccaggaggagatagttcgccggcggtgggcatcgctggttacccccatggccaagttcgacccagacatagtcctcgagttttatgccaatgcttggcctacagtggagggtgtacgagatatgcgatcctgggtgagggtgctggaggagggccagaagtgcgagtatgggccagaggaggaaccaggctga

SEQ ID NO: 16819 - DNA, 681 bp, Glycine max
  Peptide Sequence Number=SeqID_108504
atgggaacaaatcaaactggaaaaaggttctatcaagtcaagattaagggcctagatgtcaccagccttaaggagttggggcggttgatgagatctctccaaatgcaagcctttcgcaaggcgtacggaaagattttagatttgaccatagcagagatattcacagaagccattgtatcactcacccaatactatgaccagcctttgagatgcttcacttttggagactttcaattagtaccgactgttgaagaatttgaggagattctaggatgtcctcttgggggaagaaaaccgtatcttttctccgggtttcttccctccttgagcaagattgcaattgtggtcggggattcggcaagagagttggatcgtgtaaagcaaactcgaaatggcgtagtgggcctaccatggaagtacttagaaggaaaggcaagggatatggcgaatcaagaggagtgggtcccatttatggacgtattagcattgccaatctttggggtggtcctctttccaaacatggacggtttggtggaccaagccgcaattaatgctttccttgcatatcaccatagcaaagagagcccggtggtagctatcttggcggacttatttgatacatttgaccgaaagtgcgagaagagtagcgcacgaatcatctgctgctcgcccgctctttgt

SEQ ID NO: 16820 - DNA, 588 bp, Glycine max
  Peptide Sequence Number=SeqID_108505
atgacggaccctctcaacgagtcaatctctagctttctcataagggtggacccttgggtacatgccccaccttcagagggctacacgcccttaccttcagagggctacatgccctccgcttcagaggactacacgtcctcgccatcagaggactacacgtcctcgcctttagagggctgcatgccctcgcctttagagggctacatgtcctcgcctttagagcactgcatgccctcaccttcagaggactacataggactacacatcctcgccatcatagggctacatgccctcaccttcagaggactacacgtcctcgccttcagagggctacacgcccttgcctttagaggactacacatcctcaccgtcattgggctgcacgacctcacttttagaaggctacatgccctcaccttcaaacgattacatgtcctcaccttcagatggctgcacgcccttgccgtcatagggctacacacccgcaccttcagagggctacacgccctcacctttagaggactacacgtcctcgccatcagagggctacacgccctcgccttcagaggactacacgccctcgcctga

SEQ ID NO: 16821 - DNA, 749 bp, Glycine max
  Peptide Sequence Number=SeqID_108506
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgagcactggttaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16822 - DNA, 270 bp, Glycine max
  Peptide Sequence Number=SeqID_108507
atgcgggaccaactggttcccgcgatcgtcatcgggcctggcgcctctggattgacaaaagggatgcagaagacaacagatatcaaaggaaagtttaaacggataacactcgggtatctctgcatgtcacatgactccagtgtcagtatgactagaaattgtctaccggaagatgatgtaaatctccgcgtgtcacgggcttgtgcgcgattgacaaagggtgcagaaaaggacgttagtctctgcgtgctatcatgctttgagtcttag

SEQ ID NO: 16823 - DNA, 852 bp, Glycine max
  Peptide Sequence Number=SeqID_108508
cctcaaggaattgggacgtttgatgggacctctccaaaggcaagccttcctcaaagtgtacaggaagattctagatttgaccgcagcgaaggtatttacagaagctgtcgtatccctcgcccaatactatgaccagccgttgagcaagattgcagcggtggttggagattcagcaaaagagatggatcgcatgaagcaaactcggaacgatgtagtgggcctgcctcggaaatacttggaaggcaaggcaagggatatggcgagccaagagaagtgggacccgtttgcggatatattagctttgttgatttttggggttatcctctttccgaacgttgacggtttggtggacttagccgccattgatgctttccttgcatatcaccatagcaaggagagtccagtggtggctatcttggcagatttgtttgacacctttgatcggaggggttatattaactataatcccgcacttgccataagacagctaggataccccatgaggggagcgccaacggaagagagcctctcgcctttccttgtgagagatttcggcgcgccaagtctcaaggttatacaaagagtccacaaggtgtggagaagtctgttgaggaaagacaaagagcttagaggcatccgtaatggcgtcatcggtggttatcatggatggctaagagttcatacgcgagggttagattggctctccaagatgaaatttatcaatgaggagaacttcgaagctctggaggaagatgaagaagtccaagctctaaaattagagctagggaaggcaagactcaccgaagaaaagttcaagttagccgctacaaacatccggaaagagtgcaccga

SEQ ID NO: 16824 - DNA, 279 bp, Glycine max
  Peptide Sequence Number=SeqID_108509
atggagaattggcgaacagcgctacgcaataacttcgcggggctccagactcgttggtggaggatgcatgaacagcgccaggcaatgacattcatggggctccgtaaaaaagtggagaatggagaattgactcgttggtggaggatgcatgaacagcgccaggcaatgacattcatggggctccgtaaaaaagtggagaatggagaatggcgaacagcgctacgcaataacttcgcgggtctccaaactcgttggtggaggatgcatgaacaacgctag

SEQ ID NO: 16825 - DNA, 381 bp, Glycine max
  Peptide Sequence Number=SeqID_108510
atgagtgagatagaggaagttcaagaacagatgaaggctgacatggaggccatgaaagaccaaatgaccaccatgatggaggccatgatgagtatgagaaaaatgatggaggtcaacacggctgcagtcgctgccacaagtgccgccactaagggaggcaaagcattgggaagtacagacggcccccattttgtgcaggtccagagcaagcatcccctcccaccatatggcttgccttccaattatacactacccaatgttgaacacgcgcccgatgagaatgtccacaattctactcccatacccattgagatccaacaaccccagtttggtcatgcacacgtccctcaacccataggtgagacacatgaagtaccctga

SEQ ID NO: 16826 - DNA, 1563 bp, Glycine max
  Peptide Sequence Number=SeqID_108511
atggggtctaaaagacccttttcaaattcatcaaaacccttgtcaccatttgttgaggacacgaagaatgtgaagcttaaagggttggaagcaagccctggttccaagaagcttgttgttgaggagaatgatgttaatagctattcgattgagattcagaggttaagaaatgacccaacaatagtagacacaatgactgttcatgaactccggaaaaccttgaagagatttaaagtccctgccaaaggtcgtaaagatgatcttttgtctgccttgaagagtttcatggacaataacatgtgcgaacaagattctcatttacaagaaaaacaagggcttttaatttcttctgaaaatgcatctgtagaagtgaaggctaaaacagtattggatgaagaccatattgaaaatgtcaatgaaactccagagatatctgaacttaaccagggtaagagaaggttaaaccaatcagaatctgagagaaaaactatcaaagtgacaaccaagaagaaagtttcattgaaatcagatgaggattcagattttaagccttccagggcaaagaaaaaagtatcttcagattttgctagcattgttgtacagtcagaggaaatcagtacagctactattcaaactgaaccatggacagttcttgcccacaagaagcctcaaaaaggttggattgcatataatcctagaactatgagacccccatcgcttgctcaggatacgaaatttgtcaagcttttgtcatggaatgtcaatggattgagagcattgctaaaattagaaggattctcagcacttcaacttgcccaaagggaagactttgatgtattgtgtttgcaagagactaaactgcagagaatagcaaagaatgtatatctgaaaattgtgaaagatgtgaatcatgagaagctattcctaacagccatagttgctgccttttattatctatcaaccatgatgaagatgtttcttgtttgtatgaaaatccatggtgctcatgttctgatcaagccactttcagttagatatggtctaggtataccagatcatgatagtgagggtagacttgtaactgctgagtttgatacattttatttgatatgtggatacgtccctaattctggagatggcttgaaaagattgtcttacagggtgactgaatgggatccatctctcagcaattatttgaaagagctggagaagtcaaaacctgtaattttgactggtgatctaaattgtgctcatgaagagatagatatatacaaccctgctggtaacaagagaagtgctgggtttacagatgaagagaggaaatcatttgcaaagaacttcttatctaggggatttgtagatacctttagaaggcagcatcctggtgttattggatatacatattggggttaccgtcatggtggacgcaagtttaacagagggtggcgtcttgactatttccttgtctcagaatccattgctgacaaagttcacgattcatacattcttcctgatgttaccggtagtgatcattgtcctattggccttgttgtcaagctttag

SEQ ID NO: 16827 - DNA, 314 bp, Glycine max
  Peptide Sequence Number=SeqID_108512
tcaagagatctttctctatcggtgagaatgtggtctcctcttttggataccgcaaagagagagatgtttcttgggtgaagaaagacgcttcagtacaggtcgttgaagaccgttctccatcaccacctccgcacaacattcttgacaggttggatggactccacaccttcgtctgtgaatgctttgactcattggacagtcgtattgatgtcatggatgcatggtttgcaggaatggatacacgcatcaccaagcttgaggaggatgtgagttatgttcgtcagtgcttcgaccttccacctccatcctcatag

SEQ ID NO: 16828 - DNA, 333 bp, Glycine max
  Peptide Sequence Number=SeqID_108513
atggtgaaagttggaacctcttacgtgccgatcaacgtctcattttcgccaaaagttggcccagggcttcccggtatcaacagggacacccaggatttatttattctgcgaagtgatcttccgtcaccagctgtccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 16829 - DNA, 399 bp, Glycine max
  Peptide Sequence Number=SeqID_108514
atggtagcttggcccgggacccaaccttctcttcatagggaagacgaaggtcccatagcccaggtacctcagcatgtggaggatgagtcatctgaggacaccatcccagagccatttgatataggagaagaggcaaatgagacacaggtgagacaggtagctactgccactcctaagcgatcccttgaggctacttcagagccttttgcgccaatggtaaacctaccctcacctcagcctgcagcagacccctccactcctcttctacaaatgccagaggacccaactacaccaatcctagctatggacacttctcctccaactactccagtgcttcaactgacagatgaggagaatggtcagacacaggacacccaggaccagtcacaggaattttga

SEQ ID NO: 16830 - DNA, 405 bp, Glycine max
  Peptide Sequence Number=SeqID_108515
atggctaagtttgacccagatatagtgctggagttttatgctaatgcttggtccacagaagagggagtgcgggacatgcggtcatgggtgaggggtcagtggattccctttgacgtagatgccctcagccagttcctgggtgacccgctagtgttagaggaaggccaggagtgcgagtttagtatgccacccaccaggcaccctctagacccggataagtctaaaagggccctggggtttccagcattgatcacgggcctctgccagtcattcggggttcccgtcacacctagtaaggtgatccgaccgccgatcacccgggccttcattgagaagtattgcatgcctaggcaggcgcagggtgatgcgccacaggccgcagacgcaccgacgccacctcattag

SEQ ID NO: 16831 - DNA, 162 bp, Glycine max
  Peptide Sequence Number=SeqID_108516
atgactatgacacaagaccatgagaagcttgattcagatttaattgcgacttgcgtagtagacccaatgacttggaaacaaataagtggcaccaccgcgcaccacgcgacacttctgactacacaaatgggaggcaacaatgatataacagttgttgtgtaa

SEQ ID NO: 16832 - DNA, 732 bp, Glycine max
  Peptide Sequence Number=SeqID_108517
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 16833 - DNA, 315 bp, Glycine max
  Peptide Sequence Number=SeqID_108518
atgtcagcttgcggggtcgcactagaaccttctctagtggtgtccttcctggacctcttcgcggggagctttatcagggccatctccggttctttcaacccggactctgccagaatccttaaagaggggacctctacttcaaacggcagtacgacttccattccgtacaccaacaaaaatggagttgccccaattgatgtgcgcactgaggttggtggcattgtccgtgataatcttcctgggcaacccataccggcagattatctccttcttgatgaatctaaccatcacgctcctcgtcacattgtagtatga

SEQ ID NO: 16834 - DNA, 363 bp, Glycine max
  Peptide Sequence Number=SeqID_108519
gcgcaactgccaacaaatgtgagcaacttacatggtgatgatgatgatgatgattatcttgtgtctaactcatacgttgaagagtctttagacgaagatgatagtgttgacgatatatctgatacagacgatgaagtcgccgacatgattcaaccagtaagaattgttcacctagcagaaggtgtacaaggaattgaaaatccattttggaatgatgctctgcattataacaatatcaactggagtcatcctgatgaggaagacatttgtggtttggagatgccatcgagttttaatgttggaaaagaattatatgttggcatggattttgatactaaagatgcgataaaaaaaatgcactga

SEQ ID NO: 16835 - DNA, 297 bp, Glycine max
  Peptide Sequence Number=SeqID_108520
atgacttgtctcccggaatttcacaaatcgcctaatgatgggtgcagcacctcacaaggaccaaagaaaggtctgctgtcatcaagcaaaggtccccgtgagacgaaaaagggtatgacacctaatttcgctcctctcgcgttgacgagagtcaggggcgaccatgaaatttccgcatcaagaatgttatacaaccacttcgggtatttccgcttgtcatcgggcccgccgcctctggatgacaaaaagggtgcgaataaccataaggtatctccgcgtatcatgggtgcagaatga

SEQ ID NO: 16836 - DNA, 282 bp, Glycine max
  Peptide Sequence Number=SeqID_108521
atgatggcacatcagttgtcataccctaattttgtccggggaccattgtttggtggcacgcaacctttgcttgaccgcttcaaagaatcaacacaaaaagcaaaatggggtgtatttagtaaaaagaggtgtgcaaatagcaaccaggcccacttgggccttctagggggttccaacagatggcggtgccttctggtggaagcgacccagctcgcctgggtgagctgggcgacaaccacctccctctttttccctataaataggggaaagtgggcagagtaa

SEQ ID NO: 16837 - DNA, 225 bp, Glycine max
  Peptide Sequence Number=SeqID_108522
atgataatgttacctaggggaaatagcacacagtggtcaatgtctgaatacaactattatacaattgtggattatggattcaacgataatcatggaagtaaatccaaggcaattgttagatggattccagttaaatgtaataagaaaaaaggaagcactgagttcgactattacgccctgcattggatgtcaaccatagtcctaggaggtttcaaggataattga

SEQ ID NO: 16838 - DNA, 414 bp, Glycine max
  Peptide Sequence Number=SeqID_108523
atgagtgtaaagcagttcattgagaaggtggcctggcctggagcccgaccttcttttgtgggggataatgaaatttttacagcccaagcacctcaacagcatgaaccagaaccagaaaacgatcactcatctgaagccaccatccctggagctgtcgattttgcaaaaataagattagagatgagatccaatgaggctgctcatcctggaccagtgccagcattagctgatgcaccatttccaggagtggatccatcttcagctcagcacgcagcagactcttccactcctgtcttagagatacatgagggccagaccataccagtcctgactttggacacttctcctccagctacttcagtatggcatctaacagatgaggaggatgttaagatacaggacaaccaggactag

SEQ ID NO: 16839 - DNA, 357 bp, Glycine max
  Peptide Sequence Number=SeqID_108524
atgggtggttgtgtggaggtggggtgcgatggtcatggaggtttaggggagaggcatctaggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggtgtggtggttacgcgcagcgtga

SEQ ID NO: 16840 - DNA, 457 bp, Glycine max
  Peptide Sequence Number=SeqID_108525
ggctcatagggaagcgcacgaccggaacaagttccgaggggctctgtggggcagtaacagcgagcttaagatccagagaaaggaaagggaccaatcacaagtagacagtttgatcttgaaatatgagttgaaggtttgctcaaggtccaaaagaaacttgtctcagcggttatgcgagacaaagaccaacatgttagctatcatcagcaagtaccaagaagaactaaatctagctacggcccatgagcatagagtggcggacgagtatgcccacatgtacgcggagaaggaggctagaggaagggtgatcgactcgttacatcaagaggcaacaatgtggatggaggccatgaaagagaaaatgaccacaaggatggaggccatggtgagcatgaagaagataaatggagggcaaagatttgggaagtacgaacgaccccatgatgtgcaaatataa

SEQ ID NO: 16841 - DNA, 836 bp, Glycine max
  Peptide Sequence Number=SeqID_108526
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattgactgggctcatcgtggctgaggatctgaagcagttgataaagaagatgaagttggaggggactcgctacccaccactggactcaggcctgcctcctctcctgggggttgtgacccgtcacccaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16842 - DNA, 81 bp, Glycine max
  Peptide Sequence Number=SeqID_108527
aaactgaactcttgttcttctttaccgattcaacaacagctcagcagtggtagtacccatgagcctgcagattgcacatag

SEQ ID NO: 16843 - DNA, 711 bp, Glycine max
  Peptide Sequence Number=SeqID_108528
atggcaagaatagaaaaagtgatcaagatctcaaaacaagatctagaccggttgaagcaaaatagaaatagggtagttgggataccaaggaagcgcttggaggcgaaggcaaaagctttggcaaatcaaggggagtggacctcgttcattgacatattagcattgttggtgtttgggaccatactatttccaaatttagatgggctagtggacttagcagcgatcgatgcctttcttgcttatcatcacagcaagcaaagcccagtgattgttgttttggctgatgcatatgatacattcgacctaagatgcgagaagagcagtgcaagaattgtctattgtacgcctgctctgtatgtgtggttggtctcccacgtttttcttcatgcaggtatggtaggattgtccattagctggttcccccgattgaaagaaggaggggcaggagtgttatgctcatgtgaaggatttccgaacgtccccatgatgggaacgaggggttgtattaattataatcccatgctggccataagacaactaggctaccctatgagagatgcaccatcggaggagatcattacgcctttcgtcgcacgaggtttcaatgaagccaatgcgaagataattcagagaatccttagagtgtggaatacagtggaaaggaaagataaggagcttaggggaaatagcaagggcgtcatcaactgctag

SEQ ID NO: 16844 - DNA, 129 bp, Glycine max
  Peptide Sequence Number=SeqID_108529
atggtttttttggtcaaaggaggttgttttatggtaattgttgtggaggtggtagttgtagttgtggacacgacggttgtggagatgataattgtgtttgtggagacggtggttgtggttgaggaataa

SEQ ID NO: 16845 - DNA, 402 bp, Glycine max
  Peptide Sequence Number=SeqID_108530
atgttaatgtggaatgagcaatactcacatgctggtcctatacaattattatatatcatcaacagaacacccggtggtatactcaacctacttcgatccaccattactcctactcatgatgcaatgttgtattacaacagcaaaagttgggttggcaaatcccgacttctcaatgtcacatacaaatggtgtaatttgaaaaataaaagtcaaactagaactagggtagattgggattttcttggagagagtgtgtatattggtaaaaatcctgggatggagagtgctcaacaaaaagaaggggatgatggaatggacataaagaaggggaggatggaatggaggaaacgtaaggaggcgttccaaggagaagtaaccagctaccacttctctaacatctga

SEQ ID NO: 16846 - DNA, 216 bp, Glycine max
  Peptide Sequence Number=SeqID_108531
atgactgtgaaaaagaggctaagtcatgaagtgctaaaacgcgcctccaccgctaagcgcagcttcagcgtgcttagcgcgacagaggaatctggtagagcatcaatatcatggccgcgcgctaagcgcgagatcagtgcgctaagcgtaacagttgtcttcagccaggctcagcgcacgactggcgctaagctcaaatccacttactcgcgctaa

SEQ ID NO: 16847 - DNA, 228 bp, Glycine max
  Peptide Sequence Number=SeqID_108532
atgcctttttggtgggcaagcgaggcgaggctcacgggtgcgctttccaaaggaggaaagatgtgtggagtcgccaccaacgtttatttgtggaaaacgtcggaaaaaccgaaggaaaccgatcaaaatgaaaattctaagttcgggagttgtcgacaaaagcaggggcttttgctcctacgtaccctccatcgaagaggaaatcagacctacgtagttctttcttaa

SEQ ID NO: 16848 - DNA, 330 bp, Glycine max
  Peptide Sequence Number=SeqID_108533
atgactagaggcaatccatctgacttacaaccctttgatcctgagatagataggacatttcatagattagttaggcatcattttataccttttgatcattctgagcattccattactggtgaatctgtgcattctgttattggtgatttagaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatat

SEQ ID NO: 16849 - DNA, 230 bp, Glycine max
  Peptide Sequence Number=SeqID_108534
gactccaccccctcgagagcaggatgccggccgagatggagctgggagccaacctatactttcctggggcttgccttgccccaacatctaaatcaaatgcgggcgccgaaaaggaaccagcccagcctcttccagaaagctttgcttgcgcctcggaaagcgcggacgagccacatgcagggaaacttgcacgtgtggttctggccggggaccccggtatactgtactaa

SEQ ID NO: 16850 - DNA, 411 bp, Glycine max
  Peptide Sequence Number=SeqID_108535
atggcgagaatagccaaggtagtcaaaatctcggtgcaggaattggaccgagtaaaacaaaatagaaatggggtggttggaataccaaggaggtacttggaggagaaagcgaaggctttggcggatcaaggtgaatgggtttcgttcattgatgtcttggcattattgatattgggagtcatcctttttcaaaatgtggatgggctagggaatttagtggcgatcgacgccttccttgcttatcaccatagcaaggaaagtctggtcgtggctattttggccgatgcctgcgacacatttggccggagatgcaagaagagcagtgggcatccgttaattggttcccccgatggaaggaaggaagaaccgaggttttatccttatgtgaggggttctcaaacatccccttga

SEQ ID NO: 16851 - DNA, 333 bp, Glycine max
  Peptide Sequence Number=SeqID_108536
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgttggtagagctccgctcttgcaattgggtcgttgcgattacggtaatgggaaagaggaccgaaacatgccactgaaagactctactgagacaaagacgggctgtcaagaacgtagaggaggtaggatgggccagttgggtcagatctag

SEQ ID NO: 16852 - DNA, 448 bp, Glycine max
  Peptide Sequence Number=SeqID_108537
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagactacaaagcctcgccttcagagggctacacatcctcacctaaagaggactacacgtcctcgcctttagagagctacatgcccttagccttcagaggacttcacgtcctcgcctttagagggctacacgtcctcaccttcagaggactacacatcctcccctttagaggcctacacgctctcaccatcagatag

SEQ ID NO: 16853 - DNA, 219 bp, Glycine max
  Peptide Sequence Number=SeqID_108538
atgagggacgacaagaggtcttcgtacgtcattgggagtggggtgaattatggaattggcctcaggggaaagttcctcatcgcgttggaaacgacgccaaagtgggcattgccggtcgggcaagtcatggttggagctggagcttggggggcctccctctggatgggggcgggcgccttaggccgtacgggtgctgaattggaggagttcctggcgtga

SEQ ID NO: 16854 - DNA, 147 bp, Glycine max
  Peptide Sequence Number=SeqID_108539
atgagtgttgagatcaaaagtgaatccacagataatagcgtcaaggtcaatggacaccggctgaaaccattcctcacaaatccctccttggtggacgtagtagtggaggagacctccttacttcaccttacttttcttcagccatga

SEQ ID NO: 16855 - DNA, 390 bp, Glycine max
  Peptide Sequence Number=SeqID_108540
caatctagagtcaatgagcaacctaaagcttatgccgcaaacatttataatagaccccctcagcagcaaaaccaacaacaacagaataattatgatctttcaagaaacagatacaacccaggttggagaaatcatccaaatctaagatgggcaagtcctccacaacaacaacagcatgtccctcatttccagaatgctgttggtccaagcaagccatatgttcagcagtcacaacaaaggcaacaagcaactgaggctcctccccaaccttccttagtggagttagtaaggcaaatgaccatccagaatatgcaatttcagcaagagacaagagcctccattcagagtctgacaaatcagatggggcagatggatactcaattgaactaa

SEQ ID NO: 16856 - DNA, 450 bp, Glycine max
  Peptide Sequence Number=SeqID_108541
atggttatttcgcaccctttttgtcatccagaaggcggcgggcccgatgacaagcagagacccaagtttggtcattctgcacccatgatacgcggagataccttatggttattcgcaccttttgtcatccagaggcaggcgggcccgatgacaagcagagaccaagtttggtcattctgcacccatccaaaggcggcgggcctgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttatggttattcgcacccttttgtcatccagaggcggcgggcccgatgacaagcagagaccaagtttggtcattctgcaccctcatccgcgggcccgatga

SEQ ID NO: 16857 - DNA, 474 bp, Glycine max
  Peptide Sequence Number=SeqID_108542
atgactctcgggctaataacatattgtgaccacaaaacaaatgatcacaagatgcaacacctaattaatactccatccaaaaaaagtcatgtagcaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16858 - DNA, 264 bp, Glycine max
  Peptide Sequence Number=SeqID_108543
atgtacaaagataattggacccaaccttggcccatgggctcagaaatctaccctaaggttcatgagaaccctagggccttcttcagcagctctagctcaatcttcttggagcctcttgctcatggttctagtgattggtcccttcctagggaggattgcatcacaatagggcttggatcttggaagaaactgattatgaagatagagatgtcgttttgtcctcacaatataatacaatttcaatgctttgaagatttcttatga

SEQ ID NO: 16859 - DNA, 171 bp, Glycine max
  Peptide Sequence Number=SeqID_108544
atgggattgaggagcagaatcgtcttaggcgatggtcaaataccgggccaaatccaaagacggagacaaattgagggatggacgcgagtagaggctaggcccatgatcgatggatcgtcgtcccatgcccagatccggacaagcgggaagtgcagctgggaggcagcctag

SEQ ID NO: 16860 - DNA, 195 bp, Glycine max
  Peptide Sequence Number=SeqID_108545
aatttgctaagcgcaaccttcagtggctacgcacgaggaagaatccagaagaagatgagctgtcaagttcgctaagcgcaccgctccagatctgcgctaagtgcacgagcatgaacaaggccacctatttaagcatgaaatcagatttacaaagggattttggcacttttcttgagaagatctacatgcaagaag

SEQ ID NO: 16861 - DNA, 1054 bp, Glycine max
  Peptide Sequence Number=SeqID_108546
atgaccatgattacgaattcgagctcggtactcatgtcttgtcgtacaggtgttcaatcgaactatttaggcctggttggataccagcctaatttggtttcaagacaattcggcctctcgcaaattcgtcctaaaagcttgttcgaagatcctcaagacgtcataagaggggccaatctttcggaaaagaccttcaagaagtttttgaagatttctcttgatgaaaactataacctgcatccttttgagttcaaccactcccacttctgcactatggggtttgttacctggtgggaaagatattactcgacccgttcggttggagacactactaacatgatctccaggcttgagagtggctttgtgcaaccaacggtcgagaatattcgctcaagccttcaagctcgaggcaaagcacctatgacgaagaggagtgctgaaacgcctcgagctgacatgagacccaagaaacccactggggtaaaatccaagaagggaaacaagaagagaagagtcaaaagaaagatgatagcactgagactaccacgacctcaaaacgctcgaagcgtgtggtcatcgaattcgacgaagaaaaagatgcaagaagaagaggaaagacctcttataagaaaaagaaaatcacctgagacttcgaccaaacctgctgatcaaacagaggcaggcaattcccaggctcaaatgcctaagaagaaaaagaaagtgaaacaagtcgagcctgaaccttctgtgactgtcgagggtggcgagccagccaggaagaaaaagaaaaagaccaagccttcaaaagaacaaggcgagaatcaacctgttgacgtccaaccaccttcgactgatgttgacggcactgaagtagaaactactccctctattgctgagatgggcaaccctgtcgagcaaccggacttaccacaagaacaacctaccgtcgaggtacaacaaaatgtttctgtagaagaaataccctcatgtgctcgaacctctcctgctcctgagacggatgcagtgaatgttgaggaacagggtgaaggtcaag

SEQ ID NO: 16862 - DNA, 357 bp, Glycine max
  Peptide Sequence Number=SeqID_108547
atgtggaccaccacaggggagatgcttgccgcccagctcgcccaggcgagccaggaactttcaattggtgctgcccaaagacaaactcctgccccgctgacagccttgaatgctcaggctcgacccaattccaatgacaaatctcggcatggacaaaaccctgcacaatcaactcaacgcactggcactcgcaaaccttttctcggctgctgtcagtggtgcaacatcaaaggtcatgttctctctcagtgcaaaaccttccagcagcagcatcctagtgtcccaccgccacctcgtaactctctggctcacactggacaggttcaggtcaatactgcaactgccggcccatcgtaa

SEQ ID NO: 16863 - DNA, 459 bp, Glycine max
  Peptide Sequence Number=SeqID_108548
atgtctagccgaagatccagacaacattcagggtctacaaggatctccgatgaccaaatcatcgaacttgtttccaaattgcgccaacttgttcctgagattcgcaataggcgatctgataagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16864 - DNA, 423 bp, Glycine max
  Peptide Sequence Number=SeqID_108549
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggattaccggtgtcattccgctgttatggccgcgtttgtctcattccacgcctgacactcagttccggtccgaccgctgcgccttatccggtaactatcgtcttgagtccgacccggaaagacatgcaaaatcaccactggcagcagccactggtaattgatttagaggagttagtcctgaagtcatgcgccggttaa

SEQ ID NO: 16865 - DNA, 574 bp, Glycine max
  Peptide Sequence Number=SeqID_108550
atgagtcatcattcatctagtgttaatggcgagggtactagtcataaagaccctttatctagaatcttagatgagttaagttccctcaagttatggaaagaagaaaaagagagaaaagaaaaaggaaaaaaaagagtggaagaaataagtcaagatgaaagaaagaaaataagagaggaagaaagaagaaaaataatgaaagaaatgaaaagagaaaaacattgctcctatagtagtcataactcttgcaagagcctaagtgaagaacttcgtgactattatgaaagaaggcataggtcacatcttagacctcactcccataaaagagaaaaggaaagaaatcctcaagaggctaacattaacctcacatactttcataagaaagacaatgtagaggctaacttagattgggaaataaggatagagcaacaacttaaaaagaagtctacttcaaaatcttatggctctcactcttatccaaagaaagaccaaggtcaagatatcttaggggtgacaccttctaagcccaaagatgataaggagaagacaatagaaaagcaactccttaaggcta

SEQ ID NO: 16866 - DNA, 264 bp, Glycine max
  Peptide Sequence Number=SeqID_108551
atggagtgcttctacatgatttcgcatgcatttatgactccgacacaactaggggatcctcctaaagttccacctgttcaatactatgacacatttgttgaaccagatatgcatcagcaatcggtagcggcagcggctcctgatgacgcagacgttgatgtgcatcgtctaggacatgtagtggatggttatgtagcaattgctgataagttggagaagcttttgaacctgaggatcctgaccgaaggaatagaagcctatacg

SEQ ID NO: 16867 - DNA, 149 bp, Glycine max
  Peptide Sequence Number=SeqID_108552
atggagaaagtgcttgggacgttagaaatggtgtttttcctaagctacacgaaagcaaaggctgaaaacgctcaagtgagaaatgctctcgggaacggaagcttcgcgcccactctagacatcttctcaaagatcctaaccgtcagatt

SEQ ID NO: 16868 - DNA, 789 bp, Glycine max
  Peptide Sequence Number=SeqID_108553
atggaaaaacggctttgccgcggccctctcactttccctgttaagtatcttcctggcatcttccaggaaatctccgccccgttcccttttttctcctgccacatgaagcacttcactgacaccctcatcagtgccaacataggaacaaaagctggtaccgggccccccctcgaggtcgacggtatcgataagcttgatgtcgtgctaatcccaaaatctcttccattagatggtgcagccccgttgctatgtgctggaatcacagtatacagcccaatgaaatattatgggcttgctcagcctgggttgcacttgggtgtggtgggcctgggaggcctaggtcatgtggctgtcaagtttgctaaggcttttggtatgcattctggaccagcaacaattgcaggtaatttaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 16869 - DNA, 192 bp, Glycine max
  Peptide Sequence Number=SeqID_108554
atggtgccaaaaacttgttcgaacccggcaagtgcaccggattgcgcaagtagtataaaacgcctaatcctgattaagcatcatcctcagattcctcttgttggactaaactcgaacagaatcgcattaagacaaacatacaaacaactaggttaccgtaccccgatccctcatgataatacgataaactag

SEQ ID NO: 16870 - DNA, 222 bp, Glycine max
  Peptide Sequence Number=SeqID_108555
atgtcgctcgagcaaacaaaccaatggctcgcacctgaaaatcctgatgagtcattagagacatctaacaacagctttcaaaattgccccatccagcccgcatcaattagaccttacaccttacgcttgagggtcatacagtgctcaatggaatgccccagggccctccacgatatgcacatgttgcgttcgagtcatatcctcagaaaaatgggggtttga

SEQ ID NO: 16871 - DNA, 150 bp, Glycine max
  Peptide Sequence Number=SeqID_108556
atgggtgccaagtacctcgaagcggtcaagcaaaggttgcatgccatcaaacaatggtccccggacgaaattaggtttttacatatatctaaacctgggacttacatgcccaatcaaaaagtgtcaaagaaccaactaaggaagagttga

SEQ ID NO: 16872 - DNA, 411 bp, Glycine max
  Peptide Sequence Number=SeqID_108557
atgccaactcaaattcattatgcacatacttcacatgcttctgttttgcagggacaatggagaaaccaccctggaaatcagttcaatagagatcaaggtggaccatccacaaggccacaacaacaagggcctagtctctatgatcgcacaacgaagctggaagagactctagctcagtttatgcaggtttctatgtcccatcagaagagcacagagtctgccataaagaatctggaggtccaactgggacagcttgcaaagcaattagcgaataaatcatcaagcagttttacatctaatacagagaaaaatcccaaggaggaatgtaaagctgtgatgactagaagtagaatggcaatccaaggaaatgatagtgaagctggaaagaagatggaggaacataaacaatag

SEQ ID NO: 16873 - DNA, 49 bp, Glycine max
  Peptide Sequence Number=SeqID_108558
ggtgaatgctgtgaaaattttcccgaacgcccaaaatggactcagatga

SEQ ID NO: 16874 - DNA, 426 bp, Glycine max
  Peptide Sequence Number=SeqID_108559
atgacattgctacttagcaacattctgcccagcgaccgcaatgccaatctccccctgcaaaagtatcagttggtctgtgtcgtcccgacatggggatcgcacccacaaagacacctagtggacctgaagaagtccaacagggccctggggtttccagctctggttacgggcctctgtcggccctacagggcacccgttccccccaacaagttcatgtcgtcgtggcatacggattgtgcccgcaagacacctagtggacccgaagaaggccaacagggtcttggagttgccagctctaaatacgggtctctgtcagttctacagagtgcccgtcgccccaacaaggtcattaggccccacattaaccaggctttcatcaagaagtactgtgcccccaaacgggcgcagggcgagacaccacagtag

SEQ ID NO: 16875 - DNA, 955 bp, Glycine max
  Peptide Sequence Number=SeqID_108560
tacgccaggtgaaggatcggtgttctccttctacttccgcgcgccggccggcgaaaccgcgcgatcaaacccaaccgcatctgtcacagccgctggtcaccgacaagctgtggtggtgagcgaaagcgccgttgaagcgctgaagctgtggcagcaggatccgctgcgctttgacctgatcattaccgactgcaatatgcccggcatgaacgggtttgaatttgcccaggcgctgcgccagcatgaacgccaccatcatctgccgccgatcacgctatacggcctgaccgcctccgccgagcagcacatcatgcagcgctgcctgcaggctggcatgaacgactgtctgttcaaaccgcttaatctggatacgctgctggcacaaatcacccactgttcgcgccgcacgccaaacgcgcgtgacagcgaggcagctgtgaccgggcaacctgctgctgacaccgccgctgccgcgctgccggcactgcggcgccacgatgaattgctggcggcgctgcagcaaaccactgatgctcacgcgctgtcacagcttggccataagctgaaaggcggtgccagtattcttaatgccagcgcgctgatggagctggggcgcaagctggagaaacaccagcaggaaggacacgatgtcgcgcagctgattgccgccatcgcacataatgtgcgccagcgccatcatatcggtgtcgttaaagggagatctatgtttaatgcaaaaattctcatcgttgatgagcatcgccttgttgcggctgggcacatcgacatcctgattttagatcctgatttcaaagagaaaaatggcatcgcctttttacgcgatatcggcgctaacggcttcgtgtcgaaatacgatccgattcagacgctgaacgccgcaaatttccagcccgcacttttcccgctagagttcactcatccgaccactcactga

SEQ ID NO: 16876 - DNA, 819 bp, Glycine max
  Peptide Sequence Number=SeqID_108561
atgccgcagcgcgctattcatcagggcactgaagtccttgagcccatgctggctggcgcctggcgcggtcactatccgcacaagaatgccgccgccgcatctttggtgctgatgagttttctggggctttacatccggaaacgcggtttgccgataacaggtctgctgattgtcgccctttgcgtttttttcgtactgcatacaggcggcaagacatcgacggccatgttgccttttatcgtggtgatgtcgctggtgttcgtgcggtggaaatggacgcgtgttttcattgcagtcggcgggatcgcggccttcaacattgttgccgtaggggccgctgtcttcgatccactgcgcgagcttgtagaaagcttgggagttgacgccagttttacaaaccgttctgatatctggaaacttgcattctctgcgatctcggccaagccgattttcggctacggtctggactcgttttggaaaacgcccgaaatggtctatgcaggcggcggcggtgcaagctgggcggttgccgccttcaatgcgcataattcattcctcgatatgatgatcaatgctggcattattggtctcattctgacactcatctgggtaatgattttgccgcttcgatatattagggaagcggaaagcacagacaacgaccctatattaacgctgctttacattcgcctttggctttacggattatatatgtcttgtatggaaagtacgttctttcagaacggtggggcactatggttctgtatcatggttgctgtcttcggattgcgcttgcaggctaaggcaaggcttgtctga

SEQ ID NO: 16877 - DNA, 688 bp, Glycine max
  Peptide Sequence Number=SeqID_108562
tgctggatctatgagcacttccctagtgtgcatcagtgcgtgactgacgacacataccaggagacgtccccacgtgcttcccggtggttgacgtcgaaggcgcacatgaagggcatcacaggagcaccctacagggcacgttgtgatggtttgaccgtcacagatgtgtcctggttgccgtacacggagcatcggggtgttagggcgtttcaggagatttcatcgttccagggtcagctcagatggggtcctatgatcgtcgcagttcgaccggagagggtggtacgccagttcggttacatccagagcatccctccgccgcctgttagtgcacgattgtcacaggagcagatagatgacaggtggatggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattacgagggatatgagggcgattgcacagagggggacccagtgctgatgggacggtcagggctcgtcagagacgccgcacggaccattgatcatt

SEQ ID NO: 16878 - DNA, 690 bp, Glycine max
  Peptide Sequence Number=SeqID_108563
atggaaacatgtttggaagtagaggaattgttgcagcgaatgatagatcaaggccgactggaagtcggtgatgagggaagagaagagcaacagatatgtatgcagtccgtggatgagagatgttttggaaggcccaaacctttggtgatatatttcaccaagggcgcagcttcgcaaaaaccccgacacccctcgacacctaagcctgtccctttcccataccaaaatagccatgcagtcccatggaggtacacacctccgaacaaagaggaagaagaagccaccgacatcagttcgttgtcggccaaagtaaccaatatcacggggctgagcggtgtgacccacagcggtcgtgtatttgtgccccccgacctaccaattcatcccacgaacatcaaggggaaggcaaaggtagtcgaagaacaagatgataaaatgcccctcactccaattgaggatattccggcgaaaggtcttctagagaaaagggatggttatggcaagaaggaggtgtcgctagaggaagccaacgagtttctttgcataattcagcagagcgagttcaagggtctcgctgttggaattactcatgagctcggaacctcatcgggctttgctaataaaggttttgaacgaggcccacgtggcccaagatatctctgtggagggcttcggagggcctgtcaataa

SEQ ID NO: 16879 - DNA, 639 bp, Glycine max
  Peptide Sequence Number=SeqID_108564
atgaaacatattttaaagaggttgtctgagcatgttgaaagcatacaattaggggtcattcacccaccaccggagttacacccttacaatcaatatgaagaaaaaagactttctcatatggagaatgtgttgatgcaattcatggaaatatcccaagctagctttaaagccaatcaaaactcaattcaaaatctggagattcaggttggcgagagttactccatggaaaattgttggtgggagcaagagttacaaccttacaatcaatatgaagaagaaagattttctaatcttgagaatgtgctgatacaattcatggaaacatcagaaactaacttcaaagccaatcaacatgcaattcaaaatttggagattcaggtgtttccgggatacatgagtttcatggagtctctagctaagagggaaaagtgcaaagaagatgtgttctatgaggttaagaaaactgtaggaatgtcttgcatgagtgaagtgataagaagcaaccaaatgcctgtacaagttgcctggccaggagtccagtttccttctgtaaggggtgatacctttggtattggtaatgatgatgtagacaatgctactgctcaggaagctttggatccagggcccacacaagattga

SEQ ID NO: 16880 - DNA, 1161 bp, Glycine max
  Peptide Sequence Number=SeqID_108565
atgcaacttaagaaggtcactaatagggataagaaaatccaggaaaggcaagctacactgggtgacatgactttggaggacttcttggtgaaggctggagtggttgctgaagctttgccaaaaagggagtatatgaagaatgacactgcagaattgaagatggaagctacagtcagtaaacttgtgttagaagatgcagaaacaaagcttagaatttataggaacaaatcggccatgattgcaaggctttttcctgggacaacagataatgcagtgaagaatcactaccatgttaaaatggccaggaagtataggggacaatccagtgcttacaggaggaggagaatgagccaatctgtgtacaaaagagtggatcaaaatccaacctttgtttgcagcagtagagataataatgcctcaaccacagaaccagaaccagaatcattgctttcctattaccccaatctcaatgacctagctgctgataccactggtggagatgttgactttggctcaaatgtttctccactaaacatgactagaggtagagaagtaatgtcaaacaccacacatgttggcttgtgtgctgaagctcaacaacaagcaccatttgatttcttctctggttataagggccacaaatatttgtcaaagggagagtctaggattggtagaggaaaacaaaagcttgatggaaacaagaatgcatgcattgagacaatgtctaaaccaaaacatgtgtatggaatcaaagttaaacaagttcaatggcttctgaggtgttctttgtgcaatgaggagtgttacctcattgcttctaatgattttgctatatggggttgcatattgttggtcttcctcatgctttggccaacaacgcagaaagttgcacaggagattggccagaataatggccaacgagggattctgcttcttgaattccaacaagcaaagattgccatggaggaattgaaagtggagttggagagaatggtgggttatgatgcacaatatgagatccaagcaaaagttgacaacttgaaacattgctttggattgttgagatgtggggttgagactataacaagacaacttgatgatttctttgatgaaattgtggaaggaaggaagatgttgttgaatatgtgtagtcataagtag

SEQ ID NO: 16881 - DNA, 327 bp, Glycine max
  Peptide Sequence Number=SeqID_108566
atggaaaacgccagcaacgcggcctttgtacggttcctggccttttgctggccttttgctcacatgttctttcctgcgttatcccctgattctgtggataaccgtattaccgcctttgactggcacgacaggtttcccgactggaaagcgggcagtgagcgcaacgcaattaatcacactcccagccgaggttatcttgaaggtgtgcctggttgggtgaaggtgcatgccctcatgcaagtacggcaaaagatcaacactgactggaggtggaacccaaaacctaaatattggaagctaaggaaggcttgttggccttgttcatga

SEQ ID NO: 16882 - DNA, 454 bp, Glycine max
  Peptide Sequence Number=SeqID_108567
gtgtggccaaaccaatcataacattagaagctgtaaaaatattggagttcctgttaggccaaagaaatatgttgcaccatcaacttcaaatgaggataaccacctattatctcaagatgaacaagctttgaatgaggctgaagaagctgctgctcatgttcaacaagattcggtggagattaatttatctcagcctcatttgtcacaagatagtgacatggagttgatggtccctgcaactattgttccaccaatagcaaggaataagctaaccataacaagagccaaacaaaggaaggttgctgataaagatgatgttgatgagtttgaagttcgaatagttgcacgtcttccatggtggcattgccgaatgaaactaccagaaaatgcacaacaactgccacttgcagacatggagaaatcaagtgaacaagcagcagcgactgagccttag

SEQ ID NO: 16883 - DNA, 378 bp, Glycine max
  Peptide Sequence Number=SeqID_108568
atggcattagtagatattgttgccatttcatacggttgtggtgatgacatgaagtttcctaacatacgtggatgcacgttgaaggcgagggcaaaaagccttgttgaagaaggccaatgggtgtccatgatgcataaggactacacccatagcgtggctggccacattcgtctcggtgacaaatctgtgaagaaagggtttaaggagcttattcacggtggcttggaagtgttgtattctgccattaggatatggtggaatccttggagtaagtcaagtttcaaaaatcaggaagttgtgcccagtttgtccaacagctcatccatcattgacattggaaagcagtccttaatcgtgattgcgtccagtgctttatag

SEQ ID NO: 16884 - DNA, 369 bp, Glycine max
  Peptide Sequence Number=SeqID_108569
atggcgtggggtaatggaagtatcgagtggttagggaggggggtcaagagtagcatcttcatctttaattatcagcaaaaagaagtgggtcttgcatctgtgatggaaggggtggaaaagaaggaagttagggtggtggttgtggcagtggtgttgtgtttgaaactcctgggcgaacacgatagctcttgtgacgatcctccagtttattctcttggagctttgccaatgatatcgcctaaggctccatttgggtcgtcgaagcgaactgagattcgagagcctgcagaagtgatggctgaggcttgtgtggtgtttggagttgcagggcctgaagttgttcttgaatggcatccagccagagggtga

SEQ ID NO: 16885 - DNA, 273 bp, Glycine max
  Peptide Sequence Number=SeqID_108570
atggaggagacagaggaccgggatatcatactcttggcaatcctactggtattttatctggaggcatgtgaatttggaagtatctttgaaggtcttattcctgaagatattaatatttatgcaaccacaacttccaatgcagaagaaagtagttggggaacatattgccctggggagtatcctagtcctcccctagaatattcaacttgcttgggtaatctgtatagtgttgcttggatggaagacaagtatgtgcataataaagaatcatag

SEQ ID NO: 16886 - DNA, 399 bp, Glycine max
  Peptide Sequence Number=SeqID_108571
aggacaaagcacattgatattaagttgcattttgtcaaagaagttattggtcaaggatcagttatagtcaagaagatttcaactgatcacaatccttctgatatgatcacaaagaaaaacaaaaaagaaactaaagggaacggaggagcccgaaagcgcagcattgagagaggcgtcgcttggttggtgcatttcgttgaacaccttgagtgcgtcaaggaaatggcgagggttcgcagcgtaggcggatgtgagggcggaagaagcataagggtcggaatggaaaccgattttgaggagatgggcatggagggtttgggtgtgggaaggggaacggaggttggtgcatgctttgaagagagtggggaatgtgaaggagtgaagggtgggggaaggtga

SEQ ID NO: 16887 - DNA, 279 bp, Glycine max
  Peptide Sequence Number=SeqID_108572
atggtttggattggtgtggcacaacttggatcttggtggggtgagttgcgtgagggaatatggaggaagagtatgaggttagaaaaagaagaaggaagggctgaggggaaggtgaaggaattcgacccaagcccacaacaaagttacaatgaggaggaatgcatggagtcagatgtaatctttagggaatcacatgttagcatcttgctcacacccacttcatttgttagtcaggacctggaagcaatcatcctatccattggaagcattcgttgttag

SEQ ID NO: 16888 - DNA, 348 bp, Glycine max
  Peptide Sequence Number=SeqID_108573
atgcacttgactgtagaagcaagcttcatgatgatgaatcaagttgattcaagtagttttgatgataacaaagatgatgacaaaaagctcaagagaatgatttcaagattgagtcaacaaggtacatcctttgtggtacaagtaaaggatacatctacttggattgttgtaactgagaacaagagagggtacatctcttgtggatcagttcaagtggaggatacatccacttggttgttcaaagagaacaatgaagggtacatcccttgtggatctttgcttgtaaaggtttttacaaggttgaaaagaaatctcaaggaccgcaggtcgcttggggactggatgtag

SEQ ID NO: 16889 - DNA, 858 bp, Glycine max
  Peptide Sequence Number=SeqID_108574
atgaaccaacatacaacatattcaaagtgtggtttttggcattttgcttttgaggttttcaagggggtggaagggaatagaagaaatttgatcacttggaattccatgattgcgagaatgatgttgaataaagagagtgagagagcagttgatatgtttcagaggctggaatctgaagggttgaagcctgattcagctacttggaattccatgatcagtgggttcgcacaactaggggtgtgtggagaagcttttaagtactttagggaaatgcagtatgttggtgtggctccatgtttgaaaattgttactagccttttgtcagcatctgcaaattcatctatgttacggcgtggaaaagagatacatgggtttgctttaagaactgatatcaacagggatgatttgttggcaactgctctggttgatatatacatgaaatctgggcatccttcttgggcacgaggagtttttgatcaatttgatgcaaaaccagatgatccggcattttggaatgcaatgattggtgggtatggaagaaatagagactatgagtctgcctctgaaatctttttgatgaaatgctggaagaaatggttcaaccaaacatggcaacatttgttagtgatttatctgcttgcagccacatgggtcaggtgttacctagattccaatcttggggaagaaatggccaagaagcttctagatatagaaccagaaaaccctgctcctctggtggtattgtctaacatatatgttgggctgggaagatggaaggaagtggaaagaataagagggatgatcacggataagggactggacaaactctctggctttagcatgatagaacttgcatga

SEQ ID NO: 16890 - DNA, 264 bp, Glycine max
  Peptide Sequence Number=SeqID_108575
atggcatgtctgatccaacgaaaacaagcagtcgggctcacggagaagaagagaagcagcagcgaagaagagaagcagcagcgaagaagagaagctcgcagagaagaagagaagcaacaacaaaggagtgaatgcaatattgttgggtgcaccttgcatatccctctaataagctctttttttcttggggttcagagttcagacaagcctaacttaacaaaagggctattttttcctgaactccctttttaccttccggaatga

SEQ ID NO: 16891 - DNA, 481 bp, Glycine max
  Peptide Sequence Number=SeqID_108576
atgggtgagagtgcattgctgacaactgcttgtgggaagaacaaagcaactaagtctcaagctaatcagaaggggaatgacaaagtatcacctcaagctgatattaagaaggttagtgaaggatggggtactaatactctagattttactgactttaagacttgtatggactgcattaagggtaagcaaaccaacatgtctaagaaaggtgttaacaagagttcaagcatatatactaagaatgaacaagcacctggtccttttgcaaagtttcttcaagaacatgagattgttgcccagtacaccatgtctggttctccaaatcaaaatgctggaaatgatcccaaaacttttgatcaagccatgagttataaagagtcaaatttatggcatgatgccatgaaggatgagatgaattccatgcagagttacagagtttggaaccttgtagagttgcctgatggggcaaaggccattgact

SEQ ID NO: 16892 - DNA, 999 bp, Glycine max
  Peptide Sequence Number=SeqID_108577
atggaacctgaattgatgatctctgggaagcatgttgtgatgtggagccacaaaacacgtgaagggttcttcgtggattgtctaagcctaaggccaagtgccccggagaagaagattggtttagcgaagatgggacaaatgttcagtatgtttggttttgtgcaagtggaacagtcaagtgtggcgatcaaggaagttttcgggaagtacaatgatgttctcgatcctggttgccactgtgtgccgtggtatttcggcaatcgtgtggctggtgcactttctttgcgtatacaacagctagatgttcgttgtgaaaccaagacaaaggacaatgtgtttgttactgtggttgcctctatccagtatcgagcattggcagaaaaggcatcagatgcttactacaaactcagcaataccagagcacagatacaatcctatgtctttgatgttataagagcaagtgttccaaagatggaactagatgctacttttgagcagaagaccgacatcgcaaaaacagtggaggaagaacttgaaaaggctatgtcagcatatgggtatgagatagttcagactcttattgtggatattgagccagatgagcgtgtgaagagggccatgaatgaaattaatgctgctgcaagattgagggtggcttcgaacgagaaagcggaagcagagaagatagtgcagataaagcgagcagaaggggatgcagaatcaaagtacctagcaggccttggagttgctcgtcagcgtcaagccatagtagatggcttgagagacagtgtgcttgctttctccgagaatgttcccgggacaacatcaaaggatatcatggacatggttctcatgacccaatattttgacacaatgaaggatattggtgcatcctcaaaatccaatgctgttttcattccacatggacctggttctgtacatgacgttgcttcacaaattagggatggtcttcaacaaggaaatgcaacaaagtcttga

SEQ ID NO: 16893 - DNA, 1340 bp, Glycine max
  Peptide Sequence Number=SeqID_108578
ttgccaacatcacttatccacattctttcatccaactgattcaaggctatctctttcatgggctacccaatgaagatccatacgcccaccttgctacatacatagagatctgcaacatagtgaagatatcaagagttctgaaagatgtcatccgcctcaagcctcaacctgttttctttctccttggccgatgcattactagcttagaacaagctcttagccaagcaaatagaaaccctcacaagacattgaacaagcttcctcaacaattgcatgtagtgcaacctactcattcttcagctatgcaaattgggggatgcaatatttatggtggggcccatgagtcaagcatgtgcatggcttacgataatgcatctaaagaggccaaagttgaagatcccatagtgggaataacttcaacaaagatcaaggcggtttctctgtcaaatcacaagagcaccgagtcagtaatcaagaatctggaggtacaagtgagccaattagctaagcaattggctaaaaagtccacgagcaattttgtcaccaacacggggaataatcccaaggaggagtgcaagacaattttcactaggagtaagaggagggagagtgctgagaagagagctgagggagtattgaaggatgtcttgaccactaagaccaaaagtcagttagtttgggaggctagaaaggagataccctcagtcctagtgaaggaaatcccatatcctttggatatgcctttgtataccaaatttctaaaggacttcctcacaaagaaagggaaatatataaacaatgagagtatcatggtggaaggaaattacagtaaagctctcattgatctgggagaaagtatatatttgatgcccctctctatgtgccagataatcgaaaatctcaaacttgctcttactagaatgactcttcaattagcagaccactccattatcaaaccatatggtgtagttgaagatgttctggcgataaagcatcctaacacttgcttcaaggtggaggcaattgagcaagaaactgaccttgttgagcgacacctaaagaatgtgcttccaaaagaagatgaagccaagctagttgtgaatccagtagacccttccattgtcttcacaggccacttcttctacaaacgacaagccttctccctcttcttcttagtcgaagcagcttttccccatgctacaaagccttcaccatggatagtaccttttgatgcagagcctttagggggtgatacctctggtattggtaatgatgatgccccagagattgaagttgatgctaattacgttgcggacatcactgctgcacaaggagcttag

SEQ ID NO: 16894 - DNA, 1689 bp, Glycine max
  Peptide Sequence Number=SeqID_108579
atgggattgggaacaaccgcggcgagaagcagaagaagaatcgtcatcgaagaaggttctataagaacaacacacaccgccaccgccaccaacgccgatgccgatggagctggagctagcttcaccatcaccgacccctccatccctggccaccccatcgtcttcgccagcccgggcttcctcaagctcacgggctacgcggcccgtgaagtcctgggccgacccgccgccatcttccagggcccgcgaacttcgagaaaatccgtcattgaaattcgcgaggccgttagagaggagcgaaacgcgcaggtcgttctgctcaactaccgcaaagacggcacgccgttttggatgctttttcgtgtttgccccgttttcagcagcgacggtggcgccgtcgtgcactttgttgccgtacaggtgccgcttcagaaaaaggaagggtctggagtgagggatttcgggttcgggtgctgtcggaaggaagtatgcgccgattcgttggcggagattggtcgcgtttgttcattagagcaagtgctggaacctgacgttagagaattggagagagaagagccgtgtgaggcaagtgatgaggagaagcgtagtgcagttaatgctatggacaatatattttctgtgctaacccattatagtgaggcgacgggcagattggtgtgtcaaaagagatgcagcattcctgatgtgggtcttttaagcacatccttgattatttctcttggtagaatcaaacaaagctttgtattaactaatccgcgtttatcagacatgcctattgtttatgctagtgatgccttcttgaaattgacaggttctaaaactgttacctttcttagactaatgggaatggaccatcttgttatgccttctcttattgcttacgttcagataagggagagcattaaaacagaacaaccctgcacagtacgtattttgaattacaggaaggacaaaagctcattttggaattttcttcatatctcacccgttcgtgatgcttctggcaaggttgcatactttgtgggagttcaaatagaagacagcaataaaaacgatgatagccattgtttgagtcctgagaagaggcagcttaatgtggttggtgtagtcaaggttgcagtgaggagtttatcaatgactcttacccaaaccttgtcacctcctgaaccgccacaatatccaacaccaatagcatctggttcaccttgtaccattaggaagcagaatcatatcaggcataaccctaggaatcggcataacttccataacccatgtaggattctcatccgtcatgggatgagagttgcggaggattctgtttttggtgtagtcgaagaggatggagttgcggttggcgaagatgaagaggttgccgtcggggaggaggtgcaagaaagggtaaagattgttctcctcgccgctgttggggtcgcgggcgtaccagcggtcgcggggattgaagcagcagcggtggccagagagggagatgttggaggggccgaagtcggtgcggtcgaagatcactaccttcttgtcgtacattacttgcatgtgcatggcggagatgcctatgctgcgttgcagctgaacccagtggccaccggtggtgcttgttgttccctcttgaagtgtcacggtgaattggagaagaagaaggaagaacgatga

SEQ ID NO: 16895 - DNA, 639 bp, Glycine max
  Peptide Sequence Number=SeqID_108580
atggccacaaggagattaattgtatggagaaaagtttatcctaaagtgctagtcaagtgcaaggtgccgccacgaatttgggttcttaatgtggaggcggatatgggggtaggtgaatcttcaaaatctgtggggaaatcattggatgatttagttacaaataattatggctcaagattctatgtgtttaattatgcacatgaggaaaacaataggtctacatgtggtgtggaagaacgggagtccaataagaaggctttcgatattagctcgctggagttcaataagaaggcctctggtactagcttgttttcttgggccaaacatagttccaataacaaggctaaggcagtttcaaagccactccttagtaagccagactcaggttcatcaaagaataggcgtgtggccaagcgggtggtatatggtgtttatggaaccctgcatgttggagcggagctagcttatgacatggacaaagcatgggctatcgtgggagatttcaactttatccttcatgcccatgagaagatacgaggtgcaaattctccaaatttaagaggtatcatagggtttagccaaatgatggaggtttatgagtttattgatgttggattgcaggggtacctcttcacatga

SEQ ID NO: 16896 - DNA, 1014 bp, Glycine max
  Peptide Sequence Number=SeqID_108581
atggaagaaccaaaaaaaacagagaacgaagatgacaaggatgaatcagaacaacgagtgtggagttggggtgctggaaccgagggtcagttaggaacaaaaattcttcaggatgagcactttccacaactccttcatcaaccctctctctcctccatctcttcccttgcctgtggcggcgctcatgtcattgccttgacctctgctgggaaggtactatcatggggtaggggcaattctggccaactaggccatgggttggttgtgagtaactctttgtatcccaaggctgtgacatcattggatggctacttcataacccatgtctctgctgggtggggccactctggttttgtttcagataatgggtgtgtgttcacttgtggggatggctcctttggtcaactggggcatggggatcatgcctcacactgttctcctgtcaaagtgtcatgctttgttgatcagcatgttgagcaggtggcatgtggcatgcgccattcccttgtcttgttaaaagattgtacaggaaatcaagtttatggatttggctctgggaagcgtggtcaactgggtgtcagcaacgatagggtcaaatctgttaatgttcctaaagttgttagtgggtttgaaggtgttgaaatcgctggaattgctgctaatggtgaccatagtgctgcagtatctgttgatgggcatgtttacacctggggaagaggcttcaagggctttgaagatgctcgtgttcctcagtgcttaaactcttcattgaattttaccaaagttgctctggggtggaaccatgctttagctatgagtggtgagggggaggtttgtatgctaggtggaaatcaccttggagtgcttagtgatcttcagaacataagcccagctaagcatttacctcatttaagagaagtcaatttggagaaagtccctggtcttgatgggacgaaaattactgatattgctactggagctgagcattctgtcattgtcacaggcaagatgtag

SEQ ID NO: 16897 - DNA, 114 bp, Glycine max
  Peptide Sequence Number=SeqID_108582
atggaagaaaacaaagaagggggaaaaggcatggacccttcaccctacgccaagaaagcgagggctagtatcaacgcactcacgtttgatgcgccagacgaaaataatgtatga

SEQ ID NO: 16898 - DNA, 225 bp, Glycine max
  Peptide Sequence Number=SeqID_108583
atgggtgttagtcgtgtagaagcaagtttcatgatgatgaatcaagttgattcaagtagttttgatgatgacaaagatgatgacaaaaatcccaagagaatgatttcaagatggagtcaacaagttcaagatcaagataaaatcaagattaatttcaagtttcaagaaatgacatcaagaagaatcaagattcaagagaagatgacttcacaaggaaagtattga

SEQ ID NO: 16899 - DNA, 966 bp, Glycine max
  Peptide Sequence Number=SeqID_108584
atggctgcctcagctttgtcactaacatccccattccatttcagaaaaccccacaacagggtttcacctctcaatgctcatcctctcattctcatccaaaagggtaaacaatctcttaaatcaaacttctcattctcaaccctgaatgcttccccccacttcagaccccctattgccattgctccttccacactgaccctaacaagagcttcttcctctgatgaatgctttgaccctgctggtgaagcccaaaggttgctgctttctgaggaaaaaccagttaattttgctttctgggtcatattttgggcctctttgtccctggcttggtttgctgtttcaagggatgctaatgctgctgttgaatcctccatcaaagcctctggctttggcttcaacattgccaattcgttgaggaaattgggttggcctgattgggttgtggtgttcacccttgccactcttcctgtgcttgagcttcgtggggctatacctgttggttactggatgcaacttaaccctgtaactttaacagtgttatctattctggggaacatggtccctgtgccattcatcgtgctctaccttaaaaaaattgcgtctttcgttgctgcgaggagcccttctgcgtctcgattccttgacatgctgttcgagaatgccaaagagaaggctggtccagtggaggagtttcagtggcttggtctgatgctctttgtggctgttccttttcctggaacaggagcatggaccggagcctttatagcatccattcttgatatgccattttgggctgctgtgtctgctaatttctttggtgttgtatttgctgggttgctagtaaatttgttagtgaaccttggtctgaagtatgccatcattactggtgtcatccttttctttgtttccacattcatgtggagtgtccttagaaatcttaaaaaaggtttgagctcgtcaaattga

SEQ ID NO: 16900 - DNA, 312 bp, Glycine max
  Peptide Sequence Number=SeqID_108585
atggtgttcaagtgctaccataccctactcatccgcaagtttgaagacaaatccattgatcatgtcgcctcactctttgacaaagaggtggtgaagatcctcctgatgagtcatttgggcattctaacagagacaaaggcttctatagcggcaaatgcaagtgtcaggtcatgggtgtttgcacatttatcaactattggctatttagagtcgggggattatgttgtggaggacctggtagccactagatggaaatcgttgagaggaaccgggtgtgtccttccggtcagggagagactagataagctataa

SEQ ID NO: 16901 - DNA, 1299 bp, Glycine max
  Peptide Sequence Number=SeqID_108586
atggtcaacaaaatcaagattgagaaattcacagggaagaataaatttgaccttcgacacatcaagatgcgagccttgttgaaagaacaaggcatctgggctcctttcttcggtcaattgttgaagattgataagtcaacccttgggttacaagaggaagaggcgaattcactaattctcttatctctatctgatgaggaaggtacaccattgaaggaacatcttcatgagctaaactttgttttgatggaactacgcaacattgatgtcaagatagaagatgaagatctaacaacgattctattggtctctcttcctcctttttatgagaattttgtgagttcttttagtatagagcttcgactaaaggcgtttaggaatggtgatgaagcctttacgttcgaactattggtgactaattcttctaaaggacagaaggagaagaaagacaaatgtggtaagaaaagcaaagcttatcctaaggacatatgcaattactgtaaagagtcggcgatttggttttggttgttggtgaacaactacaacaacattttgaacaatgggtactggactcagcagagcgtggagctctcgcctaatcagtatgatgaattctacgatgagctgaagcggaggcaggttaaggggaaactcattaagtttgacgctcagacattgaacgctttccttgagaccccgatcatcattccaaaaggggagcaactagcctcttacgcccagtacctccacacctacctcgaccatcacaccatcacggtgatgctatgcactttgggtggtaatgtcttttcttacttcaacctggcccctacctcccacacctctgacctcaacgtcgattgtgcccgcctgatatatgggcttgtgatgaagatggacttggatttgggcagcctcatctctttccagattacacagattgcccagcccagtttattgcagttgggcttccctgtgctgatcataactctttgcgatgcaaaggcggttacctttgactccctgaccttcgattcactgagcccagtgatcaatttggcctacattcggaagaacaactggaatctacaaatccttccatcgtcttccccgggtcagggctcaagccactctcgatgttccaccagtcgctcctccacctgtggtccctactccagccgtctctcctctacccgccgacccaccttctctcctttcttctcagccagaccagctcctccctatgctgcagagtctccaacttcaatctccgtctctttcttgctctcagattcttag

SEQ ID NO: 16902 - DNA, 1359 bp, Glycine max
  Peptide Sequence Number=SeqID_108587
atgtctatgcgtgagaggttgattatgagcacaattgtagttggaagtattgaagaggcatggtttgattcggttgcagtatttgactctgactgtgatgatgattatcagagtgttcctgatgatgttgtatctctgagtgggattgaaggtggatctgtatcaagttttccatcttcaggagatgccaaccatggagtttccacagatcatgttcagaaacagaaggagttgttggcaggatccgaagcagccagaagttcagatgtccaatattttgtggtagatgccattgattctcaacatgagcccgtgttccttgatgaaatttcctcagtggacgcgaactccaacaaggatgatggacttttggataattgtgggattcttccgaacaattgtttgccatgtcttgtatctaccattccttctgttgagaagagaagatcaacaagttctagtcctcctaatgcaaggaagaagcctacaacaaaactttcctttaaatggaaagaaggacatgggaatgctactctattttcctcaaagatgcttctacaaagaccaattgctggttctcaagtgccgttttgtccaattgagaagaaaatgcttgattgttggtcacaaattgatgcaagcactttcaaagttcgaggagtaaattatttcaaggacaagaaaaaggactttgctcctaattatcctgcatattacccatttggtgtagatgttttcttgtctccacggaaagttgaccatatagctcggtttgtggaacttcctgttatgagttcctccgcgaaatttcctcccatactagttgtaaacgttcaggttccactctatcctgccacactttttcaaggagaaactgatggtgaaggaatgagcattgttttgtactttaaactttcggaaagttactccaaggaacttccacagacttttcaagaaagcatcagaagattgatggatgatgaagttgaaaaggtaaagggttttcctgtagatacaattgcacccttcagggaaaggttgaaaatattaggccgtgtcatcaacctggaagatcttcatttgagtgctgcagaaaggaagcttatgcaggcttacaatgagaaacctgttctttcgcgtccccaacatgagttttacatgggggaaaattactttgagattgatttggatatgcatagattcagttatatctccaggaaagggtttgaagctttcttggacagattaaaggggaacaaacaggaggagctaccagagcatgtgttatgttgtattagattaaacggcattgactacatgaattaccaacaactggggctaactcaggaccccctctaa

SEQ ID NO: 16903 - DNA, 288 bp, Glycine max
  Peptide Sequence Number=SeqID_108588
atggctatatctcaacctaagttacagctgattccagaattaagggaagcccatgcacaagagaaacagttgagtctaattacgcagctttggttgcagaacaagcctccaaatccgagttattcattttctaataagttgttgtattggaaaggtcgtctagtgttaccacgaggccatgaagtgcaagacatcaaggagtttgttcagagttgtctcatttgtcaacagactaaacatgatacagcattaccatcaggcttgcttgaaccactaccaattccataa

SEQ ID NO: 16904 - DNA, 327 bp, Glycine max
  Peptide Sequence Number=SeqID_108589
atgcaactctctaactcgcgcatcatctctctcactcgtgcctcgtctctctcactaggaggaaaccctaagccccaatccgagtgcttctctcatcaccatttccaagaggctcaacaagacgcgcgattggatcatcgccatcaaagccctcttgcttattcacagcaatggatgcagaggcagaagagaccgagtgtgatggtcatggtggcgctaaggaaaagtgaagaaaaattggcggaaggtggagttgagttggtcgaattgcgaaggtcttggtctttgagaattggatcttggtatttttgtgttcctttgcagtag

SEQ ID NO: 16905 - DNA, 1044 bp, Glycine max
  Peptide Sequence Number=SeqID_108590
atgaatgaagaggaacttggtgtgaatgaaaaaaatggagaggaagctagtgcgcatcaacacattgattgttctgatgccttcaatacttctcaagtgtctgctaccagtgattatgtgttgcattgggctcaatctgctgcttatgatattggttttgtggcggtgattatgaggaagaaagatttagtacaaacagttattggtagtagaaaatgtaggtgcccctttaagttgcgtgtgaaaccagtggtgcaaggcgaaagatggatgatgaagttaatttgtggaagtcacaatcatgaattgcctaagtcattagttggacatccatatgagcacaatgccaacaattatacaacaatcaagaaaatatacaatgcaagaaatgcacatctttcttccataagagacaataatactgaaatgcaacaactaatgaagcttgttgaacgagatcaatatattcattggcatagatttaaggatgaagatgttggagaacatctaaatgatgttgtttgggctctagaatgctttcgagataattttctcaaatgtgatgcactccctagagttattgttaccaatagagatctaacattgatgaatggaagtttggtggattgtccttttgagcaagagttcgatgagtgtcttatgaagtttgaaatggcttgctcaccatggccaatgtttgttgactatgtcaagtatgctttaaaccagattgctgttgagtttacacgtgtaagttatgctgatattgatagtttttgttgtggatgtgtaatgaggactactcatggtcttccttgtgcatgcgagttagccagcacaatcgaagggatggaaaccatatccaagaggtttgaagagcttgatgtttgtggcaaagttactctaaagagtaaacttcgaaaaattgtttatcctgatctaaactctatgtgtgctccttcagaaaaggtcaaaacaaaaggtgctcagaaaaaaccaatgactaaacatcaaagatcaacaaagtgtgattcgtcttactaa

SEQ ID NO: 16906 - DNA, 366 bp, Glycine max
  Peptide Sequence Number=SeqID_108591
atggaaaaagtgaaaagtgtaatggatgccaaacatgccaatatgtcaagaaagcaactgaattcgttgtcgttttcatgggacagaaatgaagagtttgaattacaagaaaatgttggggagattcttgaagcacttcaacctgatacccaacaacttcaaagtctgatcatagaggtggaaggtttgcaagaggctttccaacatatgattgtagaagcaaagcttcatgatgaatcaagattgattcaaagatgttttgatgataacaaaggtgatgacaaaaagctcaaaggtcaatcaaagaatgagttcaagatgttcaagatagaatcaagaacacttcaagattcaattaagaattaa

SEQ ID NO: 16907 - DNA, 225 bp, Glycine max
  Peptide Sequence Number=SeqID_108592
atggaaggagtggttgcacaatcaatgacgtcaagatatgttgttgaggttatgtgtattggggtttggatgtgttgggttttggtgatggccattggcagcattgatgaagatgatggtgatgtagtggggggtataagaagcaaaaagggaaggtacaggagaaactgcaaggaatataaactcagacccgagcccgtcacttaccaccctatgatggcatga

SEQ ID NO: 16908 - DNA, 1818 bp, Glycine max
  Peptide Sequence Number=SeqID_108593
atggacccagagcaacgccggaagaggaagcgtgtggtggcagcaagacaccttcacatctcatcaagatcactttttctctgcttctccttcttaatcttcctcctttttttgtcttcccaccatcattttttcttcttcaccccttcaactttcagaccctctctcacagcctcaactttatcccttctctactcatccgcaagcaactccattctcgaccctcttatacccaccacaccctcctacaccctccaacaccgtatccttttccccgaccaccacctcctcatcctcaccaacccccaacaacaacaacaaaagctccacgaactagagtgcgtctactacacgctccaccccaacgcttcctcttccggttcacctgaaccggttctcgaagttcaggttcgaccggtcctgtccacggaccgttatgacgaatctcgatccattgttaggtgcccacttccccaaacgaactcctctgctggcggcggccctaaagccgtcgacttgcgacggcgcggtgaggtgggtcgccggagtttgggcattttgatgaaccaaacggctcaatcttgggacagggtggcgtacgaggcgaccctcgacggagacaccgtggtggtgttcgtgaaaggactgaatctccggccacacaagatctcggatccaacccggatccggtgccatttcgggctgaaaagtttccacaaggacaatgcctttttacttaccacgagagctgtttctgtggctcaagaagttgtgaggtgtatgttgccgcagagcataaggaacgatcctgataaggctcgagggattcgggtcacggtgagttatttgggtggcaatgtgaggcacccggttcgtgttcttgtgccttctgtggcaagggttagtagccctggtggtggtggtagagttcagaagaggaatagaaagaagcatgagttgtgtgcgtgtactatggtgtggaaccaagcttctgcgctcagggagtgggttacgtaccacgcttggcttggagtggagcgttggtttatctatgataacaacagtgatgatgatattgagaatgttgtgcaggatcttgatcttcaagggtttaatgttagtagaaagtcctggccttggattaagactcaggaagcagggttttcccactgtgctttaagggctagagaggagtgtaaatgggtggggttctttgatgttgatgagttcttctacttccccagtgagtttcagcagccgctgggggagggtgttcctggggagaattatctgagatcggtggttgccaatttctcatattctaaatccatcgcggagataagaacagcttgtcatagctttggaccttctgggttgaagtcgcccccgaaacaaggggttactctagggtacacttgccggcttcaaagccccgaacggcacaaatccattgtgcggccggatttgcttgacatcagtctgctgaatgtggtgcaccattttcagctgagggtggggtttaggtaccacaacatgcctgaaggtactgctatagtaaaccactacaagtaccaggtatgggagaccttcaaagccaagttcttcagaagggttgctacctatgtggtggactggcaggaggaccagaacaaagggtcgaaggatagagcaccgggattaggaacagaagccattgaacctcctaactggcggcgacagttttgtgaggtttgggatactggcctgaaggacttccttgtgtcttattttgctgaacctgcaaccgggttaatgccctgggaaaagtcttctctataa

SEQ ID NO: 16909 - DNA, 3780 bp, Glycine max
  Peptide Sequence Number=SeqID_108594
atgaagaggtccagagatgaagttctcacgagttgttctcaattgaaacggcctgtgttgtcttcacgaggagaagcgtctgggcaaccgcagatgatgaatggaggtgctcagaaactgacaactaatgatgcccttgcatatctcaaggcagtgaaggatatatttcaagataagagggacaagtatgatgactttttggaggttatgaaagatttcaaggctcaaagaattgatactgtgggtgtcattgcaagagtgaaggaactgtttaaaggccacagagatcttatattaggatttaacaccttcttgcctaagggttacgaaatcacacttccatcagaggatgatcaacctgccccaaagaaacccgttgaatttgaagaggctataaattttgtgaacaagataaagactcgttttcaaggtgatgatcatgtgtataaatcatttcttgacatattgaatatgtacagaaaggaagacaaatctattactgaggtctaccaggaggttgctgctatttttcaggaccaccctgatcttcttgatgagtttactcattttcttccagacgcttctgcagctgcctctactcattatgcttctgctcggaattctatgcttcgcgataggagctctgcaatgccaacaatacgacaattgcacgttgaaaagtgctgtcccttcagtgaggtgcttgcctctagcactgttatggttccactaacattctactcatctgcatgtcagcgagaacggaccattgtttcacatggtgatcatgaccccagtgttgatcgtcctgacccagatcatgacaggggtttgttaaggatagaaaaggagaggagacgtgtggagaaggaaaaggaacgtagagaagatagagacaagagagaacgtgaaagggatgatagagattatgagcatgatggggctcgagatagggagcgattctctcacaaacggaatcgtaaggctgaagactctggagctgaaccattgcttgatgcagatgaaaattttggtgtgcgtcctatgtcatccacttgtgatgataaaaattctctgaaaagtatgtacagtcaagagtttgctttctgtgaaaaggtcaaagaaaaattacgaaatcctgatgactaccaggaatttttgaagtgcttgcatatctacagcagggaaataattacccgacatgagttgcagtcattggtgggtgatttactgggaaaatatccagatcttatggaggggtttaatgaatttttgcttcaatctgaaaagaatgatggtggattccttgctggtgttatgaataaaaagtccttatggaatgatggacatggactgaaacaaataaaggttgaagacaaggatagagatcaggatagagatagagaccgttatagggatgatgggatgaaagaaagggaccgtgaattccgagaaagggacaaatctactgcgattgccaacaaggatgttttaggttctaagatgtctctatatcccagcaaggagaagtatttatccaaacctataaatgagctggacctttctaactgcgaccagtgcactcctagttaccgtctcttaccgaaaaattacccaatacctgtagctagccagaaaacagaacttggtgctgaggtgttgaatgattactgggtgtctgtcacttcaggaagtgaggattattccttcaaacatatgcgcaaaaatcagtatgaagagagtttgtttagatgtgaagatgacaggtttgaacttgacatgttgttagagtctgtaaatgtgacaaccaaacgagtagaagagctgttagacaagatcaatagtaatataattaaaggagacagcccaattcgtattgaggagcacttaacagctataaaccttaggtgtattgagcgattatatggtgaccatgggcttgatgtgatggaagtgttaaggaagaatgcacctctagctttgccagtgatattaacacgcttgaagcagaaacaggaagagtgggcaaggtgccgtgctgattttagtaaagtttggggtgaaatatatgctaagaactatcacaaatctcttgatcatcgtagcttctactttaagcaacaggatactaaaagcttgagcaccaaagagttgtcaattgcacgctgtagtgctttcgcgttgtggctatgggccactctgttaaagcccatcatgtcactgcttggtgttgtgcctggagtggcacaaatcatggccatattaatggctatttgtggcattagcaagcacaatgcaattttcgcatatgttggtgatcatgatgcaataattctttccatttttctgacactgacacctttcttttatgaaacttttacagccttgctggcagaaatcaaagaaatctgtgaaaagaaacgcaaagatgatgttcttcttgctattgctgctggaaataggcggccaattcttccaaacttggagtttaagtattctgatccagatattcatgaagatttatatcagctcataaaatattcctgtggagaaatttgcacaactgaacacgtggataaagttatgaaggtttggacaacatttttagaacccatgctttgtattccttctcggccccagtgtgcagaggatacagaagatgttgtcaaggttaagaataattgtgtcctaaatgacacagcaactgttgctgagagtgactgtagccctgttgtgggtgctaccataatgaatccaaagcatataaatgtttccagaaatggggatgagtgtatgccattagatcaatcaacttctagtaaagcatggcagtcaaatggtgatagtggggttagagaggataggtatcttgatgaccatgcattgcgtaaaactgaaactttgggcagcaatacacagcatggtaaaatgaatagtattgcattcacacctgatgaaccatcaggatttaacaataagcaagaccagtccagcgaacggttagtgaatgcaaatgtctcaccagcatctggaatggagcaaagcaatggaaggacaaacatagataatttgtcgggactcactgccactccaacaagacctggtaatgcttctgttgagggaggacttgatataccgtcatcagagggtggtgattctacaagactgggtacatcaacaaatggggccatcactggaggcaccaaagttcaccgataccaagaggaatcagttcgacccttcaaaaatgaaagagaagagggtgagttatctcctaatggagactttgaagaagataactttgcattttatggaggtaatggtttggatgcagtgcataaaggaaaagatggtggtgtgagtcggcaataccaaaataggcacggggaagaagtttgtggtgaaactagaggagaaaacgatgctgatgctgatgatgaaggtgaagaaagccatcacaggtcatcagaggacagtgaaaatgcatctgaaaatgttgatgtttctggaagcgagtctgctgatggtgaggagtgttctcgagaagagcacgaggatggggaacatgataacaaggctgagagtgaaggtgaagctgaaggaatagctgatgcccatgatgttgaaggagatggaatgtcattgccatattctgaacgctttctactaactgtgaagcctctagcaaagcatgttcctccaatgttacatgagaaggacaggaattcacgagttttctatggaaatgattccttttatgtgctgcttagacttcatcag

SEQ ID NO: 16910 - DNA, 1485 bp, Glycine max
  Peptide Sequence Number=SeqID_108595
atgggtgaatttcttgtggatgcaacagtgtttgaagataagaagatgggagagggtgctgctgcttccaatcctgctttgcaagtgtctgtttcgtttggtagatttgagaacgattccttgtcttgggagagatggtcctctttctctccaaacaagtacttggaagaggttgagaagtgtgccacacctggatcagtggcccagaagaaagcctactttgaagcacattacaagaaggttgccgcccggaaagccgaattgctggctcaggagaagcaaagggagaaagattctttcggatcagaagaacatagtggaatagatctgagtggtaacactgatgcagaacatgatatatccaacaacactcaaggttccagtgaaggggttgagcatgaaaccagttctgctggtgagatccataagactcatgttaatgaatctgaggaggaatttgcagtttcaagggattaccaaagttcatcagttcaggtagagaacaaggaactggaaagtagatcacatagttcctaccagatagatgaacctgaaaatgtatgcaagaaacaagtggaaagtcctaacaacaacattgaagctgaagatgtgaaggaaatttcacatgttgtgtacaaggagacaggaaaggcttcagaaggtgaagtaaaagatgtgaaattgaatcatccaaaggaatctaaggttaagtctgtgagtaagggtagcaatgcagccaggactaagaagaaatcaatgctacctacttctaaggcatccccaatttcaacaccaaaaagttcaaagcctgcatcaacaactcctaccaaaacagtgacacctgcttcttcaactagaaagggaagctctccatctttgactaggaggcaaattacttctagtggggagagcagaaaatttgctaacaaacctttgcacatgtctttgagcttggctccaagtaatcctgatccagctcctcaaagtaccatgaggagatctttaattatggagaacatgggggataaggacatagtcaaacgagcatttaagacattccagaacagtttcaaccagccaaaaacttctgttgaagacaaatctttgataaagaagcaggttccttcaaggggaactgtgtcaaaggttccaacatctacaactttgaggaaagaaaatggacggccgactaaggttgagaatttgtatcaaagtggaaatgctgtacgaactactttgggtccaaaaagagacattagagcagagaaagggaaagagtcttcaagaaaaatagaagaaaaatctaacacaaaaggggtggaaagaacacgtcttcaatcaaaagtgaaggaggaaaaagaggcagagatgaaaaggctaaaacataatgtcaaaggcacatcctcaccagcttttaaccgtggtcaaaaagtagtgaaaagtcgtcctgaaaagctgactacttctttgcatttaatgctataa

SEQ ID NO: 16911 - DNA, 1098 bp, Glycine max
  Peptide Sequence Number=SeqID_108596
atgggattgttggggtgtgggttggcgtttgcgcagaagtattctaaggatgagagtgtcacttttgctatgtatggagatggtgctgccaatcagggacagctctttgaggcgcttagcattgctgcgctttgggatcttcctgctattttggtctgcgagaataatcactatgggatggggactgcggagtggagggctgccaagagtcctgcttattacaagcgtggggattatgtgcctggcttgaaggtgagtttggttaatgtgttctttgatgcacttgttgtaatggtttatctgttaatgggtggttttaatgtgtttctgcaaagaaatctccaaattctcattattggtaatgaagagatacaaggttatatacatggttacgaggctcaaaccaggattatcactggtttgtatgagaaaaggattggaatcatccatggcacccatggaaccgaaaaaggagaagaaaagctagaaggaaatcagagaaagcagaagaaatgtatctctgctgataccatattaacagagagctgtgtgcagcaaagaaatctccaaattctcattattggtaatgaagagatacaagggatgtatgcctttcctgttcttgcattatacgttgatgcttctgtggactctccttttttagcctcctcattgggctttattcctgttgatggcatggatgttcttgctgttaaacaagcttgcaaatttgcaaaggaacatgctttgaagaatggactccttattcttgaaatggacacttacagataccatggacactctatgtctgatcatggcagcacataccgtacacgtgatgaaatttctggtgtgagacaggagcgtgatccaattgagagagtaagaaagctgttattgtctcatgatattgctgctgaaaaggagctaaaggacatcgagaaagaagtcagaaaagaagttgacgaagccattgctaaagcaaaggagaatccaatgccagacccatctgatctatttaccaatgtctacattaaaggttacggagttgagatattgatttcatccaacaaactatacgtgcttcagaatttatag

SEQ ID NO: 16912 - DNA, 735 bp, Glycine max
  Peptide Sequence Number=SeqID_108597
atggacacggacggtgtcgtttcgttcaaccatgtctcgccggaggattcccacgaggttcatgtcttggccgtcgacgacagcctcgttgatcgaaaggtcattgagcgcttgctcaaaatctcagcttgtaaagttacggctgtggatagtggaatcagagcactgcaatttctggggctggatgagcagagaaggacctctgaatctgatggttttgtcccggatttgaaggtggatctaattatcacagactactgcatgcccgaaatgaccggttacgagttgctcaagaaaatcaaggaatcgaccatgttcagagaaattccagtagtgatcatgtcttccgaaaacattttgccgcgcatagacagatgtttggaggaaggtgcagaggatttcatagtgaagccagtgaaattatctgatgtaaaacggttaaagggttacttgacaccaaaagaggttattaaggttgacagaagaagtgatggttatgttaacggtggctgcaaaggtggtgatggtggtggtggtggtggtgtggagataaacaacaacaaaaggaagctggaagagcaagacacatctgacgtgtcaacatctccaccgtccacttctacactttcatcatcaccctccgtttcttcaccatcaccgtcatcttctcctacctcttcacccagcgtgcttgcttctccgatcagacggcttaaaatgaccagcaccgattga

SEQ ID NO: 16913 - DNA, 1452 bp, Glycine max
  Peptide Sequence Number=SeqID_108598
atgcatcagcttcttcatcaacaagtcatcgatgacatgcgcgtgtcttccctgcaaccacaattaccaaacatcaccattaaaagaaattacatggaacccgcgacctttcttcaacagtacacgaaccacgatgaagtcgaagaggtgaggtcaatgtcaaagaaaggagcttcaatgaaagaaggggtagggcttcaatgtcaaagagttgaggtcaatgtcaaagaaaggagcaaggtgaaaggtctagggttcaaagcaaggagaaacgaaggagcatggtgcaaggtgaacaaacacgcgagggttcaaacgaaggagcaagcagaaaggtctaggctagggttcaaagcaaggagaaaggtagcagaaagcttcaacactacaccagtttcggctcgtttgttccccaacgtttcctccatcccaaggtggaacacatcccacgcgccacctgatagcgcgtggaacgcgtatcgcaatttcactgggtgccgcccgggaaaaacatataacggtctttcgaatctgaaaaactactttcattattttggctacatctccaacgtgtcctcgaagtcgtcgaattttagcgacgatttcgatgatgcgttggaggcagccgttagagcctaccagaagaacttcaacctcaacatcacaggggagctcgacgaccccacgatgaaccaaatcgtcaagccacgctgcggcgtggctgacatcatcaacggaaccacaacaatgaactccggcaagacaaacaccacggattcaccgacgttccacacggtagcgcattattctttctttgacggccagccgcggtggccggtggggacacaagaactaacctacgccttcgatcccgataacgctctcgacgacgtgattaagaccgtgtttggcaacgcgtttagcagatggtcagaggtgaccacgatttctttccgcgaaacggcgtcgtatgtggctgcggacataagaatagggttttacggtggggaccacggcgacggcgaaccttttgatggcgtgttggggacgttggcgcacgcgttctcgccgacgaacgggatgttccacctggactcggcggaggactgggtggcctccggcgacgtgacgaaggcgtcgctgtcgaacgcggtggatcttgaatccgtggcggtgcatgagattgggcacttgctagggttagggcactcttcggttgaagatgctattatgtaccctacgattaccgcgaggacgaggaaggtggagctcaacgaagatgatatacaagggattcaggttctctacggttccaaccctaatttcactgggactcctgctacctcttcgcgtgagagcgacacgagcgatggtggtgttcggcacgtgggagccacgtgcggtgtgttcttctctcttttgttcttcgttgtgtttggattgcacgtgtga

SEQ ID NO: 16914 - DNA, 1263 bp, Glycine max
  Peptide Sequence Number=SeqID_108599
atgtgttgcaaccttaaggattccacaaaactcaacaccaagaggagtccccaagattatccttcatggacattcaagcaaggttgcctgcaatctgtccacctgaatccgaattcaaaccgtggtggtgacgtgtttttctctgcctctgcttctagtcgcggcaatgggattagggttacggttacggttagggtttcggttatcgtcatgtccgatccttcgaggggtcgcgttaccattactctagggcgtagcggtcatgttgtgaagagggatgcatctgctgtagatgtttcttctttctcttctattcattcagctggcactaagcggtctgtaagagacagaattggaagtaatgcagatagttctgggtggcatggaaatggacatagcggcaataaacgacaccgaggagatgtaagcatgcaaaatggactggatggcaatgatctacgattgaagctcatgcgaaaaagtgcattggggcaggctgacagcaatggcagtaagaggcatatggacctccgtgaaaagctgtcaaaggcaagtcaccctctggctaacacttataattcgaagcagcatgggccagattcaagggaaacaagtttgaggcaaattccctcagctagaagttctgataaattactgcgtatggaatccatgagaagctcatactctccttggacattggatcatattaggagaagatcaccagatgggtttccaagtacttccagggggatttccccccaaagggatgtccaagacctacatagaaggcctgtaagcaggacatatgatggtgtcagatcagtttcatatgtaggtagggatgttcttgaaacttcgaggcctccaataagtacaccccaatctttcatgtcacgctccacaatgtccacattgcctccagtaactgtcaagcctgtagcatctcatcctggtcaacttcctccatcgggcagtgttgctcaaaggccttcatatgtgccgccatctcctcacccaatcatttctcctttcaaaagttgcagaacagatgctgaacagaggctgtccagcaacagcgcaggttgccaaggctgtccagcgatggtacaggtcgtagagcctatccggcaacaacgcagaggagtggccgcaaatggcaatgatggccacgaaatcagccatgataagtggtgctacagctgcaactcaaccggctccgtgatggcaagcagaactgcggggaggggtgctgtgatatcgtaa

SEQ ID NO: 16915 - DNA, 367 bp, Glycine max
  Peptide Sequence Number=SeqID_108600
gttcccggaagacgtgttccggaagacgttcggttacttccggaagaacacttcttccggaaactttccagaaaaggttcttccggaacttccggaagaacccctaacgggtcttccggaagacttctccgtcagccttttccgccattttttccggcgtactctcgtcttctccccgctcgtcttctaccctaaggttactaccttaagtaaaagcaatggagagttagggagactaacctcgaaggctgttcgcggagaagacggagaagaagaagaagcttggctcgtggtgtccggaagaagacgaaagcttggctcgcggtgtcacggaggatcaacaggaatggaagaagaaaagaagtag

SEQ ID NO: 16916 - DNA, 387 bp, Glycine max
  Peptide Sequence Number=SeqID_108601
atgtggttcacctctgccttgaggctcactgaaagagttgttgtgttcgccagagttatctggaaattagtggagaaacttcttgttccaactccaaagcaattgaaatattcaactggggagagtcaatccccttcacaaggactgaaatggtcttttgctgctggtacaaatttgttatcccagcttggggagaagattgagagacaatctagacagaagctcaatgagtttgcacgggaactgaggtcatttcctagtattgatatgtcagggcgcaactttggagatgaaggattattcttccttgctgagagcttggcattcaaccagctactagtcatgaagtgcaagtatggatatgtggaacataacaacttgctttaa

SEQ ID NO: 16917 - DNA, 471 bp, Glycine max
  Peptide Sequence Number=SeqID_108602
atggctgaggctgtattcaaagttgtgcttgaaaatttgagctccctcgcagcaacagagctgggaacacttctgggtttcaatggagaaaagaaaaagcttcacaacatgttcactgcaatcaaggccaagtttcaagatgctgaggagaaacaattctcaaatgaagctatcaaggattggctgggaaagctaacagatgcatcttatgagctggatgacgtgttggaggaatgtgcctatgaagaattgtggaaaaaatatttgcttgttttggatgatgtgtgggaagataagccatataactgggagaggttgaaatttgtactggcttgtggggcaaagggttcttccatactggttactactcatctttcagaggttgcaacaatcatgagaacaataatgcatcctcctcatgaattaacaaagttatctaacaaagattattgggaattgcttaaagattga

SEQ ID NO: 16918 - DNA, 387 bp, Glycine max
  Peptide Sequence Number=SeqID_108603
atggcgccaatgcttcacacgaagtcttccagttgcctaggagaaacaattctccaacagagctataaaagctcgatcacatcctttatgacatcatggaagagtgtggcactgaagcattggagatggaatatcaaggagtcaaatgtggggattggcttttgcagcagtagcattaggaagtttttttcactttacaagagtggaacaggattggctctatgtcagggaaagcaagctatggagtttacagcatgggaattcagtcatgcctgccttgagattaaattatttgaacttaccaagaaaattgagacaatgttttgccatctgtacatcattgtacaaggacaagggaagtgtcaaggacaacatactgaattttga

SEQ ID NO: 16919 - DNA, 498 bp, Glycine max
  Peptide Sequence Number=SeqID_108604
gcggaatgtttgtggggtgggagagccttccatggcgttgaggcttatctgggaaatgagggtatgattagggtcgttgtcggggaaggtgtcaggggtgaggacgtcttcgtccacgatgaacatgggaagaagggaaggggatttcgggatgagggtactcgaggtggctggggaggggaaagaagaggtggggtttggggatggtgggtgaggcggaggccggggaccgcggcggcggtccagcattttgtcttcctggaggcgggcaagttcgatggcttgcgggagagagataggccgcagtgcctgtacttcgcggcggagctccaggaccaagcccgagatgaaacaactcagcagggaggatggggcaattccgatggtgcggttggccaagcgctcaaaagcaatgagaaagaaggcgcgaagcgagactccaaggcctacaacatcgccggccacgaggagaagaacccattccggtgcatccactga

SEQ ID NO: 16920 - DNA, 1392 bp, Glycine max
  Peptide Sequence Number=SeqID_108605
atgctccgttcaactccaattccggcaccgtacaattcggtgccagttctctctcgcgcccgcacgtgtcactctctagcacctgcacgtgccgttcattcccattcctctttcgtttcgcggctcgtgttcccacaattccggcaatacatcgtaaatgttcccggccgagtgtttgtcgcggcagccgcaaagaagcaacggcgcggcggcgctgaactcgctgtaacggacgacggtttcgacgatgacgaggagtacgacgacgacgatttttatgatgagtacgatgatgatgatgatgatgaagaagaagagtttgatgatgatgaagatgatgaggggatgctttcattggagaagatgaataaatggtttgagaagaagccgaggggttttggcgaagggaaagtttacgacacttcggttgaggataagctgctcgaggaaatgcgccagagtagaatagcgcaggctgagaacttgaagaagcttatgagcaacccagtaaaacatgcttccaatgaaagtgttcaaaagaagaaagccggtgatgatttaatccttgaaagaaaattcttatttagtcctgaacgtgtaaaaaatgcagaacttgttccaattggaggtcgagtgtgcttggtgaacctaccaaagaaaaagaacatccataaagatctgaaatcagctttgcaagggattcctggcataattaatatagtcccagctgttactggaaacaagaagacgagggacccaatctgcaagggttttgcatatgttgatttcaagcgtgaagaagatgcagttaggttcgtagagttatacactggacaaactattacttttggtaaaattcagaagcagataaaatgtgagcttctaaatgtacagtcttcatcttctctgaaattaagcaaaaaccttagtgctgctccgcaacttgtggccgctgcctttgaagaagattcaaatgaggattctaacttggatggttctgcccgtagttcctgggatgagaccaattcttcagatgatttggatgacctggactatcagatgaatggagaagaacaggaagatgatgaggataatcaagagtctgtcactgctttgggggtagatcatgatgataatgtggaaatgaggatcgatcctgaaaatatttcacttccctcagagcaggttgacagaaaccccgcagctgtgcagaagtcgtctgccaaggttaaacaggagaatgcccgtaagaaaaaaccaatttccaaagagaaaaccaaaaaagttttagatgttcctggatcctcaagaaggttaaagatcagggagaaagctgtattaagtgaggttttctccaagggaagtatgagtaaagtattcaagtttgacttg

SEQ ID NO: 16921 - DNA, 55 bp, Glycine max
  Peptide Sequence Number=SeqID_108606
gggagcaactcgtagggtcctggaaaccataaggccaatgaggcctttgccttag

SEQ ID NO: 16922 - DNA, 606 bp, Glycine max
  Peptide Sequence Number=SeqID_108607
atggatttcagaaataatgctagtgacaatattctgagtcaaaacccttgtcaaaatggtttttcaaaggaagcgcaaaacatacaatggtggttccaaagtcagaaaagatgcaaagacaagctgaaactaacaaggaacaagcatagaatcacggttacctcaagaaaaaccacgaagggttcctctcggtgtggggtttcaacggagaacaacgacggtttgtggtggctactggtggctgtgggtgatggaggaaaaaacttgggacgttggaaatggtttttgaagaaagaaggagaaggaaatggcgtttttccaaggctacacgaaaagcaaaggttgaaacactcaagtgcttctgctcacgggaaaggaagtgttcctcacactctagacgccgtatctaagatcacaacgtggcgtctccaatcacctttcctccttcttcattccgctatcattgattttcaagaagcaaatgacttcattgatgaagaagatccaaggcctacaagctctacatggagctacatcaagaagcaaatgactccattgatgaagaagatccaaggcctacaagctctacatggagctacatcataa

SEQ ID NO: 16923 - DNA, 204 bp, Glycine max
  Peptide Sequence Number=SeqID_108608
atgggtggaggacacatgaacgaaaacgcaattcatggggctctgaaaaagattggtggggtgggatatcgccagtcgagaacgaccttaaatggcaatctgaaaggaagagacaccaaaaatgggttttccttcgctggcagtcacctaccctgccgaaaatttatctggtctgaagatcttccgttccctctctcccattga

SEQ ID NO: 16924 - DNA, 312 bp, Glycine max
  Peptide Sequence Number=SeqID_108609
atgattgatcagtggaataatcgccatgcatttagggtcgacgcttatccccgacaagaaggcctattgagttttaactcggactacatggtctgggtgaagttgcggaggcattacaatacatggtgtctcctcaagggaggaatacatgcacatttgatgatctcgtgccttatgtggaaaaaattacaattttatccgaagagcaagagagagtcactgagccagtgtcacatggtcccgcatcagagcgtcaatttcctgcacaacagtttcacatgcttcagtcaagtattgaaactcaggggatag

SEQ ID NO: 16925 - DNA, 852 bp, Glycine max
  Peptide Sequence Number=SeqID_108610
atgccctcactttcagaggactacatgtcctcgccttcaaaggactacgcgccctcgctttcgtggggctacacgcgcgccccttcagaggactacacgtccttgcctttagatggctacacaccatcaccttcagagggctacacgtcctcgtcttcagaggactacacttcctcgccttcaaaggactacacgactacacgtcctcaccttcagagcactacacgccctcaccttcagagggctacacgccctcaccatcagaggactatacatcctccccttcagagggctacacatccttgcattcagagggctacacaccctcaccccagaggactacacgtgctcgccttcagaggactacacggcctcaccttcagagggctacacgccctctccttaaaaggactacacgtcttccactttagagggctacacaccctcgcctttagaggtgtacacgccctcgccttcagaggactacatgtcctgaccttcagaggactacacgtcctgaccttcagagggccacacgccctcacgttaaaaggactacacggcctcaccttcaaagggctacacaccatcaccttcagaggaatacacgacctcgcctttagaggactacacgtcctcaccatcagaggactacacgtcctcacctttagagggctacacgccctcacctttagacgactacacgtcctcgctttcataggactacatgtcctccccttcagtggagtacacgtcctcaccttccgaggactacacatcctcgccttcagaggactacacgtgctctcctttaaaggactacacatcctcggcttcagagggctacacaga

SEQ ID NO: 16926 - DNA, 231 bp, Glycine max
  Peptide Sequence Number=SeqID_108611
atggcctatggtggtgatgaattcgttcatcctgacaatgcggtaccagtttctctcactcggtccggttaccctcggatcattccgtctcatcataggcgtatgattctgaagaaggatgagaaagcggacatgctgtcgctatgctccctggataaaacgtatacccctggaacaaacaagggttacggtttgaaccaacctggaaagccttgccgacacactcattga

SEQ ID NO: 16927 - DNA, 853 bp, Glycine max
  Peptide Sequence Number=SeqID_108612
atgaaaccctacctcttctcagagttctatccctcattagctagaatttccaagatagtccaaatctcggcgcaggaattagaccacaggaagcaagtcaaaaatagggtggttggaataccgagaaaatatttggaggcaaaagcaagaatcttggcaggtaaaggcgagtgggccccgttcatagatattctcgcactgttgattttcggaggagtcctctttccgaatgtggatgggttggtggacctggcagtgatcgacgcttttctcgcctatcataaccacaaggaaagcccgattgtcgctatgctagccgacctatatgacaccttcgaccaaagatgtgaaaagagcaatacaaggattgtttgctgtactccagctctttatgtatggttagtttcacaccttttttgccaagaggtaaggcatgcttgctcgctagaaagccaccgttcatgcacagagaaaggaggggcaaattgggaccaactcttagcaagcaaagaaggagcatctgtcaactggttccctcgatggaaggaaggaagaaccagagttcttatttcatgcggaggatttccaaatgttcccttgatggggacgaggggttgcatcagctacaatcccgttcttgctataagacaacttggctaccctatgagaggggcgccactagaggatgagctcacgcctgtcatttcacgaggtttcaataagaccaacgtggagacacttcagaaggttcgcaaggcatggaaggtggtacaaaagaaagacaaagaacttaggggcagtaacaatggacccatcggtggcgaccataagtggttgaaagcccacgtgcaag

SEQ ID NO: 16928 - DNA, 540 bp, Glycine max
  Peptide Sequence Number=SeqID_108613
atggcgcctaccaggcaccctctggacccggataagtccaacagggccctgggatttccagctttgatcacaggactctgccagtcgttcggagtccccgtcgcacctagtaaggtgatttggccacccatcacccgggcttttattgagaagtattgcacgcagagacaggcccagggtgatgcaccacaggccgcaggcgtgccaccaccacctcatcaggctgacccagctgggtcaattgacaccgagcggtatttgcggcactcgatgcgccagcacgcggccaaccataggggactggggcaggtccatgagtgtctctaccagctaagcctcaacatgcagagccagggcttcgctccttttccgcgccctactccagaccagtttagggcagaggtcgcatggcccggggattggcccgaggcccaagcaggggaggcacccgcagaggctcccgacgatggagaggaggccggcatggataaggagatgtcagatttgctcgacttcttgggagggagtggagccacatga

SEQ ID NO: 16929 - DNA, 215 bp, Glycine max
  Peptide Sequence Number=SeqID_108614
gattgcatcattccctctcccttgaaaaggatttgacctcaaatccagaggttcttgaagctctgggcttcttccctcaacacctaaacgaagatgctctgataccacatgatgtagctctaagtggagcttgtaggccttggatcttcttcatcaatggagttcttttcttcttgaagatcaattgcaacagaatggagatggaagaaagatga

SEQ ID NO: 16930 - DNA, 239 bp, Glycine max
  Peptide Sequence Number=SeqID_108615
cagagagattgaaggcacttcgcatccagacaactacccttaaaggaataattaacagtgctttgaaaggacttaaggatactccacaacctaaattcaaggttggtgctagagagattgaaggcacttcgcatccagtggacaactaccttaaaggaataattaacagtgctttgaaaggacttaaggatactccacaacctaaatccaaggttggtgctaggtggattgttgttaaa

SEQ ID NO: 16931 - DNA, 480 bp, Glycine max
  Peptide Sequence Number=SeqID_108616
atggcttccaactcccaacaactcagtgcaagaaatgatgctattgtccttagaggagtccatgaggtggccatggattcatcttcatctactgaaaataaaaagcttgagggaaaacttgatgccttggtcaacctagtaactcagcctgccatgaatcagaaatatacacttgttgcaagagtctatggtctatgttcttctgcagatcaccatatagatctttttccttctttgcaggaatctggagtcaatgagcaacctaaagcttatgctgcaaacatttataatagaccccctcaacatcaaaaccaacaacagcagaataattatgatctttcaagcaacagatacaatccaggttggaggaatcatccaaatttgagatggacaagtcctccacaacaacaacagcctgtccctcccttccagaatgttgctggtccaagcaagccatatgttccgcctccaatgcagtaa

SEQ ID NO: 16932 - DNA, 483 bp, Glycine max
  Peptide Sequence Number=SeqID_108617
atgggttctccacctgccttcactcctcctcctcctccccctccttcggacgcatcggctttgccgtctgccatgaagcggacacgcaaagcctcacgtctacgatcgttgtccactagaccaactggtgctgagagaccaatggtgcatgttgatcctgctactgggaaggccgacagttcccacaagaagaaattaagaacatatttggggattgtggtgcgtgataaggtggacgtcacctccgagaactggaaggaggtccctactgctcagaaggacctgatttgggaggatattcaagcagaatttgatatcttagaggcttctgatagtaggatgaaaaggaagttactgcagatcgtgggggagagatggaggaagtttaaatcagacctcacgaggaaatgggcccttgcagccgatcaggacagtgtcgaggacaatgtctatgagaaatacggcatcagcaaggaaaagtga

SEQ ID NO: 16933 - DNA, 875 bp, Glycine max
  Peptide Sequence Number=SeqID_108618
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaccaaaatcactgggacagcacaaggacttatactatctcttacccaacctttgctaatgagttcatccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 16934 - DNA, 201 bp, Glycine max
  Peptide Sequence Number=SeqID_108619
atggaggttgatgaaccttggatagggttatggccaccattgaattatcaagtagatatgggagcaagtcagcataggacactagaattggggtggtcttcgtcattggaagtgcgtaatgacattgttgggttggtgggaaacttggccatcaacttcgatcctttcactggcgaagaccaaatccgcaaagctttgagg

SEQ ID NO: 16935 - DNA, 366 bp, Glycine max
  Peptide Sequence Number=SeqID_108620
atgtccaaatcttgtggatttgggatgaccggccctctcgatgagtcgatctcttgctttctcataagggtggacccttgggtacttgtacctatcacctttagaggactacatgtcctcgccatcagaggacttcatgtccttgccatcagagggctgcacgccctcacctccagaggactacctgtcctcgccttgagagggctacacgccctcaccttgggtactagttaccctcaccagttgagaggactacatgtcctcgccatcagagggctgcacgccctcaccttcagaggactacacgtcctcgccttgagagggctacacgccctcaccttgggtactagttaccctcaccagtga

SEQ ID NO: 16936 - DNA, 486 bp, Glycine max
  Peptide Sequence Number=SeqID_108621
atggagaggagtatgattgatgctgccagtggtggagctcttggtgatatgactcctgttgaggctaggaatttgattgagaagatggcttccaactcccaacaattcagtgctagaaatgatgctattgtccttagaggagtccatgaggtggccacagattcatcttcatctactgaaaataaaaagcttgatggaaaacttgatgccttggtcaacctagtaactcaactttgcatgaatcagaaatctgcacctgttgccagagtctatggtctatgttcttctgcagatcaccatatagatctatgtccttctttgcagcaatctggagtcaatgagcaacctgaagcttatgctgtaaacatttataatagacttcctcagcagaaaaaccaacaacagcagaataattatgatctttcaagcaacagatacaatccaggttggaggaatcatgtagaagcaaacttcattgattcatga

SEQ ID NO: 16937 - DNA, 612 bp, Glycine max
  Peptide Sequence Number=SeqID_108622
atggatgaattaaagatcctaaacatcccaacaaagatgtttaaactctttaaccactctattttcccccaccagggacatccgacaaggtcaatgcgtccccctcctccccacgaacatacacaacatgcatcatctcaattcatttccaacatcatcaatatttcaattcaatatcattctcaacataaacatcacctcgtctcaatgacgctatcaacaacaacaacctcattccatatcaacatcatcacatatcaatttaaagtcatcaatagcaacatcaataaaaaaaaattccgcatgcaacagggacatgcatatattctcatagctaggtttcctgaccgtaaccatggtgtagaaatgaggtctctctcgttcgcgcttgtcggtccaacgcaagtctctattacgccaaaacgaaaggaatttagtatgcatttcaaaaacaaggtcaaaggcaacaattggggtcaaatacctctgtcaacacataaagggctgaggggtgtttcagattctacaaatggaaacattattttgaaattccgatcacgccaatgtgaccggggttcagtgactggcgcaaaaataacctcaatgttataa

SEQ ID NO: 16938 - DNA, 534 bp, Glycine max
  Peptide Sequence Number=SeqID_108623
atggctcctgaagacctagagcaattggctcaacaaataagagaccagctagaggagtcgatcacagaaaaaggacttgcactgcctccgaagcctgaggttggtccttcagctgctcgtgtcagcacaaaggagaattgtgttgatccttcagggaacgatccagacacgggtgactcagacaaatgtgggttgtacatcgaagaaaatcctccccgcctggttgccctaggaaaagtttatgagggatcgataaccgttcacaacatccctttgttgcatgatcaagtgaaggtcgatgttgaggaggttagagatgcagatgcacccattcctgtacccattgaagaggttaggttagtggggcagacacttaacaccttctttgcttggccgacacatctcatcaagcatttatcagaacagggagctatgggaccatcaaaacctacagataggccggatcatgaggtcgatgatcccctatatctgatgacattgaccatcccacaactttttttgaacccgttgtag

SEQ ID NO: 16939 - DNA, 529 bp, Glycine max
  Peptide Sequence Number=SeqID_108624
atgggggcatacgcaaaagatgagaaattgctgatacattccttacaagaaagtcttactggggtagctgttatctggtacactagcttggaacctccccgagtccattcttggaaggaactaatggttgccttcgttaggcagggtcagtataatggcttcgaacaggatgcaactatagaacatggatctggcagcccaagtgtttccctcaatggcgaagaaagaaataataacaatgatagtagacatattactagtgttctattatggaaaatggtgggttacacgccttcaagttttgcggatttggtcttcgctggcgaaatgatcaaagtgggtctaaaaagaggcaaatttgatcatcatgctttgatacatgcaaaaaaaaaaactggggcaaatgaagaggatgagaatgagggagaaacccatgctgtggctgccattcctatatggccaagtttcccaccaacccaacaatgtcattactcagccaataacaacccatctccttacccaccaccca

SEQ ID NO: 16940 - DNA, 336 bp, Glycine max
  Peptide Sequence Number=SeqID_108625
atgacttctacaagtggagatgctattccatcatctccaaaaactgcaaggctcatgacagagatgattaaacttggtgatcaaatgagaagaatgagttatgaaaatgaagaaaggatggagagaatgagaaaggagaattatgagagtttaagaagaatacacaggattagtgaagctttaaatgaggggtgtgaagaggatgagggaggattgaggaatgaaatgtatagggagagaagaaatcatagaagatatggaggtaggcaaagggagaaagggattaagggaataaaggtgaagatccctacttttaaagggatttgtgatccataa

SEQ ID NO: 16941 - DNA, 120 bp, Glycine max
  Peptide Sequence Number=SeqID_108626
atggaggatatacatagagaatacgatgaagaacaaggaattaaagagaattcacagaataaaaagatagaggaagcaaaagaacatcaccaaaggcatgggggtgagcttagctattaa

SEQ ID NO: 16942 - DNA, 534 bp, Glycine max
  Peptide Sequence Number=SeqID_108627
atgtttgttgaccctaagaatgcaaacatagctacattggttgaagttgcggagacattacagtatatggtgtcaccacaagggaggaacacatggacaattgatgatcttgtgccctatgtggataaaataaccattttatctgaagagcaagagagaatcactgagcctgtgtcacatggtccagcaccagagcatgaatttgcaccacaagagtttcatattcttccgtcaagtgttgaaactcaaggcataggcagacgaaggaaggctgtaaaagtggaactatatttctacccacagatggaagaccgtggccatggaatgtattacacaccaccaaaattttctcagtatccgacacagatgtatcaatatcctttcgaaggtaatcaaactgatgcttctgcaagcgaacattcgttgggtggtattgtgaaaacacatcctaatttttcatggcctactatgaccccttcacagcaatatgataccccaattccaacacctaatgctccattaggtatgcaatga

SEQ ID NO: 16943 - DNA, 177 bp, Glycine max
  Peptide Sequence Number=SeqID_108628
atgacacctgttagcactgccacatctcttgggcttgaggttattcctcaagtaaaggagttgttggatgagggtttagttcgtaagagcttaaatccttgtgctttgttggtgcctgaaataggtattattaggcaccaaatccctaaaataggtgatatgatgaatatggaataa

SEQ ID NO: 16944 - DNA, 342 bp, Glycine max
  Peptide Sequence Number=SeqID_108629
atgacccgaagatctactgcaggtgatttgatccccatcgatttggagattaacactacttgcaggaggtgcaacgcagagagaaatagaaaatttttgcaggacttagaagcagcaacaactctagaagaagaacctcgatcttccgaggtgtcttctagctttcctattgcagggcaatcttatatagatttaattgaagaagttattatggctgaagaggcaaggagagtgaccctagaagattactcaagttcaagtgtgccacaatttttcaccatcattgcacaactagaggttcaagcaaaaacaatcacatatcctccttctttgatacagtag

SEQ ID NO: 16945 - DNA, 246 bp, Glycine max
  Peptide Sequence Number=SeqID_108630
atggggcttaccaacatggatggcgaagagctaccttcacccgggcaggatcaccttgggctaccttctggagtagagacaaaacatgaacgacagaaaccaatcgaggacgaacgcaagcggggatggggtcacgaccgaccgatcgttgcctttctctgtgcgaaacgagcagagaatgtcgctgcaaggcagccccgtatcctttgtattttgcagctttcttttactatttgtttgttttaa

SEQ ID NO: 16946 - DNA, 431 bp, Glycine max
  Peptide Sequence Number=SeqID_108631
atggcattagcgcgtgacttttgtaaggaaacaacccatggggcattttggtttggagtaggtagcaaaatacctttggcaatatacactttgggtatgatagcaaaatacttggatgtattagaaataccaagatgtgcacatgtgcaatttttggtaccccaaaatgctttgagtatgcatgaaatcgccccgaggaagcttgcctcaaagaggtccaggaaggacaaggtagccgaaggaactagttccgctccggagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccag

SEQ ID NO: 16947 - DNA, 631 bp, Glycine max
  Peptide Sequence Number=SeqID_108632
ggcttcccggtatcaacagggacaccaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattaatgaagcattgggcttgaatccagaattgggcttggacttgaagagggcagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 16948 - DNA, 676 bp, Glycine max
  Peptide Sequence Number=SeqID_108633
tggaattgctacttgtctgaaagttactgatgcatatttggttgatttgaggagggtttgtaaagaggctgaaaacagattaaagtctaagaatcttcctttacctactgacaaaaggactctaacaccaccaacattaccaccaaaaagaagaaaatcaagcaatatagagagtgcatttaatattgaggataagaatcatcttagagcagagatagcaaggatgttttattctgccggcttgtcattccatcttgctagaaatccacattttgttagttcttattcatttgctgctaactgtaatctaagtgggtttcttcctcctagttataatgcattgagaactagtcttttacagcaagagaggtctcatattgaaaggttgcttcaacctatcaaatctttgtggagtttaaaaggagccattgatgggtccaaggagtacaaggacaaacattacatgtttgacttattaaaggatgtaatcaaggaggcaactgggttattgatagaagctgaatttcctcatattttttggaccccttgtgtggttcatactttgaatcttggagtgaaaagcatttgtgctgcaaagaatgttgatggtaatgagaatgtcttcaatgaatgtcggtggattgctgaagtaattggcgatgcttcttttatcaag

SEQ ID NO: 16949 - DNA, 363 bp, Glycine max
  Peptide Sequence Number=SeqID_108634
atgtcctcgccttcagaggactacacgccctcgccttcagagggactacacgccctcgccttcagaagactacacatcctcgccttcagaggacttcacgtcctcaccttcagagggctacacaccctcacctttagatggctgcatgcccttgccttcagaggaatacgcgtcctcgccttcagagggctacatgccctcgccttcagaggactacacatcctcgccttcagagggctacacgccctcacctttagagggctgcacgccctcgccttcagaggactagacgttctcgcctttagaggactagacgtcctcaccttcagagggcttcacgccctcgccttcagaggactataa

SEQ ID NO: 16950 - DNA, 126 bp, Glycine max
  Peptide Sequence Number=SeqID_108635
atgaagtttcagtggatttcaatcggtggaagtgaaagaggagtgaaaaagaggaagattgggctttacgggacgtgctttggtgaagatttgagtaagatacgaaggctgcctgttcttgtgtaa

SEQ ID NO: 16951 - DNA, 285 bp, Glycine max
  Peptide Sequence Number=SeqID_108636
atgaaggcccaagtggagaagcatgaaggcccagaggcagagacactatcaagactattaattgttgctgaaggcccaagtaatccttgtggcgtctaccttgacttatcttccttcaccggaagtggcgtctatcctgacttatcttccttcaccggaagtggcgtctaccctgacttatcttccttcaccggaagtggcgtcatccaaaccttcgtagcctgtatcaaacgatccgctcctactcaggttcacatcatttggtatcagagcttcggctcttga

SEQ ID NO: 16952 - DNA, 273 bp, Glycine max
  Peptide Sequence Number=SeqID_108637
atgtgcagtttagctcgcctgggcgagcaccccctgcatccaaaatataaaaacgagggaaggggaacgtttttgcatccaaaaactccccccccccccccctcattcaaaagagaggacttacaaaggcttgcggttcttgctccctcaagccacttttggttgccttttgctttcatttttggtgttattgttcactccaacaagtacggcataggatattcaaaatgggtacccaaatgcaattccgagcttaggaacccaaacttgtag

SEQ ID NO: 16953 - DNA, 492 bp, Glycine max
  Peptide Sequence Number=SeqID_108638
atgtggtttggaatctcgaggcattacaattacattaagtgtaatgttgaggccatgcgaaatgttgagaacaaagctaatgcggttatcatacgcatgtgggtgaatagtgtgcacgaaaatgtcattggttcacgtgcattagaatctcgatgcgtgacagtaccacagttgatgttaatgtgctttggaatctcgaggccttgcaatgagacaatttataaatgtgctttggattctcgagacatttacaattaccttatcgtacgcatatgggtgaatagtgtgcacgaaaatgtcattggttcacgtgcattagaatctcgatgcgtgacagtaccacaattgatgttaatgtgctttggaatctcgaggccttgcaacgagacaatttataaatgtgctttggattctcgagacatttacaattaccttaacgtacgcatgcgggtgaacagtgtgcacaaaattttagtgattcacgtgaattag

SEQ ID NO: 16954 - DNA, 441 bp, Glycine max
  Peptide Sequence Number=SeqID_108639
atgccacctaccaggcaccctctagacccagataagtctaacagggccctaggttttccagcattgatcatgggtctctgccagtcatacctagctgcagacgcaccgccactacctcatcaggttgatccagctgggtcattcggcatggagcggtatttacagcacttggtttgccagcaggcggccaaccacaggggacaggtgcagacccatgagtgtctcaaccagctcagcctcagtctgcagagccaaggtttcgctccttttgcctgccctactccagatcagttcagggctgaggttgcatggcccggagattggcctgaggcccaggcaggggaggcgcccgcagaggctcccggcgacgtggaggaggctcgcatggatgagaagatgacagatttactcggtttcttgggagggagtggagccacatga

SEQ ID NO: 16955 - DNA, 486 bp, Glycine max
  Peptide Sequence Number=SeqID_108640
atgaaatatgaagataaatcacccaagcaggtgcgggtctggggtcatctggtcaaatttgatgaagatactttgaatacttttctgaagaccccagtgattgtagaagagggggagaatttatgtgcttattcgagatttgcactcctgaggcctgatcctcaggagttagctgctaagctctgtatcccagggaatggatttgagctaaatgttgatggtctcccgttgaagatcttaaggaagaacatgactactctcgctcagacatggatcgttctttcttattgtaacttggtcccgacctcccacacttttaacatcacatttgaaagggccaagttaatctatgacatcatcatgaagatggatattgtcgcagcctacccttttgcgggcgagcgaggcgagactcacgggtgtgtcttccatagaaggaaaatgcgtggagtcgccaccaacattttattgaaaggaaaacgttag

SEQ ID NO: 16956 - DNA, 213 bp, Glycine max
  Peptide Sequence Number=SeqID_108641
atgcgagggctcacgggtgcgtcttccatgggaggaagatgcgcggagtcgccacccaacgtttattcgaggaaaacgtcgaaaaaaccagaaagacgtggtctacgaactttaagtgtgaaaggttcagaagttgtatttacgcacggggaagggtgtttcccttgcttctacgtattcctcaattgtgataaggaaatcaaacctacgtag

SEQ ID NO: 16957 - DNA, 275 bp, Glycine max
  Peptide Sequence Number=SeqID_108642
gtgctccagtggcttctgtttctatcagctgtccctcctgttcagctactgacggggtggtgcgtaacggcaaaagcaccgccgggacatcagcgctggcaagtgtagcggtcacgctgcgcgtaaccaccacacccgccgcgcttaaatgcgccgctacagggcgcgtccccattcgccattcaggctgcgcaactgttgggaagggcgatcggtgcgggcctcttcgctattacgccagctggcgaaagggggatgtgctgcaaggcgattaa

SEQ ID NO: 16958 - DNA, 381 bp, Glycine max
  Peptide Sequence Number=SeqID_108643
atgactgcacctgatttcacttatgaaagcttgtgcattcaataccctgatgaggatgtcccatgtgttcttaaaactggactgatacacttgttgcccaagtttcatggtcttgcaggaccactgccatcaagaaggatatttcaggcatcaggcaactcagtggagaaagcctatatgaatactgggaaagattcaaaaaaattatgcgccagttgccctcatcaccagatttctgagcaacttcttctccaatatttttatgaaggacttagtaacatggagagaagtatgattgatgcagccagtggtggagcccttggagacatgacctctgctaaagccaagaatttaattgagaagatggcttccaactcctag

SEQ ID NO: 16959 - DNA, 658 bp, Glycine max
  Peptide Sequence Number=SeqID_108644
gtggcgcgagtcaatcatccggcgctgccgggcagcaagggccatgaattctggaagcgcgacttcagcggcagcagcggactgttctcttttgttctcaataagcgcctcaccgacgccgagctggcagcctatctggacaacttcagtctgttcagcatggcctactcttggggcgggttcgaatcgctgatcctcgccaaccagccggaacatatcgcggccatccgccccgaggcggaagtggatttcagcggtacccttattcgactgcacataggtttagaaaatgttgacgatctgctggcggatttagcggcaggcttcgcgcgtatcgtgagtacactagtcgaaaaacggtaccacttaggaaagtccatggttgtcattcaagagattgtcgccgcgctgtggcaacatgattttgccgcattggcaaaccctcacgttgtgggttttgtatatctggtcatgttcgcgaccctgtttctggaaaacgggctgctgccggcttcgtttttaccgggcgatagcctgttgctgctcgctggcgcgctaatcgctaaaggcgtcatggattttgtccccactctcgccatcctaaccgctgccgccagcctcggctgctggctgagctatttacaggggcgctggctgg

SEQ ID NO: 16960 - DNA, 136 bp, Glycine max
  Peptide Sequence Number=SeqID_108645
atggctccgagaaagctttctgcaaagagatccaggaaggacgccgcggctgaagggaccagtgccgctcccgagtatacagccatcgtttcaggagcgctgagcaccagcagcattttgaggccatcaagggatg

SEQ ID NO: 16961 - DNA, 691 bp, Glycine max
  Peptide Sequence Number=SeqID_108646
acaagctgcccttgaagatcctgaagaagaatttaaccactctcgctcagacctagaggttctttcattctccaacttggcacctacctctcatgcatcagacatcacactggatagggccaggcttggttttccaacccttattaccgccttgtgcaaggcccggggagtcacatcagattcattgacctttgagagtctcagcccagccattaacttggcatacgtgaagaaaaactgttggaaccttgatgacccctcagtcactttttggggactccgaaagaccaaaggcaagatgttcgaggctccttcatcttctgctctcccgacctctgctccttccacatctgcaccagcttcttcgactcccgcaccagcttcagctcccactcattcaggaccttccacacctatcatgagcgtggacgagttccttagtcaggtggcctggccaggagtccagccttctcctttgggagggggtgaggcctccgcaacccaggagcctccagacgcagagattgctcaggaggaggtagcatcacccgagcttattgctcagccatccccatcaccagctccagttcttgatgatccacaaccatctgcaccagcaccgatgcctaatcagcctcttgctcaggaccctccagctgcactggcgttggacttgaatgagcatgcatag

SEQ ID NO: 16962 - DNA, 375 bp, Glycine max
  Peptide Sequence Number=SeqID_108647
atgactgagacaagtatgcgagcggggaatgctgatgtgtatggattcctcgagccacagtctatacaaagatctgggcaatcgcaatttgaatcagaaagttatattaagaactggatgcagaattcaaggagggatgtgtacctaggagcctacctgaatggtgcacattggcaaatgatcgtcattttgcctaaggaaaatgttgttatctggttttgttcgttaaacaatagaccagacaactatctcaaaggaataattaacaagtcagtgttgtttttcaatatatttgcattagcattagtcgggaacatcaatattttaattgtacaatatacatccatgtttgtattcagcagtgctttgaaatga

SEQ ID NO: 16963 - DNA, 300 bp, Glycine max
  Peptide Sequence Number=SeqID_108648
atgcatgttattttcgtaacctacaccgaaccccggtcacattggcgtggtcagaatttccaaatgatatatccctttgtaaaacccgaatgctctcaacgctcttatgtagtgacgtggaggcttgcgtggaaccgacgagcagagaagaaaaataaatctccaagtgacgcgacgaggaacctgcgggtagctcacgatagggtcagggaacctagctatgaggatatctgcctgtccctgttgaatgatgatttttctttcaagaaaattatgtttttaactaatgggatgcgataa

SEQ ID NO: 16964 - DNA, 480 bp, Glycine max
  Peptide Sequence Number=SeqID_108649
atgacaagcagagaccaagtttggtcattctgcacccttgtatcatccagaggcggcgggcccgatgatacgcggagataccttacggttatccgcacccttttgtcatccagaggcggcgggcccgatgatatgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggtgggcccgatgatacgcggagataccttacagttatccgcacccttttgtcatccagaggcggcgggcccgatgacaagcagagaccaaatttggtcattctgcacccttgtatcatccagaggcggcgggcccgatga

SEQ ID NO: 16965 - DNA, 252 bp, Glycine max
  Peptide Sequence Number=SeqID_108650
atgaaggatgcggatttcttagccttgctgaatgatcattggaaatttgatttctctgtggttatggccgccggctggtttgcatcatgtttgatggccttcaaacctatgttggtgaaaggttttgatgctttggaactacaagtggacatgcgtttcgacgagatggactcaaggatcaccaaggttgaaggagatgtcacttacatctgcacatgctttgatttaccaccaccaccaccatcatcttag

SEQ ID NO: 16966 - DNA, 348 bp, Glycine max
  Peptide Sequence Number=SeqID_108651
atggtgaaagttggaacctcttacgtgccgatcaacgtctcattttcgccaaaagttggcccagggcttcccggtatcaacagggacaccaggatttatttattctgcgaagtgatcttccgtcacaggtatttcttcggcgcaaagtgcgtcgggcgatgctgccaacttattgatttagtgtatgatggtgtttttgaggtgctccagtggcttgtgtttctatcagctgtccctcctgttcagctactgacggggtggtgcgtaacggcaaaagcaccgccggacatcagcgctggcaagcgtagcggtcacgctgcgcgtacccaccacccccgccgcgcttaa

SEQ ID NO: 16967 - DNA, 393 bp, Glycine max
  Peptide Sequence Number=SeqID_108652
atgggtgaccaagaggagatacaggaacagatgaaagccgacatgtcatctttgaaagagcaaatggcttccatgatggatgccatgttaggaatgagacaactcatggagaataacgtggccactgctgccgctcatactggggacattagcaacccctatttgggatacaaccgggtggcttacccttatgaattaccacctaattacactccaccagtcatgcgtgacgacgtcggtcatgtcccttcccccatccctgaaggggagcctcctcaacattcggtcaaggttcacgaggatcatgcccaaggagatgtcgatttctaccccccggtcctcgtcgaggggctgacacccgtcatactgcctcaaccaaacctcccaacatag

SEQ ID NO: 16968 - DNA, 144 bp, Glycine max
  Peptide Sequence Number=SeqID_108653
atgggtagtgcccgacagttgtttcaacgtttgcaaggaccaatggaggaggatactctgaagtctcattttgataaaattatcaagattgggcagaagcaacgttaccacaggaatcaggttttaatcaaaatcttatattag

SEQ ID NO: 16969 - DNA, 231 bp, Glycine max
  Peptide Sequence Number=SeqID_108654
gaagtttgtgatgacattgttgagaggttggagcgccatctgagtctaggggtggtcacgtctggctcatcgacacatgaggtgatcgaagaatgcctcagattggccaagagtgtcacacaggaccatctaatatacgttaggtgtagacgcaggcggcgcactgatcaggcttggtttatgtacatattatacattgatattccttgtatatacagatattgtacatga

SEQ ID NO: 16970 - DNA, 270 bp, Glycine max
  Peptide Sequence Number=SeqID_108655
atggctggtccaccacttgtagaagcaaagcttcatggtgaatcaaaggtgattcaaaggtgttttgatgataacaatgatgatgacaaaggtgatgacaaaaagctcaaagatcaatcaaagaacaactcaagtgaatcaagaacaattcaagagttcaagaatcaagaagaaagcctagaatcaagaatcaagattcaaggttcaagaatcaagatcaagattcaagactcaagattcaagaatgcagaaaagactcaatcaagataa

SEQ ID NO: 16971 - DNA, 267 bp, Glycine max
  Peptide Sequence Number=SeqID_108656
atggaggtgaggaactttgttgggattatggctaccattgcattattgagtagatatgggagtaagttagcatacgacaccggaattggggtgaattctacaggcttcttttctggaaaattccttctctggttggtgttttggtttgtattaagggtggtgtttggcctcagatgtgtagcaggaacggtagtcacaacatgggtttctccctccttcttgttctctccatttgccccaggcttcctattcattaaagcaacatga

SEQ ID NO: 16972 - DNA, 582 bp, Glycine max
  Peptide Sequence Number=SeqID_108657
atgatgcaagccgacctcacaagtatttcctggttaagtctggccgtctggctaccggtactctccggtgtgctggtattggtgctagggggtgaccacaaggccacattgacacgctggctggcactggctggcggcctgcggctttgcctattttgccgtgattgtcggcgtgtttgtcaccgccttctattccttccgcctgtatttcctggtgcttggctggcgaagagaagtggccattcaaacagtgatctgcccaatgcgcacatgttgacggccttccatgatgatggcatcatgattggcgatgatcacgcgcacgacgatgcgcatcatcatggcctgggcccaacgacaacccacatgaaccagtcgctgggtggtgactctgccgctggtgctgctggcaattccatcaagttggtgattggctatattgcattggagccgatggtgtttggcgatttcttcaggaacgtgatttttgtcaatcctgaagcgcatccggccatggagcatctggcacatcattaccatgtttatgcacagccctgctggcatggcgattcatggttttag

SEQ ID NO: 16973 - DNA, 459 bp, Glycine max
  Peptide Sequence Number=SeqID_108658
atgagtgaaatagaggaggtgcaagggcaaatgaagtctgacatggaggccatgaaagagcaaatgtccacaatgatggaagccatgatgagtatgaaaagaatgatggaggtcaatgcggccacagttgttgcctcaagtaccaccacagaagtggacccaactcacccatttggcttcgatcaagtaaatcatcctgcctcagatatggtagggcagacaattcaaaacaagcattccttcccatcatatggcttgcctcctaactatatggcacctaatgttgcacacactcccaatgagaatgtcgacaactccgtacccatgcccattgagagccaacaacctcaatctgatcatgcacatgtctctcaactcatgggggagatgcatgaagcatctcgagaccacaatctagtcgactccgagctttgcctcgaacacgccactgaggggtag

SEQ ID NO: 16974 - DNA, 234 bp, Glycine max
  Peptide Sequence Number=SeqID_108659
atggaggagaagaaaaagaaaaaagtggaggaagctgttcaattcggaagcactgacaccatgattgatcctccatctcccatcagacgacacgtgaagtggaagatggcccgcaccaagaaaactgggcaaatgacatctgatgtagcaaaggaaattactgacaagattattcattggagaagcaggcctcacagggttcctttgtcgcccatggacgtcaagatgtactga

SEQ ID NO: 16975 - DNA, 327 bp, Glycine max
  Peptide Sequence Number=SeqID_108660
atggcccgtatctcttttcttcctttattcgaggttgcactagaacgatcaccaccaatctgtgcttcttcctcgtctattagtgtagtttacaaaagcaaaggtgaaacgaaagatattgagctggtagaggaagaacagacacggattggtgctgatccttctagtgggacctctaataaatatgagaattataaggaggaagcacggaagaaaacactaaagcataaaccaaagagggtggagagtgtcaacgctgatgcagaagcctttggtgatgactggaaaattctgattgctctatgcattgtgaagctgaagcagtag

SEQ ID NO: 16976 - DNA, 476 bp, Glycine max
  Peptide Sequence Number=SeqID_108661
gcaatccatctgacttacaaccctttgatcctgagatagataggacatttcatagattacttagacatcatttagtaccttttgagcatcctgggcattctgttattggtgattttgagcattattgttttgaacattcagattttggacattctgagaacatgacacaacctccaccccgtgagaggactctaagggaaatggctgcacctgatttcacctacgaaatcttgtgcatccaataccctgatgaggatgtcccatatgttcttaaaactggactgatccatttgcttccaaagtttcatggccttgcaggctttcctcattctttaaagggagtggcaaaggactggctgtattaccttgctccaaggtccatcacgagctgggatgacttgaagagagtattcttagaaaaaattttccctgcttccaggaccacggccatcagagaaggatatctcaggtattag

SEQ ID NO: 16977 - DNA, 649 bp, Glycine max
  Peptide Sequence Number=SeqID_108662
gctgttgtggtgtctcgccctctgcctgcctgggggcgcaattcttcttgatgaaagctcggttagtaggaggcctgatgaccttgctgggggtgacgggcactccgtagaacatacagaggcccgtaatcagagctggaaaccccaggaccctgttggacttctttgggtccactgggtgcaccctataggactgatagaggcccgtaaccagtgctggaaaccacagggccctgttggaaataatgcatacctacctatgtcaggacggcacagaccaactgatactttcgcagggggagatcggcattacgtggtcatgttggtgcgcacgatcaacacttgtctctttgtagcggcacgggtgaaatcttgccccggtatgcatagtagctgcgtgatagcctccctctctggttgtattcgcacagttggcgccctgcaatgtcaaggggtggcccaggaactgataaaaggaaactactggccgcttaaccgggagtgcaagtctcggttaagcatttatgggcagaggaccttaaattctcttaaggtgcaaatgtggagccctctaaaagcgaggatgcgtagccctctaaaggcgagggagtgtgcagccctccgaaggcgaggacatgtcgccctctaa

SEQ ID NO: 16978 - DNA, 85 bp, Glycine max
  Peptide Sequence Number=SeqID_108663
gtcgactctagaggatcccccgacaagcaaggacaaaaaggaatcttcaagtgacgcgacgaggaatccgtggggtagctcatga

SEQ ID NO: 16979 - DNA, 174 bp, Glycine max
  Peptide Sequence Number=SeqID_108664
atgaagaatattccagattcgggagttgtatttacgtttgaggaaggggaggagcttgccacccagctcgcccaggcgagccaggttgcttcctccaaaagcaaccgccttttggaggaacaatctggaaggcccaagtgggccaagttgctattcgcaccctttttttactaa

SEQ ID NO: 16980 - DNA, 570 bp, Glycine max
  Peptide Sequence Number=SeqID_108665
atgagcaaggccaccgccgacacccaccagaagatcctggccacggccgaggcgctgatctaccagaacgggatccacgccaccggcatggacctgctggtgaagacctccggcgtggcgcggaagagcatttaccgccacttcgagaacaaggacgacgtggccgctgccgcgctgagtgcgcgcgatgtgcgttggctggcctggttccggcaggagtgcgacaaggctgataccccggaaacacgcatcctcggcatgttcaccgtgctcaagggttggttccagtccgagggctatcgtggttgtgcgttcatcaataccgcgggcgaggtcggcgaccctgccgatccgatccgggagatcgcgcggaatcacaagcagaagttgttcgattacacattggaacttaccgagcaactggatgtggagcagccggcggacctggcccgtcagctgctgatcctgatggaaggcgccatcaccctgtcgcgcgtgatgggtgattacgacgccgcagacaccgcgaaggatgtcgcgaagctgttattggaacaggccaagcgttag

SEQ ID NO: 16981 - DNA, 540 bp, Glycine max
  Peptide Sequence Number=SeqID_108666
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccttttgtccacacagtcacagctattcctgtcaaaagggtcattgtaatttcgtgtcacgtcgatctacacagtgaccgtgctgtgcatatctttattgtcgccaatccctga

SEQ ID NO: 16982 - DNA, 516 bp, Glycine max
  Peptide Sequence Number=SeqID_108667
atggagaaagaaatgataaccatgatagtagacacgttgcaagtgttctactatgagaagatggcaggctatatgccctctagtttcacagattttgtgtttacaggcgagaggattgaggtaggcttgagaaggggaaagttcgattatgccgcttccgcaagcacaagcaataggaggttcggagtgggtggagccaagaagaagaagggaggcacccatgctgtaacttcagctcccacatggcctaagtcccaacaaacccctcacaaccccacttaccaatattccccgcaccaaccaaattattcggccaacgtcggaaaccctcccaatcttgcgctcgtccaacaaaggttgcccactcaacccacaaaggcctcccccacaaaatttatttccctcacaatctcatcctgccagcaacaccaatcccagcacaagcaccaatccgggaaggaattttccagcaaagaagcctgtggaattcaccccaataccaatgacatatgctaa

SEQ ID NO: 16983 - DNA, 123 bp, Glycine max
  Peptide Sequence Number=SeqID_108668
atgacgtgtaaagaaagggttgcctatggagccgaccgcgaagtgatgatgaaaggttcatctttgtgggtgatggcaagaaggttgcagtggaagctattggaacttttagattacagttaa

SEQ ID NO: 16984 - DNA, 489 bp, Glycine max
  Peptide Sequence Number=SeqID_108669
atgtgggcttttcttacaggccgacaaattgattggtcacacttagtccgatatcgcttgcataaggcattgcaattaaatgctccattgccatatccacacctagtcactctcttccttcaacactttaacatccctcttgattctgaaccctatgttccaatcaagagatccttcttaatcggtgccgctgtgattgcattctctggttaccgtaaagagcatgatggctcttgggtaaaaaagggtgctcaacccattgatgaagaaggaaacttaccagttggagaagattcctctcttcttcaaaggattttggacaggttcgatggtcttcaaacctttgttggtgaaaggtttgatgctttggagttacaagtggacatgcgatttgatgagatggattcaaggatcaccaaggttgaaggagatgtctcttacatccgcacatgctttgatctaccaccaccaccaccaccatcatcttag

SEQ ID NO: 16985 - DNA, 240 bp, Glycine max
  Peptide Sequence Number=SeqID_108670
atggaaaaacgccagcaacgcggcctttttacggttcctggccttttgctggcttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtactcataagcatcacgaacgacggatgtatgcactgtag

SEQ ID NO: 16986 - DNA, 498 bp, Glycine max
  Peptide Sequence Number=SeqID_108671
atggcgtttctccggcgtcgccttgaagcgaaactcgaaggccacgccgcggaaaatcagcccgatcagcatcagcgtcagcgggatcgccagcgcgtcgaggatcaccgagtaggccagcgggaaggcgccgaacagcgccgcgccgcccagcaccagccaggtctcattgccgtcccacaccggggcaacggtgttcatcatcagatcgcggtcgccgctctctttcacccacggaaacaggatgccgatgcccaggtcgaaaccgtccatcaccacgtacatcatggtgctgaacacgatgatcacaaaccaaatcagcggaagatcgatgcccatattcagctcctgtcgtccagagtgtcgttgaccgcggacagcggacgcgccggccggccctcggtattgtcttcttggtgtcgccgtgcgcggagaccgcgtccttggtgcgcagcaggccgtacaccacccacggctggcggccgatctcggtggtga

SEQ ID NO: 16987 - DNA, 141 bp, Glycine max
  Peptide Sequence Number=SeqID_108672
cgcacccgtgagcctcgcctcgctcgcccgcaaaagggcatgttgcgacagttggtgactccactggggaaccatggagcaaagcatgctagctatcatagggcaatacaaggaagagttgaaccagtctgtgacccatga

SEQ ID NO: 16988 - DNA, 243 bp, Glycine max
  Peptide Sequence Number=SeqID_108673
atgctgttaggctcaacttattttcattctcactatttgaggaagccaagaggtggctgcattcactcaaaggttgtaggttgcacactttgtggtggagctcttgaatcaggctattgtattcccactgaagaatcaacacatgaagttaattatatggggaaccaggcaaggcagaattttaatggaggtggattttctggattccaacagggccaacattacaaccagcaacaaaattag

SEQ ID NO: 16989 - DNA, 369 bp, Glycine max
  Peptide Sequence Number=SeqID_108674
atggtctcccgaggtggagacgaaagggatgaatatttgtttcacctcggggagtcgcatgacatggaaacctgtcccgtggtggaagaattgcttcaacgactcatggattacgggcagcttgaagtgtccataggagggagggaagaaccacaaatttgcatgcagtcggaagagaagaaggttcctctaacccccaaggccctagtgatatgttttactaggaaagggaccggctccacacccatatacccccggacggcacccaagccaacaccatttgcatatcaaagtaataaggccgttccgtggaagtatacccctcccgtgtccagcgaaagagttgcaaccgaagttgactccccatag

SEQ ID NO: 16990 - DNA, 453 bp, Glycine max
  Peptide Sequence Number=SeqID_108675
aagactcccactcacgggttttcagaaccaatacaactcaagatattcatagatgggttgagaccacaatctaaacagctcttggatgctttagctgggagtaagatcaaaatgaagacccctgacgaagcaatagacttaattgaaagcatggctgctagtgacattgccatttggagagaccgtgcccatattcctaccaggaaaagtctattggagctaacctcacaggacgctctgttggcacaaaacaacccagaggaaatttcaatacaagtggatttccagcatttcagaacacccagcagtatcaacagtagagagtggaaaaatcaccccggtaaccaaatcaatagagaccagggtggttcatctacaaggccacaacagcagatgccaagtctctatgaccaaaccacgaagctggaaaagactctagctcaattcatgcaa

SEQ ID NO: 16991 - DNA, 571 bp, Glycine max
  Peptide Sequence Number=SeqID_108676
ggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccagacgggttcaccgggtgcttaccatcaatcatgcgcaccctgaaaaaaacggggcgctcatcgcgtcgagagaaacgcgcgggcgggcataccatttctacaagtgtccgtcgtgcggtgccgagattgatggcgaaccagcacggaacaacgaagtcgcgattagccgctctggaatccccgttcatggcgtgttgccagaggcacaacctgacagcgccgagtgggatttcattcaggggatcctctag

SEQ ID NO: 16992 - DNA, 285 bp, Glycine max
  Peptide Sequence Number=SeqID_108677
atgaccacaatgccaatctccccctgcagatgtatcggttgggatcgtgcccacaagacgcccagtgggcccgaagaagtccaacagggccctggggtttccagctctggaatcgcacccataagacacccagtgggcccgaagaagtccaacagggccctggggtttctagctctggttacgggcctctgtagtcctacagggtgcccgttccccccggcaaggtcacgtcatcatagggatcgcgcctgcaagactcccagtggacccggtgggatcctctag

SEQ ID NO: 16993 - DNA, 351 bp, Glycine max
  Peptide Sequence Number=SeqID_108678
atgggtggtgcagtgaccttgttggatatccctggtgggggaaataaagtgtgcattgagggtgcctatgttgaccctttctatcttatgacattgaccatcccacaactttttctgaagccattacaggttatgtgggatgctaccttgtttggcctgtttaatgaagacttccccttgcatatgactaggacaagtatgcgagcggggaatgctgatgtgtatggatacctcgagccacagtctatccagagatttgaccaatcacaatttgaatcaaaaagttaccttaagaactggatgcaaaattcaaaacgagatgcgtacctaggagcttacctgaatgggtaa

SEQ ID NO: 16994 - DNA, 560 bp, Glycine max
  Peptide Sequence Number=SeqID_108679
gcaagagacaacctggtgaactgaaacatcttagtagccagaggaaaagaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggccgcgagagcgcttcatcgtcgagagggaaacagcccggatcaccagctaaggcccctaaatga

SEQ ID NO: 16995 - DNA, 282 bp, Glycine max
  Peptide Sequence Number=SeqID_108680
atgtcatgcttcctcttgtatagaatgcttccactcaggaaaaaaccggctgccaaccttctcaacgttctcttgtcgttgtcggaagcctcccatgggtactccttgtcttcaatcaatgtgcaggcttgctgcgacatcggaactcgatgtacggaaagttcccatgcagggttagctgaaacatggatgctagagtggcaagcacatcggccatttgattctcctctctgggaatatggtggaaggatatgtcatcgaagaactttgtcagtttcttga

SEQ ID NO: 16996 - DNA, 459 bp, Glycine max
  Peptide Sequence Number=SeqID_108681
atgacaagcagagacaaaatttggtcattctgcaccctgtatcatccagagccggcgggcccgatgatacgcggagataccttacagttatccgcacccttttgtcatccagaggcggcgggcccgatgacaagtagagacaaaatttggtcattctgcactcttgtgtcatccagaggcggcgggcccgatgatacgcggaggtaccttacggttatccgcacccttgtgtcatccagaggcggcgggcccgatgatacgcggaaatgcccgagtggttatccgtataaactttcttttgctatctgtaagacagaacgcttgatagcatgcagaggctcacatagtcttctgcaccttttgttcctccgggaacaacaagtcatttacatgcgaaaatttcatggtcgcccgcgactctcgtcaaccgagaggagcgaaattagtgtcatacactaa

SEQ ID NO: 16997 - DNA, 288 bp, Glycine max
  misc_feature (49)..(49): n is a, c, g, or t
  Peptide Sequence Number=SeqID_108682
cggatgccgggagcagacaagcccgtcagggcgcgtcagcgggtgttgncgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccctccagattcaacattgtcggaaactgacgatgcaacagccgcgacgc

SEQ ID NO: 16998 - DNA, 243 bp, Glycine max
  Peptide Sequence Number=SeqID_108683
atgaaaaaagaagaacttcaaggtcttcttgctttcacaagttttactgcttggacttccgctagtggccggtcggatgtcgaattcagctacttaacacctattgccaagcatttcgtaaggtttttcaacgtttcagaaggaaatgtgcaaaatactcaaaaggaaggcaaaagggatgaagttattagctcgcttgggcgagctaccttcatcccaaatgccttgttttgctataaatag

SEQ ID NO: 16999 - DNA, 483 bp, Glycine max
  Peptide Sequence Number=SeqID_108684
atgcttccatttggtttccggtgtatcacggaaacttacggattgtgcatcaatatttttttggttttccggcatgtcctggaatttcacaaattgcctaatgatgggtgccaagcacctcgcaaggaccaaagaaaggtcgcatgtcatcacgcaaagagatgtattggagcacttgatgggacacatatttcggttatagtttctcctaatgagagacctagatattgtttatttatatgttacctgggtgggaaaggtctgcaggagattctcgagtattacgagatgcattacgtcatcaaaaaacttgaaattctaactggtttatttatatgttacctgggtgggaaaggtctgcaggagattctcaagtattacgagatgcattacgtcatcaaaaaacttaaaattccaactggtaagtactttcttgtggatgcgggatataccaatgatccaggatttttagcaccatgttga

SEQ ID NO: 17000 - DNA, 270 bp, Glycine max
  Peptide Sequence Number=SeqID_108685
ggagcatccgctaagcgcaacattcctgggctaagcacgaggaagaatccagaagaagatgagttgtgcaggttcgctaagtgcaccgcttcagttcatccgctaagcgagaaaggcgcgcaaagccaaaaatcactaacgtgtgctaagcgcacgagcacgaacaaggccacctatttaagcctgaaatcagattttgagaggggagtttggactgggattcaaagctttagactagagctcgaagcaggagccggtttgaaagcttga

SEQ ID NO: 17001 - DNA, 336 bp, Glycine max
  Peptide Sequence Number=SeqID_108686
atgccgatctccccctgcgaaagtatcggttggtctgtgccatcccgacataggggtagcgcccacaagacacccggtggacccagaggaacccaacagggccctggggtttccagctctggttacgagcctctgtcagtcctacagggtgcctgtcctccccagcaagaatcgcacccacaaagacacctagtggacccggagaagtccaacagggccctggggtttccagctcgggttacgggcctttttcagttctacggagcgcttgtccccccagcaagttcatgccattgtgacataggtaagtatgcacatcccccaactgatttctga

SEQ ID NO: 17002 - DNA, 321 bp, Glycine max
  Peptide Sequence Number=SeqID_108687
atggctgaaccttcgaagaagcgaaagggcactttgagtcagagtcaacggcattccgggtcacagaaaatgccaatcccttcctccattccctctggatcattgttttcatcagaagaacagtgtatacggtacacaaaactcttttcctctcgttccattatagacccaaaattcatagatatggatttcttctcaaatgagagttttgaatgctttcaagcatttgaaaactccaatcttattccattcatgtctctgaaattaccagtttattctgaactagtcaaagctttttattctaatttagaatccatgaag

SEQ ID NO: 17003 - DNA, 126 bp, Glycine max
  Peptide Sequence Number=SeqID_108688
atgacgatgtcagacgggacgtggcggactatgtttggttggggcaattcatggggggccggatccttaaggggaagtagagggcctagatgggcatctccttcatcatcttcttgcagaggatag

SEQ ID NO: 17004 - DNA, 1068 bp, Glycine max
  Peptide Sequence Number=SeqID_108689
agttcttcggaaacgttctatactctggtctggagacttgcttgctcactgagcaaggaagccttatccagactcttacttcgtggctcctccgttactctcatcatggcaggtggattcgctctacgggccttcttcctggcgaccgaaggagggctatccatggagaattccatgatgcctcaccctcacggagctgccgaatccacccattctgatgggtttacttatacttccgatatggttccggattcgtcaagttccgggcggagtataagttccgtggagcagcctattccagaagagaaaccatacatcgcactccttcagctagagggggagcgaaaacgggttatggaagaaattctccacatcgtggaagggcaattggaagacccggggctgccacggggtccacatgagcaagccctacgcttctgttggtttgaactggatataaatgataattccagtcttaccgatcttcaagactggaggggttcactaagagggggtaaccttgggcaataccaatccatttttggtttctataagcccggggggatttattatccagggaatactcctccagaacaggaagaggaggaaaaaaaagcttatgatgagcatctatttgagtcgattaatcatcccttgcatcatccttacaccggttctcttgttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcactt

SEQ ID NO: 17005 - DNA, 372 bp, Glycine max
  Peptide Sequence Number=SeqID_108690
atgttgctaagtagcaacgtcatctatatctatgtaagagtggtcatgttggtgcgcatgatccgcactcgtctctttgcaacggcacaggtgaaatcttgccccggtatgcatagtagctgtgtgatagcctccctctctagttgtgcttgcacagttggtcgccctccaatattagggggtggcccaggaaccgttaaaaggaaactactggtgtggatatggagcccactgaaagtgaggacgcgtagtcctctaaaggtgagggtgtgtagccctacaaaggtgaaggcacatgaccctttgacggtgaggacgtgtagtcctttggaggtgagggccatgcagccctctgttggcgaggatgtgtag

SEQ ID NO: 17006 - DNA, 213 bp, Glycine max
  Peptide Sequence Number=SeqID_108691
atgattattgaagaatccattcatgtttcttttgatgaatctaatgctattttgccaagaaaagatgtactagatgatatttcagaatcattagaagaaatgcatattcatggagaagatcacaaaggtaaaggagatggaaataatcaagatttcaacattggtgaaattaaagcgaatgctgatcttccaagagaatggagagcttcttga

SEQ ID NO: 17007 - DNA, 498 bp, Glycine max
  Peptide Sequence Number=SeqID_108692
atgcagctggcacgacaggtttcccgactggaaagcgggcagtccatcatgctgtacactgtacccattttgatagtttgtctcctgatactagtgatcaagcagttctttcaaatcaattctgtcgtcgatgcagcaatcactgctattagtgttgtggtttatgaaagcgtcttctgcatgggctttggcgttattcccaacatcatatgtgctgaaatctttccaacaagtgttcgcggaatctgcatttctctgacttctcttacatattggggttgcaccttgattgtcactttgatattcccctacttgctccagcttctcggtctcactggtgtctttggattgtttgttgttggctgcatcatttcatggatatttgtctacttgaaagttcctgaaacaaaaggcatgcctttagaagttattattgaattctttgctattggtgcaaagcctggtactgatcctgccgcattgggaatcaaaggctga

SEQ ID NO: 17008 - DNA, 786 bp, Glycine max
  Peptide Sequence Number=SeqID_108693
atgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccaacccggcggtggggttcaacgggtcgcagagggggacgccaatgcatccattcgggaaagtgaacggtgcagggtttgagtacatgacaccgcggaggtcaaacttggccaacatggggcatgtggtgataacggagtcggagctggggccgtcgccatcggaggtggcggcggcgatcgcgaggaagccggtgatcgacgagggggagaattcaacggtgggaggatggagcttggacgcggagagcgtggaggggctgcagtcgaagctggagaggtggcggacggacttgccgccggtggtcgatcgcggcgaggtctcgagctacccaacgacgagcaccaccaagacgagccggcactcgcggaggcacaccgacggcgggagtactgggagtggcttgttctcatgctttagtaacatatgtggtgttgagtgctacgttggttgcggcggtgaccctaaaggaaagaagaaccgcatccgcagtcgccgcactccctcagcggatgacagttccagtcttctctaa

SEQ ID NO: 17009 - DNA, 1044 bp, Glycine max
  Peptide Sequence Number=SeqID_108694
atggccgacagccagcgcgacgtgatgggcagctggtccgccgccggggtggtcaagcagtcggtgaccctgcgcgaagggctggagcgggcggtgggcgacaaggcgcgcattctttacgccaagggcgccaacgtcacgcaggataaaggcatcatcgactacctgaacgagtatgagccggcggtggcgttcgacacccgttcgccgcagcagatgatcgacgaagcggtgcaggcggcgcacaaggccgacgtggtggtggcggtggtgggggaatcgcagggcatggcgcatgaggcctccagccgcgccgacatcacgatcccgcagagccagcgcgatctgatcgccgcgctgaaagccaccggcaagccgttggtgctggtgctgatgaacggccggccgctggcgctgagctgggagagcgagcaggcggacgcaatgctggaaacctggtacagcggcaccgagggcggcaacgcggtggcggacgtgctgttcggcgactacaacccgtcgggcaagctgccgatgaccttcccgcgctcggtcggccagatcccgatgtactacaaccacctgaacaccggccgcccgttcggcaaggagaatccgggcaagtacacctcgcgctacttcgattcgccgaacggcccgctgtatccgttcggttacggcctgagctacaccaccttcagcctgtcggatctgaaactgtccagcccgacgatggcgcgcaacggcaagctaaccgccagcgtcacgctgaaaaataccggcaagtacgacggcgccacggtggtgcagctgtatctgcaggacgtgaccgcctcggtcagccggccggtgaaagagctgcgcaacttcaagaaagtgacgctgaaggccggccagtcgcagcaggttgagctgccgattagcgaagacgatctgaagttctacaacgccagcctgaaatggggggcggagccgggcaaattcaacgtgttcgtcggcctggactccgacaacgtgcaggcgcaaagctttacgctgaagtaa

SEQ ID NO: 17010 - DNA, 660 bp, Glycine max
  Peptide Sequence Number=SeqID_108695
atggtgtcgcgcaggatccgcacgtcgcgatcggtgattgtgacggcgatcttcacgcagtgtaacgcgcggagcctgtcaggtgcatcacccgcgctcgtcgtttgccacgttcgatcgttttttcggcacaaactgacggaacagctcctggctcttcagcggcttaccgcccagataaggtttcagcgccatacgcgtgaagcgtttggcggcacgcagcgtgtcggcgtcgggaaattcgcgctcccacagcgcgcgcagctggcgaccggtgaaactgcgctgattgaccaccagactagcgataaagcctttctcttcgcgatagctgtaggtcatgccgtcgtcgaccgcctcgccgctgccggcgcagtgcagaaagtcgacgccgtagcccaggtggccaagcagtgccagctcaaaacggcgcagcgctggctcgggcgaaccgttggccgccgccagcgtctggatacaggagagataatcgaagaacagttcggagaagggaatttcctgctccagcacccgcgacagcagctcgttaacatacaggccgcagtagagcgtgatgccgctgagcggcagcgccagcgacaccgcttcggcgttacgcagggttttgacttcgccacgcccgccccagcgcaccagtaa

SEQ ID NO: 17011 - DNA, 573 bp, Glycine max
  Peptide Sequence Number=SeqID_108696
atgaacaagaatgatcttttcgaaacgttcataggcttccagatcgcgaatgatcgacaggaacggcgcaagaccggtgccggtcgagagcagccagagattcttgcccggtttcagattgtcgtagagcagcgtgccgaccggcttcttggacaggatgatctggtcgccaaccttcagatgctgcagcttggaggtcagcggaccgttcggcaccttgatcgagaagaattccagcccgtcttcgtaaaggctcgaggcaatcgaataagcgcgcgtaagcggcttgccgtttacttccagccccatcatgatgaactggccgctctggaagcgaaagccggggtcgcgcgtggtgcggaaggaaaacagcgtatcggtccagtgatggatgtcggtgacggtttcctgattgaagttgctgctcattttcggaactgtctctgtcttgctcctgcaccgcttgggaggacggcgcccgtggatggatcggtcgttttggtcattgccgcattttgcccacagtcacgcagctccgtggagtctgcatttcctgcaggcaaaacgccttga

SEQ ID NO: 17012 - DNA, 306 bp, Glycine max
  Peptide Sequence Number=SeqID_108697
atgggcttgtacgtagttggtgatcaatgtactcaactagtggcattgggaaaagtgtatgacagtgcgtccaccatacacaatgtcccttatacagatgatgtggttagggattcacaaaagcatctgccaaaaagggttacatctactggaatgcacaatgcagtggctgcagttgatccattgggagaattggttaagaacttgtttgatgcttaccaaaagccaattgagttgccatgggatggagcgaaatttggatacctaatgttaaagatggctttttcatcacacatgcaaatgtaa

SEQ ID NO: 17013 - DNA, 411 bp, Glycine max
  Peptide Sequence Number=SeqID_108698
atggcacacaacgtgtttgcttcgtgcccctattttagggacctatatgggagagagctaaaagggttttttgtgataattcccaaggtggtcatatctctcttgatggtctctagaggtatcatcccctttgaagaacatattgcggcagtagggactactagcaacaatatgttatcaaagagaaaaactctagatgaggtccccagtggagtcgccaactgtctcaacctacccttcggcgggagggcgacgcgagggctcacaggtgcatcttccaagaaaggaaaatgcgcggagtcgccaccaacgtttattcaaggaaaacatcggaaaacccggaaaagacgtggtctacgaactttaagtgaaaggttcgggagttgtatttacgcaaggggaaggtattag

SEQ ID NO: 17014 - DNA, 375 bp, Glycine max
  Peptide Sequence Number=SeqID_108699
atgaccataatttgtctctgtgcgtttatcaggcatcgagtcttacagatagcaaaacgtgcggatgaccataatttgtcttcgcatgtcatcgggcacgatcgcctctggatgacaaaagggcgcataatgaccataatttgtctctgtgtgccatcagacacgactgtgtctggatggcgaaaaggtgtgcgaaataaccataatttgtctccgcatgtcatcgagcatgatcgcctctggatgacaaaagggcgcagaatgaccataatttgtctctgtgtgccatcggacacgatcgtatctggatggcaaaaggtgcggaatgaccataatttgtctccgcatgtcatcaggctcgccgcctttggatga

SEQ ID NO: 17015 - DNA, 189 bp, Glycine max
  Peptide Sequence Number=SeqID_108700
atgagaacggcgttgccccagttgacgttcgcactgaagttcggtaaccgtgtacgcgaatgggagcatttcgtgccaatccttgttggtgccgttgtccgtgataatcttccttggcaaaccatatcggcagatgatctctgtcttaatgaacctgaccaccacattcctcgtgacattggtatatga

SEQ ID NO: 17016 - DNA, 192 bp, Glycine max
  Peptide Sequence Number=SeqID_108701
atggaaaaatgggggcatcccttttataatcaaaagccgaaaaaccctgaccagaagcagaacccattcccaacggaagtcctattgatccatgatcacgcatcacgttcgcattttagcgaagaaaacaccgagactatttctagtctcacaagttatcaagaactacgtaggtctgagttcctcatttga

SEQ ID NO: 17017 - DNA, 578 bp, Glycine max
  Peptide Sequence Number=SeqID_108702
caccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17018 - DNA, 207 bp, Glycine max
  Peptide Sequence Number=SeqID_108703
atggcagagagggcacgtcgaagaggacaacgaagagggaggacgacacctgtgaccatgagaggtggcgacattggcgatagtgacgacgaacggctagggctccataggttattgcaagacgtttggattctgagatttgtggctgacatttttggtcatgaggcaataatagatggagttatgcctcaagatgttgaagattga

SEQ ID NO: 17019 - DNA, 276 bp, Glycine max
  Peptide Sequence Number=SeqID_108704
atgtgcaccagcatgaccacattgacccagacatggatgacactgctgttcagcaatgtcttgcctagcgatcacaactccgatctccctctgcctaagtgccagttggtgtatgccatcctgacacggatgaacatccacgtggcccaggccttcattgagaagtactgcatgcctaggcaggcgcagggtgatgcacatcaggccacagacgcaccgccaccagctcggcaggccgatccagctgggtcactgggcgtggagcgttatctatag

SEQ ID NO: 17020 - DNA, 648 bp, Glycine max
  Peptide Sequence Number=SeqID_108705
atggaaacaactaaatcaactcaacaagcactccaaagtgtagaaatccaggttggtgagctggcagaagcagtaactcaatttatgtctagactagaaaaatcctttgtagaggttaaagctcaagagaaaagccctataaaagagcatgagttaagagaaaaagatgaggagaaaaataaggaacatacacaacaacaatgggagaagtactcaatagtagaaaaccaacaaggaaatattctccaaagcaataaccttcctcatcaactgattgacaagaaaggaaggcaaggagagcatgagaaaaccttaagtgccacgctttctttaataactaacacctttcttgaaatgatttggaacgtccttccagattatatgaagttcatggaatttctagctaaaaggcgaaacttcaaggaagatgagtatatcatccaatctttggatgttaaacataaaggtttcaatttcttggaaaaaggactgaaaaataacttagaaaaatattttctgaaaaacagtcctttcgctaagagcatctttgttcatgcgctaagctgcgagtctcaagcgcttagcgcccaacccttgcatttgaggttgatttggtccgctaagctggccaaggttgagctaagctaa

SEQ ID NO: 17021 - DNA, 273 bp, Glycine max
  Peptide Sequence Number=SeqID_108706
atgtacaattatcatgagaaaggaagagctcttgatcttgaaagtgtattggcggacttcatcacatatcaagctagctctaaagatgacctgctaatgcaattcaagggtacagtagattcaatgcaacaagcatttaaaagagctaagactcagattggtaacttggtggacgacatgattaaagttatggtcagaagagaagaagagtatgcagagattgaaacacatcaagaaagcattcttcaagttaacacaatacatcatcaatga

SEQ ID NO: 17022 - DNA, 410 bp, Glycine max
  Peptide Sequence Number=SeqID_108707
tccaaactcaggagcagaggtcgcttgagcaaatggaccaatggcttgcactcaattctggatttacatgcgattctcctcaaatttcagccagcccgaatcaattagaccttgcaccttacgcttcaggcccctacaatgctcaatggaatgccccggggcttctccatgacaagcacacgttgcgttcgagtcgtattctcagagaaatggaggttgatgagccttggttaggcttatggctaccattaaattatcaagtagacatgggagcaagtcagcataggacactggaattgggggctttgtggttgattttagggatggcctttgtggataactgggcggtgggtaaggagaagactcactttgatcctttcgtcggtgaagaccatatcatcaaagcttga

SEQ ID NO: 17023 - DNA, 201 bp, Glycine max
  Peptide Sequence Number=SeqID_108708
atgggtgaagtagaggaggtgcaaaagcagatgaaggccgacatggaggccatgaaagagcaaatggccacaaagatggaggccatgatgagcatgaagaagataatggaagccaatgcggttgtagttgccgctaccaacgttattgctaaggtgaacccgatgcccccatctggcctcacccaacctcagctatggtag

SEQ ID NO: 17024 - DNA, 435 bp, Glycine max
  Peptide Sequence Number=SeqID_108709
atgttgctcccccttgcttgcatcaccaatctcaaaccggccttgatccattatcccttgcagcaaatcctctgccatagggcatgcctctacatcatgtgccttcaatataaaccacctagaggttaccacatctttcatttgcttcggcctctaaggtccgcactcctccaccacattaaccgttggccccccatgactggcaaaagggttacattggggttgtaccatcaagggaaaggagactggaaaatcttcccgggggtcaccaccgccatttggttggcgatcaaagatggtggcaagtctgtgtatgacattgggatgggagcgaattccgaaagtttctttaccggaaaattcattcccggattggtgtttatgcttggattggagttgccgatggggcgaggttgtgtaggagccaagttttga

SEQ ID NO: 17025 - DNA, 807 bp, Glycine max
  Peptide Sequence Number=SeqID_108710
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgggggttggtagatcttcccgggagttattacggccatttggttgccgataagggacgccaagaggtcttcgtacgtcattgggagtggggtgaattctggaattggcttcgggggaaagttcctcattgcgttggaattgtcggtcaggcgagttgtggttggagccggaacttggggagcctccctggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 17026 - DNA, 300 bp, Glycine max
  Peptide Sequence Number=SeqID_108711
atggcaattttgatcaccaatactcgacaacatttcatagagatgaaagactcgggaatacgtatgctatgcatggaaaatgtaattatgagattgagatgcccgaagaaacatcatttcctagttaaccacgcattagggaggcagtgccccatgtgtgcaattaagaaggtgatatggaccttcaggcttcccgtgacaaaagacgaaaccaacatacaatgcatgcgtgacgacatgatgcaaatgcgcaaaagcgcaacagggggatgtacacaacatggaaatatcctcaaataa

SEQ ID NO: 17027 - DNA, 261 bp, Glycine max
  Peptide Sequence Number=SeqID_108712
atgccaatctccgcctgcagatgtatcgattgggatcacgcccacaagacgcccagtggacccgaagaagtccaacagggccctgagggatcgcgcctgcaagacacccagtggacccgaagaagtccagcagggtcttggagttgtcaagctctaattacgggtctctgtcagttctacggagtgcctgtcacctccagcaagggcatcaagccccctactaatcgagctttcatcaaaaagtactgcgtccccaggtag

SEQ ID NO: 17028 - DNA, 258 bp, Glycine max
  Peptide Sequence Number=SeqID_108713
atgagtatcaaaggtggtaccggtagagctagtggaggtggtagaatctcaacctccggggaagtcggtgggtctacaactggtggttgcaactcatttggtgcaagctctatccttgttggtataggactggggaaacaacctcgggagatcttcctaacggcagctgagcttcaggccaggccactttatctaaaaattactccatggatactattggcctgttatgagccaactgctactggttgtagacaataa

SEQ ID NO: 17029 - DNA, 491 bp, Glycine max
  misc_feature (121)..(121): n is a, c, g, or t
  Peptide Sequence Number=SeqID_108714
ggtcggaacaggagagcgcacgagggagcttccagggggaaacgcctggtatctttatagtcctgtcgggtttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgattcgagctcggtacccataaaggtcgtaataaaggataaggatgaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17030 - DNA, 294 bp, Glycine max
  Peptide Sequence Number=SeqID_108715
atgagtgagatagaggaagtgcaagagcagatgaaggccgacatggaggccatgaaagaccaaataacctccatgatggaggccatgttaagtatgaaatggatgatggaggagaacatggccgtagttattgccaccagtgccgccactgaggcggatccgactcacccatccagcataaaccaaacaagtcgtccggtcccagacatgaagaacctggaagaagatgatctgtataggtgcactgagcgagagtcaaactcgctaagcgcaccgcttgcacctccaggctga

SEQ ID NO: 17031 - DNA, 435 bp, Glycine max
  Peptide Sequence Number=SeqID_108716
atgtggaggggggtcaaatgccactggaacctgggggctgagcggctgtatgtagtcctcacggtctgcagctggtgcatccctctgctggtcacctgcctgggccggtgtcatgaatgggtgagatatgcgaaaaaaccactccatgtaatccgcagatacctgcccaggcggcggagggatgctctggatgtaaccgaactggcgtaccaccctctccggtcgaagtatgacgatcataggatcccatctgagctaaccctggaacgatggaatctcctgaaacgccctaaccccccgatgctcagtgtacgacaaccaggacacatctgtgacggtcaaaccatcacaatgtgccctgtacggtgctcctgtgatgccctttatgtgcgccttcgacgtcaaccaccgggaagcacgtggggacgtctcctg

SEQ ID NO: 17032 - DNA, 612 bp, Glycine max
  Peptide Sequence Number=SeqID_108717
atggctgagaagaccaaaaagaaactggaggaagctacccagtctggaaccactaacggtgtcattgaccctacatctcccatcagacgccacgtgaagtggaagatgacccgcaccaagaaaattgagcagatgacatctgaggcagcaaaggaaatcgctgagaagatcgcatcacagggatcgttcgtccctcatggatgtcaggatgtcctaactaccatcattggccgaccagaccaccctggctatgtccgtgctgctggatctgtagctgacctaacaaatcagggaccagctagaggagtcgatcacagaaaaagtgactcaacagctgatggcatctttcagccagatgcagtcccagtttcaatcccagatgcaatcttagggacttgcactgcctctagagcctatgggaacgatcctaagacggatgactcagacaagtgcaggttgtacatcgaagcaaatcctccctgcttggttgccctaggaagagtttttgagggatcaacaattcacaacattcctttgttacctggccatgtgaaggttggtgttgaggaggttaaagatgcacaagctcccgttcctgtacccactgatgag

SEQ ID NO: 17033 - DNA, 622 bp, Glycine max
  Peptide Sequence Number=SeqID_108718
atggcgggtttacgccaggctatcgaagagggtaaattagagcagtttgttgcggatttctatggggctccggctcagggaagcccgtactctctgatcattatgctggtggtgttcggcctgatcttctacttcatgatcctgcgcccacagcagaaacgcgctaaagatcacaagaagctgatggactccatcggtaaaggcgacgaagtgctgaccaccggcggcctgatcggtcgcgtgaccaaagtggccgacaccggcatcatcgccatcgcgctgaacgacaccacggaagtgatgatcaagcgtgacttcgtggcggccggaattgccgtgctaaaccgttatcctttgtggaagtatctgatgttgatcgtcgtgatcctcgtcggtctgctttatgcgcttcccaacatctacggtgaggatccggccgtacaaatcactggcgcgcgcggcgtcgccgccagtgaaactacgctggaccaggtccgtaccgtattagaaaaagacaacatcgcgagcaagtcgattgcgctggaaaatggcgccatcctggctcgctttaaagatcctgacgttcagctgcgcgcccgcgaagcgctggtgaccgagctgg

SEQ ID NO: 17034 - DNA, 315 bp, Glycine max
  Peptide Sequence Number=SeqID_108719
gcgtatcacgaggccctttcgtctcgcgcgttttcggtgatgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 17035 - DNA, 589 bp, Glycine max
  Peptide Sequence Number=SeqID_108720
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgcttgaaccactaacagcattgttacaccctagtcttaagaaactggatcagaaggcaccaagtcaatcaagctacaagatcattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17036 - DNA, 582 bp, Glycine max
  Peptide Sequence Number=SeqID_108721
aggactacacgtcctcaccttgagagggctacacgctcttacattcagaggatttacacgtcctccttcaaagggttgcacgcttcacctttaagaggactgcacgtcctcacctttagagggcctacgcactctcacttcagaggactacacatcctcaccttcagagggtacacgcctctaaccgattcagaggactacacgtcctcgacctttcagagggctacacgccctcaccttcagatggacacgtcctcaccttcagagggctacacgccctctaccttcagaggactgacacgtcctcaccttgagagggctacactcttaaccttcagaggactacacgtcctcacgccagtcttaccttcagaggactacacgtcctcgccttcagaaggattgcatgctctcaccttaagaggactaggactacacatcctcaccttcagagggctacacgctctaaccgacagaggactacacgtcctcgccttcagagggttgcacgccctcaccttcagaggacggtgcacgtcctcaccttcagagggctacgcgccctcaccttcagaggactga

SEQ ID NO: 17037 - DNA, 174 bp, Glycine max
  Peptide Sequence Number=SeqID_108722
atggccaagtttgatccagaaatagtccttgagttttatgccaatgcttggccaacagaggagggcgtgcgtgacatgagatcctggagccagggcttcgcttctttttcatgccctactccagaccagttcagggcagaggttgcatggcccggagattggcccgaggcctaa

SEQ ID NO: 17038 - DNA, 408 bp, Glycine max
  Peptide Sequence Number=SeqID_108723
atgcacacacaaagtttcacaattccacaatttcctaaaataggcctaactcacaaaaatagtccccagtggagtcgccaactgtcgcaacatgcccgtttgcgcgggtgcgctttccaagggaggaaagatgcgcggagtcaccaccaacgtttatttgtggaaaacgtcggaaaaaccgaaggaaaccggtcagaaagaaaattccaagttcgggagttgtatttacgtttgaggaaggtcgacaaaagtggggctcttgctcctacgtaccctccatcgaagaggaaatcagacctacgtagttcttctttaagggtgaatcaagcgattctttttacttggaaggtgatcattttaaggcgttggaccttaaaaatgatccatttacttggtaagaaaaattga

SEQ ID NO: 17039 - DNA, 570 bp, Glycine max
  Peptide Sequence Number=SeqID_108724
atgacaaccaacctctcaaaatgtatcaataaggttttgaaggattgtcgcaacattcccataacagcattggtcaaatcaatgtacagtaggtgtcgaaagtactttgttgaacattggcaagtatattgttcaaagcttgttaaagaacttagaaacaatcaagaacaagcttgttcgcacattgttcgcgtgtatgacatccactccacaaggtttgaagtagaggagaccttcaatcctattacgcaatgtggcagacaaaagtgggcagttaacttgaatggtcattattgtcaatgcggaagcttgtggttaccttactccgcacaatggtggcctcttgggaatgaagcggctattcctccttctaatgacacatggacacttatccctgacccaactacaattcgtgtgaaaggtcgaccaaaatcaacaaggataaggaatgagatggattgggtcgaaccatctgagcaccgacaaaaatgcagtagatgtggagccgaagggaataacaggcgtcgttgtccaatgcaatctgagcgtgatagttgttcaattcattga

SEQ ID NO: 17040 - DNA, 158 bp, Glycine max
  Peptide Sequence Number=SeqID_108725
ggtatgtgttcaagggtgaaaaaggaatattgaatgtagttaaagactccatcattgtcatgaggggaattatgaagaatggcctctattatgtggatggcgaagttgtaattggctctgcagccactgcaacaggaagagtttttatcaaaaattga

SEQ ID NO: 17041 - DNA, 105 bp, Glycine max
  Peptide Sequence Number=SeqID_108726
atgtcgtggaactttgcagattacctaacgatggatgttaagtacctcaaggcggtcaagcgaaggttgcatgacatcaaacgatggtccccggacgaaattagg

SEQ ID NO: 17042 - DNA, 678 bp, Glycine max
  Peptide Sequence Number=SeqID_108727
atgcacaccctcaccttcagaggcctacaagttcttgccttcagaggactgcacgtcctcgcctttagagggctgcacaccctcgctttcagaggactacatgtctttgctttcataggactacccgttcttgtcttcagaggactacatgttctctccttcagaggactacacgtcctcgccttcagagggccacacacccacacgtttagaggactagatgtcctcgcctttagagggctgcacgcccaggccttcagaggactacacgtccttgcctttagaggactacacgtccttgccttcagagggctgctcgccctcaccttcagaggactacacgtcctcgaattcagaggactacacgtcctcgccttcagagggttacacgccctcgcctttagaggactgcacaccctcaccttcggagggtacacgccctcaccttcaaaggactacacgtcctcacctttagaggactacacatcctcgcctttagaggctgcacgccatcgccttcagaggctactacatgtcctcgccttcagaggactacacgtcctcgccttcagaggactacacgtcctcgcctttagagggctgcacgccttcgccttcagaggatttcatgtcctcgccatcagaggactacacgccctcattccttcagaggactaa

SEQ ID NO: 17043 - DNA, 672 bp, Glycine max
  Peptide Sequence Number=SeqID_108728
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaatgtcacgctctcgtgcgccgtcatcacgctggaccaacctgggtaccgagctcgaattcgtaatcatggtcatagctgtttcctgctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatcccggtaactatcgtcttgagtccaacccg

SEQ ID NO: 17044 - DNA, 495 bp, Glycine max
  Peptide Sequence Number=SeqID_108729
atgtgggctttccttaccggtcgtcagatcgactgggctcacttggttcggtaccgaatgcataaggcattatgggccaatgcacctctcccttaccctcaattggtcactctatttctccgtcattttcaaattccgcttgatgatgaaccatttgttcaagtcaagtgttcctttgctattggtgttggtgtagtgacttcttttggataccgtaaggatcggaatggtcaatggctgaagaaagatgcacttcctcctcaagttgagcgtactccttctcctcctcctcagcgagatgattcaaccctcatgactgaagttctttccgagttacggggtcttcgtacttatgttggcgaccgttttgattctctggataatcgctttgccggcatggatatccgtctcacacagcttgaagaagatgtgggttatattcgtcagagcttcgaccttccatgtcgcgctaagcacgttcatcttagttgttga

SEQ ID NO: 17045 - DNA, 330 bp, Glycine max
  Peptide Sequence Number=SeqID_108730
atggtccgcaaccatctgcttaaagaacttgccaatttctcagaagactatatcaagctctttggtggcacagaaatatttgaggaattaaggatgtcactacttgttgatgggttaatcaaggtgacaacggatgagtggatggatataacggacatgggacatgtttatttaaaagaacgttgtcccttaccgtctgcatcattgttatggtctagcaattgtcatccgcatgcgaagttgaggccaaatccatatattagcagaatgcagcattacaagagcttcgtgatgttcaagagagactatgttgacataaatgatgattga

SEQ ID NO: 17046 - DNA, 560 bp, Glycine max
  Peptide Sequence Number=SeqID_108731
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaattaagcataaagatgtacaaggtagcaaacgcctcagaataccttgtgatcactggggttggaatcacagacataaagcttgcaaagaaagcatgggttctcccaggccagtcatgcaccgttttcgacctctctccggtgaactacaccttcgaggttcagggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 17047 - DNA, 194 bp, Glycine max
  Peptide Sequence Number=SeqID_108732
atgtgggatgtgtacctagaagcctacttgaatggtgcacattggcaaatggttgtcattttgcctaaggaaaatgttgtcatctggtttttttcgttgcataataggtcagacaactaccttaaaggaattattaacagtgctttgaaaggacttaaagatactccacaaagtaaatccaaggctgctgctac

SEQ ID NO: 17048 - DNA, 801 bp, Glycine max
  Peptide Sequence Number=SeqID_108733
cgcaatcaattggtttcctcgatggaaggaaggcaaggagggagtccttttctcaagtggggactaccctaacgttccgttgttagggacaaggggttgcattaactataatcccgcacttgccataagacagttagggtacccaatgaggggagcgccaacagaggagagtctctcgcctctccttgtgagggatctaggtgcgcaaagtctcaaggttatacaaagagtccacaatgcgtggagaagtccgttgaggaaagacaaggagcttaggggcatccgtaatggcgtcatcggtggttatcatggatggctaagagttcacacgcgagggttagattggctctccaagttgaaagttgtcgatgaggagaacttcgaagctccagaggaaattgaagaagtccgagctctaaaattagagctagggaaggcaagactcgccaaggagaagttcaaatcagccgctacacacatccggaaagagtgcaccgagttacaagaggaaaacgcgaccactgcaagagcccttgaacaagaaaccaaaagggcccgcaaggaggaacatggccgagagaaattccgaggagcattgtccaagaggagtttggctcaacacttggaagccatggagcaaagcatgctagctatcatagggcagtacaaggaagagttgaaccagtcagtgacccatgagcaaaagctagtggaggatttttcacaagtgtacgccgtaaaagaagcaagagggagggtgattgatgcgttgcatcaagaagcgactatgtggatggatag

SEQ ID NO: 17049 - DNA, 579 bp, Glycine max
  Peptide Sequence Number=SeqID_108734
atgacagatcttgtgagcgcggaagatgacgtaaatctccgcgtgtcaacgggcttgtcggccgcgattgacgaagggcacagaagacgacatagcaaaaagaatgtttatacggataaccacccgggtatctccgcccgtcagcgtgactcgaaagtcagtatgacagatcttgtgagcacggaagatgacgtaaatctctgcgtgtcaacgggcttgtcggccacgattgacgaagggcacagaagacgacatagcaaaaagaatgtttatacggataaccacccgggtatctccgcccgtcagcgtgactcaaaagtcagtatgacagatcttgtgagcgcggaagatgacgtaaatcttcgcgtgtcaacgggcttgtcggtcgcgattgatgaagggcgcagaagacgacatagcaaaaaaggttttgaaagagcggacaaccacattgggtatctccgcatgtcacgtgactccagtgccagcatgacagaacttgtgagggtggccgacaaaagcgaggctcttgctcctacgtatcctccaatgaggaactcagacctacgtagttcttga

SEQ ID NO: 17050 - DNA, 327 bp, Glycine max
  Peptide Sequence Number=SeqID_108735
atggaccaattaaagtgcctaagcaccccctataaatgcttagattctctaatcacgctagttaccctcgtctgggccatccgacaaggtcagtgcactctaccccccatgacatacactccatacgacgtatgttcgtggccaaaagctagtgccaaagaccctggaagcatgcaacagggacaggcaaatatcctcatagctaggttcctgaccctaactatggtgttaaaacggttttccaaaggaagcataagacatgctatggcggttccaaagtcagaaaagatgcaaagacaagatgaaactaacaagaaacaagcatag

SEQ ID NO: 17051 - DNA, 276 bp, Glycine max
  Peptide Sequence Number=SeqID_108736
atgaagcagagatcaagcaacgagattataaggaagaaggtgtatgtctgcccacaagctagttgcgtgcaccacgacccttcaagggcaatggtagccgatcatgcatcaatcatgccaatgatttatctgttacctactgcttacatggatgctggcagtggaattgcactgaaaaattttaagcgtgtgcagaaagcctggggtcaaggaagtatatctagtttacagcctcagcagaatgattttcttgattactatgatggtagtggttaa

SEQ ID NO: 17052 - DNA, 402 bp, Glycine max
  Peptide Sequence Number=SeqID_108737
atgtatcaagtttccatgtctctggcactaggtgcacttctttacaaagttcaagcaattcgtcttaagggttggccaatagtagtcacccctgaaaaccctggtagccatgggggacttcttccacctgtgaacattcttttcttgagacgctgggtttgggcactgttaaataggcaactttggcaaagtactatatctcaatctttcgctaagccaagctactggcttaaagaagatgagctgtcaagttcgctaagcgcaccgctccaggtcatcaagcgcaccacttcagctcatccgctaagcaaaacaagcgcgctaagccaaaatccacttatgcgcgctaagcgatccagatctgtgctaagcgcacgagcacgaacaaggccacctatttaa

SEQ ID NO: 17053 - DNA, 579 bp, Glycine max
  Peptide Sequence Number=SeqID_108738
atgggtaacgaagagggagtgcaagaacagatgaaggccgacatgtcggctttaaaagatcagatggcttctatgacggaagccatgctaaaaattcaaaaatcaatagaagacaatcctacggcggccgcttccaacacaactagggaagcggaaccggtgctacagcccgcaatgaactcgtgccgggacagaagcgcggtgggtttcaatcggaggtatagtcctcaagcctacccttatggcttgcctccagacttcactccccgtaccgctccagacgatttgagccaagcgcctaccttcgaggggcaactccctcctcatgccgactatcctctgccctctacttccctcaagggaatcggcccccatgagttgccccagccaaacattatcagccatgccccatctcaatttgcacccgttaaggaacctgttcccatttcaaaagacaagggaaagatcgatctgcttgaagagaggttgagagaggtggaaggcctcgacaactatcctttctcggatttaaccgatctgtgtctggtacctgacatcatcattcctcccaagtttaag

SEQ ID NO: 17054 - DNA, 182 bp, Glycine max
  Peptide Sequence Number=SeqID_108739
atggggttgaatcaatttagatttttcaacatggtccatgacatcttggtcaaggtgaaactggaagtaacaaggacatcaacagtcctaaatgtgtttggcagtagacgaagcagtgatgtttatgatcccaacatgaggaaaatgcaaggatcacgcatgagcgaacatgaaaacaaaag

SEQ ID NO: 17055 - DNA, 120 bp, Glycine max
  Peptide Sequence Number=SeqID_108740
atgagccatggacgcctgtatcaacaaaggatgaagaacgcattcgacaagaaggggcagaatcaactagccgtggtcagatgccaggatgaagttggaggccgaaacccatcaaggtaa

SEQ ID NO: 17056 - DNA, 408 bp, Glycine max
  Peptide Sequence Number=SeqID_108741
atgaagagggcgagaatgaaggagaaacccatgccgcgattaccgttcctacatggaaacttcccaccagccaaacaatgtcattactcagccaatatcagcccttctcactacccaccacccagtcatccacaaaggccatccctaaatcaaccacaaagcctgtctaccacacttccaatcacgaacaccacctttcgcacgaaccaaaacaccaacgaaggaaggaatttcgcagtgaaaaagcctatagaattctccctaattccagtgtcctatgatgatttgctcccatatccactcgataattcaatgatagccataaccccaaccaaggttcctcaacctccatttttccaagaatatgactcgaacgcaacgtgtgctttgagcattgtagggccctga

SEQ ID NO: 17057 - DNA, 528 bp, Glycine max
  Peptide Sequence Number=SeqID_108742
atgtggtcatctgcgccctttccggagatgtcagcgtctttcggtggagactttttcaagtctcacaagttatctagaactacagacaaaatttggtcattttgcacccttttgtcatccagaggcggcgggcccgatgacacgcggagacaaaatttggtcattccgcacccctttgccattcagacacagtcgtgtccgatggcacgcagagacaaaatttggtcattctgcacccttttgtcatccagaggcggcgggcccgatgacacgcggagacaaaatttggtcattccgcacccttttgccattcagacacagtcgtgtccgatggcacgcagagacaaaatttggtcattctgcacccttttgtcatccagaggcggcaggcccgatgacatgcggagacaaaatttggtcattccgcacccctttgccattcagacacagtcgtgtccgatgacacgcagagacaaaatttggtcattctgcaccctttttgtcatccagaggcggcggacccgatga

SEQ ID NO: 17058 - DNA, 126 bp, Glycine max
  Peptide Sequence Number=SeqID_108743
atgcgaaggaattgggttgcgaacttggtgctcaaatttcacgacgatccagcggtgaataagtccgagatcgtcatttttcggagacaggtttggtgggctgcgagaaaaaagaaagggttttga

SEQ ID NO: 17059 - DNA, 504 bp, Glycine max
  Peptide Sequence Number=SeqID_108744
atggatctcactaggatgtctgaagtgtgtacttttttaagggatagatgtcgaagtgatcctttgtgggaactccacatgaagcaaaaatggggtggagtcattggtgatgttgcttacaaggagtggctatggcacatcacaacaccaaaggagaaaggaattaaccaattgaatcaacacaacaatcaaaatggatcaatgggacctttcagtggtacttggcctatgttatacctcaggtcatatcttgaagattgtagttatcttaattcctcatcattggcaaatagcttcatgatggctttgtatttctctctagagaatggcaatttctggtttccagctcaaatctacaggggattgtattttcgtgacgccttagttagatatgattccaaaactgataactttcaagcaaggctggaaaataattggggaacaacatccaatgggattaagctgagagctcccccagttgatacccttccatctgttagatac

SEQ ID NO: 17060 - DNA, 658 bp, Glycine max
  Peptide Sequence Number=SeqID_108745
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcttggttatttggaaagagaaagaatggaaggaggatcgggtggtggcgagagagagaagtggaacagtgtaagtgtatacagagagtgcttgagaaaccatgcagccagcctcggaagctacgccacggacgggtgcggcgagttcacggtggacggcgcggggggactacaatgcgcggcgtgcggctgccaccgcaacttccaccggaaagtgaagtacccggtggcggagcatgaggagtatggaggcaagaagcggttcaggtccaagttcacggcagatcagaaggagaagatgctggggtttgcggagaagcttggttggaagcttcagaggaaggatctgaatgatgagatagagggtaccgagctcgaattcgtaatcatggtcatagctgtttcct

SEQ ID NO: 17061 - DNA, 387 bp, Glycine max
  Peptide Sequence Number=SeqID_108746
atggcctccatcatcgtggccattttctctatcatggcctccatgtcggccttcatcttctcttgtaccttctctacttcacccattactctagctctagcacagaggaaaacacaaggatcaggtatgagcaaacatgtagaacaaaaagaacgatatgttcattatgatgctgaagagatgtttatgcgatgcatgatatggatcgtgttacttgcgcatttgggggcgaaatgccccatgtgtgcaattaagaagacgatatggatcttccgacttccctcgacaaaagacgagacccacatacaacgcatgtgtgacggcataatgcagatgcgcaaaagcgcaacagggggatttacacagcatggcaatatcctcaaataa

SEQ ID NO: 17062 - DNA, 841 bp, Glycine max
  Peptide Sequence Number=SeqID_108747
gtcaagagcttagggatcaccagtctaaaagagttagggcagttgatgggtcagctccagcggcaaccttttcgcaaagcttacggtaaaatctgggacctagccatggtagaagtctccgcagaggccattgcttccctcgcccagtattattatctgtcattgaggtgcttcacctttggggacttccagctatcacccatggtagaagaatttgaagagatcctaggatgtcctctagggggaaggagaccatacctcttctcagggttctatccctcattagctagaatctctaagatagtccaaatctcggcgcaggaattagaccacagaaagcaagttgaaaatggggtggttggaataccgaggaaatatttggaggcaaaagcaagaatattggcagcgatcgacgcttttctcgcctatcataaccacaaggaaagcccggtcgtcgctatgttagccgacctatatgacaccttcgaccaaagatgtgaaaagagcagtacgaggattgtttgctgtactccaactctttatgtatggttggttttgcacctttttcgccaagaggtgaggcatgcttgcccgctagaaagccaccgttcatgcacagagaaaggaggggcaaattgggaccaactcttagcaaacaaagaaggagtgtctgtcaactggttccctcgatggaaagaaggaggaaccggagttcttatttcgtgcggaggatttccgaatgttcccttgatggggacgaggggggcaccactagaggaagagctcacgcctgtcatttcacgaggtttcaataagaccaacatggagacacttcagaaag

SEQ ID NO: 17063 - DNA, 360 bp, Glycine max
  Peptide Sequence Number=SeqID_108748
atagctgaaggcaaggcagctatctcctcattccatcaattatcagatgaatccttgagtgaagcacttgagagatttcgtagcttgctgcgaaaaacaccaactcatggattctctgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 17064 - DNA, 399 bp, Glycine max
  Peptide Sequence Number=SeqID_108749
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccacttattgtgctctcaaagatgatggatatgatattgtctaccaaaggatacctttaacaacagaaagacatgttttggcctccgccgttgatgcaacacagtattgtcaacatgagtaa

SEQ ID NO: 17065 - DNA, 261 bp, Glycine max
  Peptide Sequence Number=SeqID_108750
atgacagatcttgtgagcgcggaagatgatgtaaatctccgcgtgtcaacgggcttgtcggccgcgattgacgaagggcgcagaatgaccataatttgtctctgcgtgccatcggacacaactgtgtcgaaaggcaaaaaggtgtgcggaatgaccacaatttgtctccgcatgtcattgggctcgccgcctctggatgacaaaagggcgcagaatgaccataatttgtctctgcgtgccatcggacacaattgtgcctga

SEQ ID NO: 17066 - DNA, 587 bp, Glycine max
  Peptide Sequence Number=SeqID_108751
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccggccttctttaggaactctagcccaattctcttggagttttctatcaaatacccttggggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 17067 - DNA, 210 bp, Glycine max
  Peptide Sequence Number=SeqID_108752
atgactgagaacaagagagggtacatctcttatggatcagttctagtggagggtacatccactaggttattcaaagagaacaagggagggcacatcccttgtggatctttgctgattaaacaagtaaataacacaagagaattgttaacccagttcggtgcaacgtcacctacatctgggggctaccaagccagggaggaaatccactaa

SEQ ID NO: 17068 - DNA, 558 bp, Glycine max
  Peptide Sequence Number=SeqID_108753
atggtcatagaccagtcccttttctttgaactcactcaattatccagtgacggtgtaccatttgagggtacacttgatgatgagtggaagttcgatttttctgtttctgatgcccgtcgaatggtttgtaccaaccaagcggatatgaccggaaggttttttgctggttcattggcattcaaatgccgcatcatgcactacttgattgtgcgcatcctactccctagatcatccaaccttgcacaagtttctgaggaagatttaataattttgtggattttcttaaccggtcgtcaaatcgactgggcccatcttgccgctgaagaccgctctccatcaccacattgtcagagagatgactcttcatctcttatgcacaacattcttgacaggttggatggactccacaccttcgtcggtgaacgctttgactcgttggatagccgtattgaagccatggatgcacgatttgcagggatggacacacatatcaccaaacttgaggaggatgctagctttgttcgtcagtgctttgaccttccaacaccatcctcatag

SEQ ID NO: 17069 - DNA, 265 bp, Glycine max
  Peptide Sequence Number=SeqID_108754
aaataaaaaaaatgctaataatttaacattccggaagttactgaggcctattccggaagaagtgcttctggaaaacagtcttccggaagttactgagcccattccggaagaagtgtttccggaaaacactttcggaagcacttcttccggaatgggcctcaataactttcggaagaaggtcttccggaagttacccattccggaagcagtgcttccggaagtgttttccggaagaacttcttccggaataggcctcagtgcctaa

SEQ ID NO: 17070 - DNA, 207 bp, Glycine max
  Peptide Sequence Number=SeqID_108755
atggtgcagcccaaaccaagtactggcctaaaggggaaatctctccaacatgctctcactttcatgccttctcgcattcaaaaatcaaaggcttgggtccctaggcctaagcatttcaccgagcacttggtggtcgcacttttgggtatcaacaacaaggggataggggcaatgtggcttgccccatcatttcagaacacaacctag

SEQ ID NO: 17071 - DNA, 386 bp, Glycine max
  Peptide Sequence Number=SeqID_108756
atgggatgctacagcaacactcaatggttaagcgcgaggaagaatccaaaagaagatgagctgtacaggttcgctgagcgtatcactccaggtcatcaagcgcactgcttcagctcatccgctaagcgagagatgcgcgctacgtcaaaaatcactaacagtttggactgggattcagagctttgcatgtctagggtttctagagagagaaaggtccaagttccagagagttttgagagattttgttgtgtgaagatctgcagagaccagagcttgaagcaggagccggcttcttggtatggaaagctaaatcctctattggatcttccctgtagggtcattcaacagtggaactggtctgactctaaagtccttgatagtgcagg

SEQ ID NO: 17072 - DNA, 948 bp, Glycine max
  Peptide Sequence Number=SeqID_108757
atggcggttccaaaggattcattctctaccgaaaccgaaagccaagttggggactttgtaaccttcatcgggctacacacccgcactttcagaggactacacgtccatgcctttagagggctacacgttctcatgttcatagggctacacgccctcgcctacagaggactacacgtccttgcctgtagagggctacatgccctcgccatcatagggctacatgccctcgccttcagaggactacacgtcgtcacctttagagggttggacgccctcgccttcagaggtctgcacgtcattgccttcagagggctacacgtccaatccatcagaggactacacatcctcacctttagaggactacacgtcctcaccttcagagggctacacttaatcgctttaagaggactacacgtcctcacctttagaggactgcacgcccttggcttcaaagggcttcacgccctcacctttagaggactacacatcctcgccttcagagggctacatgtcctcaccttcagaggactacatagggctgcacgccttcgccttcaaggactatgcgtcctcaccttcatagggctacacaccctcacgttcataggtctacacgtcattggctttagagggctacacgcgctcgcctttagaggacaagggctacacgtcctcgcctatagaggactacacgtcctcccctttagagggctacacgtcctcgcattcagagcacaacacgtcctcgccttcagaggactacacgtcctcgccttcaaagggctacatgtcctcacctttagaggactacaagtcttggcctttagaggactacacatcctcaccttcagagggctacatgccctcaccttcagagcactacacatccttgctttcaaatggctacatgccctctccttcagaggactacacgtcctcgccttttga

SEQ ID NO: 17073 - DNA, 615 bp, Glycine max
  Peptide Sequence Number=SeqID_108758
atggagacttgcccaatgacggaggaattgctacaagggatgatggaaaaaggcctaattgaagtttgtagcgcaagaaagggggaaggagatgtgtgcatgcagtcagttgataagagaccgagcaaacccaagccattggtgaaccacttcactaaggatgttgccgcacaaaagccccaaggtttccagtctgtcccagttaagaagcctgtgcctttcccctacaaaagtgacaaggcggtgccatggaggtacgccacacaagggcccgaaggaaggaaagacgcatttgtcgtgcatgttaaagatgatctatcctccgctaaggtcacaaacatctctcgcacgagcggcatgactcgtagcgagcggatcttcgcaacacccgagccaccggtgcgatccaaagacctaaaggggaaagtaaaggcgaatgtggtagagagtgataaggtgaatggcgaggtcccgtttggaaggtgtcataccctaatttcatccggggacgatcattggcaaaaatttggattcttgccagccaaattgagctgcttaacaccagttaccatgcattctgtaaggtttttcgatgtttccgaaggaaatgtgtaa

SEQ ID NO: 17074 - DNA, 1122 bp, Glycine max
  Peptide Sequence Number=SeqID_108759
atgggtgaaatagaggaagggcaagagcggaggaaggctgacatgcaggccatgaaagagaaaatggccacaatgatggaggccatgatgagcattaagaggataatggaagtcaatgcggctgcagttgctgctaccagcgccattgttgaggtggacccgactcccccatctagccttaaccaaataaatcatttaacctcggatgtggtaggtcaggaaggcaaagaattgggaagtataggcgacccccattttgtgcaagttcagaacacgcatgctttcccaccatatggcttgcctccgaactatacaacaccgaatgttgcgcacactcccaatgagaatgtcaataactccactaccatactcgttgagagccgacaacctcaatctaatcacgcacatgtctctcaacccatgggggagacacatgagataccccaccacaatctagccgacttcgagccttgcattggatgcgccacagaggggcaagcaattggtggtgtacctttgtcaaacactttggagggccctcgattttgcccacaaccacaacccttttattttgcggtaggaagagtccctcctgctatggctgaaaatggaaagttggatcagatagaggaaaggctaagggccgttgaaggaggtgaagattatgcctttgctgacatggaagatttgtgcctagtacccgacaaggctaaagggctacacgtcctcaccttcagaggactacacatcctcaccttcaaagggctgcacgccctcgccttcatagggctacacaccctcgcctttagagggctacacgtcctcatcatcaggggactacacatcctcgccatcagaggactacacatcctcgccttcagagggttgcacgacctcaccttcaaagggctacacgtcctcgccttcagaagactacgcgtccttaccttcaaagggctgcacgccctcgccttcataggtctacacctccttgccttaagagcgctacacgccctcgccttcataaggctacacaccttcgccttcagaggactacacatcctcgccttcagagggttgaacgcccttgccttcatcgagctacacgccctcaccttctga

SEQ ID NO: 17075 - DNA, 326 bp, Glycine max
  Peptide Sequence Number=SeqID_108760
gtatgacgcctaccaggcaccctatggacccagataagtccaacagggccctgggatttcccaccttgatcacaggactctaccagtcgttcggcgtccccgtcacacctagcaagatgagtctcagcctacagagccagggctttacttcttttccgtgccctactccggaccagttcagggcagaggtcgcatggcctggagattggcccgaggcccaggtaggagaggcaccagcagaggctcccgacgaggcagatgaggcccgcgaggacgaagagatgaccgatttacttgatttcttaggagggagcggtgccacatga

SEQ ID NO: 17076 - DNA, 390 bp, Glycine max
  Peptide Sequence Number=SeqID_108761
atggcttacacccacattccggtgaaagttgaaaatcctggtgagtcattagagacatctaacaacagctttcaaaattgccccatccagcatcaattagacctcgcaccctacacttcagagccctaccatgctcaatggaatgcctcggggcttctccgtgataagcacacgttgcgtttgagtcgtattcttggagaaatggaggttgatgaaccttggctagggttatggctaccattgaattatcaagctttctcgctgcaaaattcacttcttggttggtgtctccggtttgtgctaaaggtggtgttcgtcattggaagtgcggtagaaagactttgtggtagatttagggatggcttttgtggatacctgggtggtgggtaa

SEQ ID NO: 17077 - DNA, 384 bp, Glycine max
  Peptide Sequence Number=SeqID_108762
atgactagaggcaatccatctgacttacaaccctttgatcctgagatagataggaaatttcatagattagttaggcatcattttataccttttgatcatcctgagcattccattactggtgaatctgtgcattatgttattggtgattttgaacatcctgattttgagcattacaattttgagcattctgattctgagcattctgattttgaacattctgagaacatggcacaacctccaccccgtgagaggactctaagggaaattgctgcacctgatttcacctacgaaagcttgtgcatccaataccctgatgaggatgtcccatatgttcttaaaactggactaattcatttgcttccaagtttcatggccttgcagtga

SEQ ID NO: 17078 - DNA, 522 bp, Glycine max
  Peptide Sequence Number=SeqID_108763
atggcagaatcgtcaaagaagagaaagggatcatcctccaccgccgctgctgctgcccatcgccgccacggaccatccgaagcacccacagcacctatccatccttctttgtcatctccaagatcatccactctgttttcttcctatgatcagcgtctacggtacctttctcaattttcttctaggatcattttagaccctaagtacctagacatagatttcttcaatgatgagacatttgattgttatcaagtgtttcaaaattctggcttggttgatttcatgtcttttaaattgccttattatcctgaacttgtcaaagtcttttactgcaatttaacaattcaggatgacattctttcttctgaggtgcatggtattcccatgatcattgatcaatcattgttcttttctttgactaaactacccagtcaaggtgcaccttttgagggaaccattgttgatgactggaaatttgattattctagtcatgatgctcgccgtatggtttgcaatgactag

SEQ ID NO: 17079 - DNA, 366 bp, Glycine max
  Peptide Sequence Number=SeqID_108764
atggcaaggctaggaaccgtaaaaaggccgcgttgctggcgtttttccataggctccgcccccctgacgagcatcacaaaaatcgacgctcaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacccttcggaaaaagagttggtag

SEQ ID NO: 17080 - DNA, 522 bp, Glycine max
  Peptide Sequence Number=SeqID_108765
atgtcctatgctgacttgctcccatatctacttgataattcaatggtagccataaccccaaccaaggttcatcaacctccatttctccgagaatacgactcgaacgcaacgtgtgcttgtcacggagaagccccggggcattccattgagcattgtagggctctgaagcgtaaggtgcaaggattttcaaactttcactggaattgggtgcaagccattggtctatttgctcaagcgacctgtgctcctgagtttggacttccaagaccattcaatcaaagattactcgtcttgcatgttggtggggctgccgtaagacaacaaagaagtgagttatcaagaataggatgttggacaaatggcctcagttaccttaagaaaaaaaagggggttgaattaagatacaaagattattccccaattaaactttcactctctctttacggattaacaatgcacacagggacaacccttccgttgtgttcaggaatcctctacaacaagagactcacggtctcttaa

SEQ ID NO: 17081 - DNA, 337 bp, Glycine max
  Peptide Sequence Number=SeqID_108766
atggtgtttgatggatatggagtgagtaaggatatgatatttatctctgctaaccaagttgtgacatctttaaaagaatattgtcgcaacatgcccttttgcgagcgagcgaggcgaggctcacggatgcgctttccaaagaaggaaagatgcgcagagtcgccaccaacgtttatttgtggaaaacgtcggaaaaaccgaaggaaaccggtcaaaatgaaaattctaagttcgggagttgtatttacgtttgaggaaggtattagcacctctcacgtcgacaaaagcggggcttttgctcctacgtaccctccatcgaagaggaaatcagacctac

SEQ ID NO: 17082 - DNA, 461 bp, Glycine max
  Peptide Sequence Number=SeqID_108767
cgaggaagcggaagagcgcccaatacgcaaaccgcctctccccgcgcgttggccgattcattaatgcagctggcacgacaggtttcccgactggaaagcgggcagatgccatcgctcagcttttgtgcatactggggtcacaacttgctgcatggagacgagtgcggatcatgcacaccagcatgaccatctatcagtttgcaggaacaacgcctatgagacaccccatggatccagagaggtccaataggaacgacaggcctctgccaattttacggagtgcccgtcgtccccagcaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17083 - DNA, 285 bp, Glycine max
  Peptide Sequence Number=SeqID_108768
atgggctcaaaaatctaccctaaggttcatgagaatcctagggccttctttagtagctctagcccaagcctcttggagtcttctatccaatacccttggggggtaggattgcatcatcccctccagcttggaaaggatttgacctcaaatcccgagagtatggtaagttctgaaaacccctttcatggacatcttcccatgaaggacatggttcctcaccaactcaatgagtggtgctacaagtatagaaaaatatgggacaaaccttatgtaaaagtttgttaa

SEQ ID NO: 17084 - DNA, 828 bp, Glycine max
  Peptide Sequence Number=SeqID_108769
atggaagtgcctgcaccgtttgccggtgtggtgaaagagatcaaaatcgccacgggcgacaaggtgaacaccggttcactgatcatgatctttgaagccgaaggcgcggcgccagcagcggctgccaaacctgccgtgaaagaagcggcggcctccgcgccagccgcggctgcgggtgccaaagacgttaacgtcccggatatcggcggcgacgaagtggaagtcaccgaagtgctggtcaaagtaggcgataaagttgaggctgagcagtcactgatcgtggtggaaggcgataaagcgtcaatggaagttccggcgccgtttgccggtacggttaaagcgctgaaagtggctaccggcgataaagtcagcaccggttcgcttatcatggtgttcgaagtagaaggcgctgcgccggctgctgctgcaccggcagcgaaacaggaagccgcaccagctgcagaagccaaaccggctgctgcacctgcgccagcagcggcgaaagccgatgcgaagagcgaatttgctgaaaacgatgcttatgtgcacgccacgccggtgattcgtcgcctggcgcgcgagttcggtgttaacctggcgaaagtcaaaggcaccggccgtaaaggtcgcatcctcaaagaggacgtgcaggcttacgtgaaagacgcagtgaaacgcgctgaagcggccccggctgcggccgcaggcggcggtattccgggcatgctgccatggccgaaagtggacttcagcaagttcggcgaaatcgaagaagtggaactggggcgtatccagaaaatctcgggcgctaacctgagccgtaactgg

SEQ ID NO: 17085 - DNA, 306 bp, Glycine max
  Peptide Sequence Number=SeqID_108770
atgcaacagggacaggcagttatcctcatagctaggttccctgaccctaactatggtgttaaaacgggttcctctcggtgtggggtttcaacggagaaaaacgacagtttgtggtggctaatggtggctgtgggtgatgtagaaagtgcttgggacgttagaaatggttttggaagaaagaaggagaagaaaatgatgtttttcctaagctacttggactacaaggctcaaaacgcacaagccaaatttcgagaagatccaacggttaacgaaggctggacaacatttttactgaggcagcttcat

SEQ ID NO: 17086 - DNA, 221 bp, Glycine max
  Peptide Sequence Number=SeqID_108771
gggatggccttaggcctgtgttgtattctgaagcaatggggcatgccacattgcccccattctcttgctattcatgcctaaacaagcgcccaccaagtgctcggcgaaatgccccaatgacatatgaatatgatcttgaacccaagctcctagcttcaatgcaaggaaacatacttatggctaagaatctaaattttggttttggaagtggaaaggcatga

SEQ ID NO: 17087 - DNA, 162 bp, Glycine max
  Peptide Sequence Number=SeqID_108772
atgaagcaagcttcgacagaaggtcgtcctcgtgtgttcaagaaggagatcttgtgctcaagaagaactttctctggtggtgcactgactcttacgactatggatggggatgagctccctcgtcccgtgaatgcggatgcagtcaagaaatactttgtctaa

SEQ ID NO: 17088 - DNA, 383 bp, Glycine max
  Peptide Sequence Number=SeqID_108773
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccttacttggacacaatcatgcactgtttaggcgagcacaactgaaagctcttggttcaatccatagccaagaggctggtaaagggggtgaactcactcatgatgaagcaacaattatcagcggagcactagatctcacagagaag

SEQ ID NO: 17089 - DNA, 220 bp, Glycine max
  Peptide Sequence Number=SeqID_108774
gaatgtatggtctgcttgggccagcagcattttggaaggaaggagcaggctgctgttgttgttgctgagggcaggaccatctgagattagggtgattcctccatccaggattgtatctgttgctggagaggctgctcaattgctccaggttgctgcatggaagggcaaaggtctgtatggtggtcagcagaggagcacaaaccacaaacccttgcgacag

SEQ ID NO: 17090 - DNA, 86 bp, Glycine max
  Peptide Sequence Number=SeqID_108775
atgaataggatagatcctaagatcaggatgaatacttcaggagtattccagtatggtcctactgttcccggcattaccatattgaa

SEQ ID NO: 17091 - DNA, 744 bp, Glycine max
  Peptide Sequence Number=SeqID_108776
atgcctgcggaccggcagagccggctccgcggcatcccgatgggcaacgttcaagcggagatgaagtcgctccaatgtttttccgttctatccggaagtaccgatgaatgctcagatcgccctgatactcgggcaggatggcatcaccaacggcgccatctacgcgctgctggccttgtccatcctgctggtctttaccgttacccgcgtgctgttcatcccccagggcgagttcgtcgccttcggcgcgctcaccatggccgcgctgcaggccggcaagccggtgctgctggtgtggctgctgctggcgttcgcgctggccgaggccgtggccgatctgatggcgcgcgccaaacggccgggacgccgcgcgccgctgtggcgcatcggcgccaaggtggtgtatccgctgctgctggccgcgctgttctaccgcctgccgctggcgcagctgccgatggccgtgcaggcgctgctgacgctgctgctggtggtgccgatgggcccgcagctgtaccgcctgttctaccagccgatcgcctcggcctcgacgctggtgctgctgatcgtgtcgatcgccgtacacctggcgctggtcggcctgggcctgctggcctttggcgccgagggcgcgcgcaccgcgccgttcagggacgccagcctggcgctgggcccggtcaacgtcaacagccaggcgctgtgggtggtggcggtgtcggcgctgctgatcgtggtgctgtacca

SEQ ID NO: 17092 - DNA, 910 bp, Glycine max
  Peptide Sequence Number=SeqID_108777
atgggcctcaagcaacagggcgtcaccgatatgcgcgcccacgcacgcgccaatccgggttttacgcagcaatgtatcgacctcatcacggtcgttgcgtcgaatgaggccggaaaggaaatgctcggttacgactcctctctgcgcggaacccttcagcggtcgatcgtttcgtcttccggaaaattcgtcgatgtcctgcaggcgatcatcgataaccggcgtgtttttgaagacaaggtggtggtgcgcacggaaagcggtgaagacaagctggtgcttctttccatcagctttccggccgaggcggccgccttcaatcgcgtggtggtgagcatggtggatatcacccagcgcgaaatggcgctgaaggcgctggccgaagcgcaggcagagctgacgaaggcttcaaaggccgcggcggtgggcgccatgtcagcatcgctctcccacgaattgaaccagccgcttggggccatcatcgtcaatgcacagacattgctgcggtggctcgaccgcgatccgccggatctcgccgcggcccgccgttcggccgaacgcatgatccgtgacggccagcgcgccagcgacatcatccagaacacacgcagtcagctcgcccataccagcggcaagacggaaaccttcgatctcgatgagttcattgacgaaacgctcagccttctcgaacacgagctcgagcgcagcggcaccgccgtccacgtggacaaacaggccactccgccaataacggccgtcaggatcgaattgcagcaggtcctcatcaaccttctcacaaatgccattcaggcgatggaagaggcaggcagcaccaatcgcaccatcacggtgcggaaagaacgtgaagacggtcacaatatccatattgccgttcacgacaacggaccgg

SEQ ID NO: 17093 - DNA, 594 bp, Glycine max
  Peptide Sequence Number=SeqID_108778
gcatctgcacctgttactgttgcaagagtctatggtctatgttcttctgctgatcaccatacagatctctgtccttctttgcagcaatctagagtcaatgagcaacctgaagcctatgctgcaaacatttataatagaccccctcaacagcaaaaccaacaacaacagaataattatgatctttcaagaaatagatacaatccaggttggaggaatcatccaaatctgagatgggcaaatcctccacaacaacaacaacagtctgtccctcctttccagaatgctgttggtccaagtaggccatatgttcctcctccaatgcagcagcaacatcaaagacaacaagcaactgaggccccttctcaaccttccttagaggagttaaatccgaaaaatgtgagtgccatcaccttgaggtctggcaagcaaattgaagtgcctccaccagtagctgcacctgcacctgaacctgtcaagcttcattctacacctgaaaaagaggatgagctagcttcacaaaagagaaagcttcctgatcatgagggagctaacaaaaattttcatgcaagtggaccctcttccatttccacctag

SEQ ID NO: 17094 - DNA, 302 bp, Glycine max
  Peptide Sequence Number=SeqID_108779
atgtgcatgatcagtttgaggttgttggctttcaatgagtatgggagcggagttattgacatcctcactgggagtgtatgccacattgggtggtgtatagttgggaggcaagccatatggtccacctcaacaatggtgttggtagcggctattgcaaccacattgacctccattatctcctttatgctcatcatgacctccatcattttggccatttgctctttcaaggccttcgtgtcggccttcatctgctcttacacctcctctacttcacccattactctagctctagcacgggttcg

SEQ ID NO: 17095 - DNA, 348 bp, Glycine max
  Peptide Sequence Number=SeqID_108780
atgcctgcggaaccaagtcatatgaaccggaaaggatcctttctaataggcgcttcagtcattgcatcctttggttatcaaaaagagcatgatggctcttgggtgaaaaagggtgctcgacatgttggtgaggaaggacgtgatggagaagattcatctcttctttcaaagattttggacaggttcgatggtcttcaaacctttgttggtgaaaggtttgatactttagagttacaagtggacatgcgcttcaatgagatggagtcaagaatcaccaaggtcgaagaagatgtctcttatattcgttcaagctttgatctaccaccaccgccgccaccatcattttag

SEQ ID NO: 17096 - DNA, 363 bp, Glycine max
  Peptide Sequence Number=SeqID_108781
atgtaccctcccttgttctctttgaacaacctagtggatgtaccctccactagaactgatccacaagagatgtaccctctcttgttatcagtcacaacaacccaagtagatgtaccctctacttgtaccacaaaggatgtaccctccaatgtgttaagacaaagttctcaggcgggaatgggaagaatcaaaagaattctcaaactgtgtcattttgaattctttgacaagggagaagggagacacaaaagaattcaggcgattagtcctttgttcttttggaaaagggagaaaagagacacaaaaagaattcaggcggttagtccttggcgaattctttttggcaaagggataagagaatga

SEQ ID NO: 17097 - DNA, 195 bp, Glycine max
  Peptide Sequence Number=SeqID_108782
atggggaagcaaaattctaacgataatatagtgtatgatgcgacaatcaaagaaaatagagtagatgatcatggagatgacaaggaaggaggaattggtgttgtgggtgcttcagatggtccgtggtggcgatggccagcagcagtggtgatggaggacgttccctttcacttcttcgatgattctaccatttga

SEQ ID NO: 17098 - DNA, 204 bp, Glycine max
  Peptide Sequence Number=SeqID_108783
atggctccgaagaaactctccacgaagaggtctagaagagacgccacagcggaaggttcagtgtcgcccccgagtttgatagtcatcgtttctggagcgccgagcaccagcagcgtttcgaggccatcaaaggatggtcgttccacagagagaggcgtgtctagctcagggaggatgagtatacggactttcaggaggagatag

SEQ ID NO: 17099 - DNA, 267 bp, Glycine max
  Peptide Sequence Number=SeqID_108784
atgacggtgaaacctctgacacatgcagctcccggagacggtcacagcttgtctgtaaccggatgccgggagcagacaagcccgtcagggcgcatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 17100 - DNA, 396 bp, Glycine max
  Peptide Sequence Number=SeqID_108785
atgtctcacagctcttcctccctgcctcctgaagaattgcagcagctgacccaacaaatcagggaccagctagaggagtcgatcaaagaaaaagtgactcgacaactcatggcatcgttcagccagatgcagtcccagtttcagtcccagatgcaatctcagggacttgcactacctccgaagcatctggttggtccctcaggaaataatcctaagatgggtgactcagataggtgcggcttgtacaccgaagcaaatcctgcccgcctggttgccctggggagagtttatgagggatccactgttgttcataacactcctttgttgccttgccaagtaaaagtaggtgtggaggagttaaagatccagatgctctcagttcctgtatccacttaa

SEQ ID NO: 17101 - DNA, 129 bp, Glycine max
  Peptide Sequence Number=SeqID_108786
atgaaagaagtggttaaaggctcaaagagggtgacaatggataccaatgcaagatcaatggcagcggaatggagaaggaggaaaggtgattggagaggccacttcaaggagaagatgagtctagaataa

SEQ ID NO: 17102 - DNA, 477 bp, Glycine max
  Peptide Sequence Number=SeqID_108787
atgacctcaagagtgctaccgattggtggcctcttgtgtttctgtttgaaaggcttgcgctattgtttgacagggacgaatgtatttgaggtacccttcgttaagagggctctatctcaagtgtcctttgtgaccggtcaaccgttaggctattatggttattggcctttgttcgcgttcacccatcatgttttggtgtggtgggctgcggaacaggttagacctgggatcctgttcgacaggtatgctatattaggtgatgatgttctcatcaccgatccacttgtggcggaacagtaccggctaggcttacaacggcttggtgttaagatatccacacacaagtctttgatatcctcaactggtgctgtagagtttgccaaacaatttctggtcaaggatatgagggttaacctctctcctgtgtccatgaaagctttatgtggcttccaccacccccacggatactacttctaa

SEQ ID NO: 17103 - DNA, 144 bp, Glycine max
  Peptide Sequence Number=SeqID_108788
atgtggaggagtaactggtttcttgaggtgtccatagtttacattgaatccttcatcacacaactgactgatgctgatcaagtttgcagtcagtccctttaccagcagtactttgttcagactaggaagtccatcatggactag

SEQ ID NO: 17104 - DNA, 225 bp, Glycine max
  Peptide Sequence Number=SeqID_108789
atgacaagagggatacacatcctcgcctacagagggttgcacgtcctcgccttcagaaagttgcatgccctcgtctttagagggatacgtgtcctcaacttcaaaggtctgcacgccctcgccttcgaagggctacacaccctcgcctttagaggactgcacgttgtcgctttcagagggcttcacgttctcgccttcacagaactgcacatcctcgctttgtga

SEQ ID NO: 17105 - DNA, 210 bp, Glycine max
  Peptide Sequence Number=SeqID_108790
atggactgtcccttgtggatgctctggagcatggagtgcaacatctgtggtgtaaatgaaaaatctgagggaggaatgactggagctgaggaagggggaatctcagaagatgggggagcctcagacctcttccccttggccttgcgcggccctctgaaggtaactgagaggtcatctagcgtggtcagattcttcaagatatcaacataa

SEQ ID NO: 17106 - DNA, 310 bp, Glycine max
  Peptide Sequence Number=SeqID_108791
ggcaccatagttcacatactaaacatcattcccaaagaagagaaaaggatagaaggcctcaagaggttaacattagccttccatatttccacggaaaagataatgttgaggcctacttatattgagaaaagaaggttgaacaactctttacttgccatcatattagcgaagagagaaaagttccattggctacccttagcttttaaggtagagtattggaatgatcttaagagtgccctaaggaaaaggcacatcccctcctactatgaaagggagcttatggataagctccaaaggcatagacaaggga

SEQ ID NO: 17107 - DNA, 66 bp, Glycine max
  Peptide Sequence Number=SeqID_108792
atggcggcggcaaaaccccaacgcactccacaggaagtgggtaccgagctcgaattcgtaatcatg

SEQ ID NO: 17108 - DNA, 342 bp, Glycine max
  Peptide Sequence Number=SeqID_108793
atgaaagataagagggatgaggaagaaaaaatagaaaaacaaaagaaaaagaaggatagtaaggccttgtcttcaaaggccaaggggaaggaaaaagagggaaaggattcctccaagaagattgttaagaagggggtgcaaatagcaaccaggcccacttgggccttccaggaagttctccagaaggcagttccttctagaggaagcaacctagctcgcctgggcgagctgggtggcaagctcctccctcattttcctataaataggaggaggagggaagaacaaaaatgttcaaccctcctgattttccgccattcttcatcgttcttcggtcttcaaccg

SEQ ID NO: 17109 - DNA, 349 bp, Glycine max
  Peptide Sequence Number=SeqID_108794
taatgtaaggtctgaaaactcatttcctgggcatcttcccatgaaggaacatggttcctcactgtcataccctaatttcgtccggggacctttgcttgatgacgtgcgacctttgcttggtccttgtaagaaggctgttccttctggaggaagcaaccctgctcgcctgggcgagctgggcggcaagcatctcccctattttgctataaataggggaggaagtgagaaggaaaaggccgaggcgcttccgaaacgtttctgtaacattttccgtgaggaatttcgcaaaggtttcgaccgttcttcgacgttcttcattcgttcttcatcgttcttcgatcttcaacgg

SEQ ID NO: 17110 - DNA, 501 bp, Glycine max
  Peptide Sequence Number=SeqID_108795
atgcagatggcaaacagagatagaggtggtggtcatagaacatttaatcgtggtagaagacgtggtcttattttgggagctccaattaccactaacccttccacctcctccattcacatatcaaccttagagtcgatgattcatgtcattgcaccgactccaaatacacttcctacagctcgagaccaaccaaatccgacctttgtaagggagtcaattcccactacccctattagagatgcttcaccttcagcaccagatgattctcttacacctgagtacccaccagatccaaattttgaacatattgttgatcagaggccttttattcgtgcatataaaggagaggaaaaatttgatgaaccaacaacaaattggttgaaggtatcagttgacctttgcgataggtggtttggagagtttaagaaagactatagtggcacccagaagaagagcgagccattagagctgtttttgagacaaaaggttcacgcattttga

SEQ ID NO: 17111 - DNA, 432 bp, Glycine max
  Peptide Sequence Number=SeqID_108796
atgaatggtgaggttgcatcaagcaagtggatcatggacaaagatacactagggtgtagtggacagagagattcatgggatttaggggaattagcgagtgatgactcatttggcatggggatgttcacagacctcacattgttattcctaattggctctcatattatactttttgagttgggagcttggggatcagtgtacgatgtatccgagcggaggacttacccctacaaccaacaacttttagggttaggagatgtcaatgaagtcgtgcccctgcgagcttggtgtagtagtttttatcttggtatggaagtgcctcatgatgctcaagaatttgaaatgaccccagtgaggagatcacacattgatatgacacctgacgaggaggaagtgtatcgcgagcttttgagatctagagccttcatctga

SEQ ID NO: 17112 - DNA, 324 bp, Glycine max
  Peptide Sequence Number=SeqID_108797
atggttgaaagacccactagcagctttagagccaacacagagaaaaacccgaaggaggaatgcaaggcggtgttgactagaagccagaggagaacaggaaagaaagaggaaaaagagaaagaagaagagaagaaggtcttaacctttaagaccaaaagccaactagcccgagaggctaggaaagaagagccaccaacccctctgaaggagctctcatatcctttagtgccattaaagaagaataaggagtgctacttcaagcgtttcttggagatattcaaggggtttgagataaccatgccatttggggaagccttgcagtag

SEQ ID NO: 17113 - DNA, 246 bp, Glycine max
  Peptide Sequence Number=SeqID_108798
atgaatgtaaacttcaacaagctaagagtgaattcaacgaaatctatgatcggtcacctactaggggcagctggtggtgtggaagccgtagcaacaatacaggcaataaagacagggtgggttcatcccaatatcaatttagaaaacccagatgaaggagtgaataaccagacaatgtattggatactcacactactcctttggttgaacaaaaatgattataggggggattgctttcttggatga

SEQ ID NO: 17114 - DNA, 1017 bp, Glycine max
  Peptide Sequence Number=SeqID_108799
atggaagtaagttcctactgctcagaaggatttgatatgggaggatattcagccgacaaggaaagtgacgacgacattgtatgcaaaaagtatgacattagcaaggagaagtgggcccaattttgtcagacctgcagagacccttcgtggaaggatgtgcaaaaaaagacacaggccatccagaagcaaaacacagcccctcacgtgttatctcgtgggggttatgaatatttagaaaacaagttgatgaatgagaagagaaagaaaaaattggaggaagatgctcaatccggaagcactggcaccatgattgatcccccatctcccatcagacaacacgtgaagtggaagatgacccgcaccaagaaacctggtcagatgacgtctgaggcagcaaaggaaattcctgataagattataaaacaccctggtcgtgtgcgtgctactggagctggtgtgacgatcaagaaatactttggaccggctccaaggacctcccacacgtctttctccatggctcccaaagacttggaggaacgatccagacagggtgactcagacaaatgtgagttgtacattgaagaaaatcctccctgcctggttgccctaggaagagtttatgagggatccacaaccgttcacaacattcctttgttgcatgatcaagtgaaggttggtgttgaggaggttagagatatagatgctcccattcctatacccactgaagaggttaagttagtggggcagacacttaacaccttccttgcttggctgacacatctgagagctgtgggactagcaaaacctgcagataggccggatcatgaggtcgatgatcccatatatgtaatgacattgaccattccacaactttttctaaagccattgcaggttatgtgggatgctaccatgttcagggtgtttaatgaagacttccccttgtacataaagcatggagatctgtctgatatagcacacggtggtcaatgtctcagcatctttgttatacagttgtga

SEQ ID NO: 17115 - DNA, 528 bp, Glycine max
  Peptide Sequence Number=SeqID_108800
atggagttggtggtggatccatggatatggggatcactttgtatcaaaaatcttcctagcagtgcacgcgacctccaatcaagacccaccgtgcgcacgggccctccaccaccaccaaactaccataagcgaccaaacctgatccgcaacgccttctaccgccataatcgtgatcgtttcggcgtcaagttcgggtctttcgagggatttccgggaggggtcaccgacccgcacggtggccccgcagatgagtgcgacagcgcggtggccgcaacggcggaaccaggagaggacaatgaggtcgaggaggttgccgaggtggagggattcctcggtggggtcgaagccgcaataaaccttgaagggtggcggtgtcaggcacgtgctgtggagtcattcactgtggtgacaaaggcaaaggcaaaggcaaattgtccctcttttgagacaaggaacttgccatctttgtcaatccaattcattagagaaccatttattaccccgggtgagacacttccaaaatattga

SEQ ID NO: 17116 - DNA, 195 bp, Glycine max
  Peptide Sequence Number=SeqID_108801
atgaagagtaagattagatttctcaaattaagactaagattagattacataagatttccaaaaataatggttagaactagaggtcttggtcgggctttaggccgaacaataggaaaagtgttggggaggagagacgagagtgatgatgatgccccccaacggcgaaggcttactacatcagcctgtagacagtga

SEQ ID NO: 17117 - DNA, 318 bp, Glycine max
  Peptide Sequence Number=SeqID_108802
atgtcctgcttctttgagttccaagagaacatgtgtgagcctaaggaaaaaacatattcaatagtgctcttcatgtcatcaaggtttaaaccagattctaaattgagtttcaagtacttaagtgctctctttgctactacaaaatgtaacacacttagacttttcataaatgttgagagtaagctggctgcatacatactagggaaagcatcgggtggaggagttataccaattagtgcagttcttgcagacaaagatgtgatgctttgtatacaaccgggacagcatggaaggtttcattttattataaatttataa

SEQ ID NO: 17118 - DNA, 210 bp, Glycine max
  Peptide Sequence Number=SeqID_108803
atgactgttgcaaacagtattaagacaactctccctaaaatcgaaagtgctaaaaggaaatcaagacatttccaaaaggattacctaaagtgcaagtcttggttcaaaaagaaaagtgagcttaatgctcatagattccttacaatccaaaccataaactcaaatgagaagtttgtcttcatggggaataaagtgaaagcttcagtgtaa

SEQ ID NO: 17119 - DNA, 354 bp, Glycine max
  Peptide Sequence Number=SeqID_108804
atggatgaaaaccctcgatcattaaaaagaccaatacatatgctaacaagtttctttgaggattggaagcggactagtaaattgttattgaacttgatgagattgaccgtggctacaaatgttaagccatgtatgcccaaaagaggtaatgtattgaagttcataaaattggccagggattattcacattctaacattactgacaaggcactgtgggatacctatcaagacaaggacaatgaccaattgaaggttaaaaaggaaggagtccgcaaagagaagaaatactacttttgcaagccgaatggtgactttaagaaggtttgtctaaaaagaaagaaatggattgaatag

SEQ ID NO: 17120 - DNA, 966 bp, Glycine max
  Peptide Sequence Number=SeqID_108805
atgctggaaatcccatcacatgcaaggaaatatctaaaagaatgtgagaatcactggacaattttatggaagaatgcacctcctctgcaatgggacgttgttacgctcgaccgcgacattaaagataaaagtatcgtccggccatggtacaagtttctcaaggaaaacgatttccatcacggagatgaggtgtcttcttttccaatcttcatcccaagtctttttgatttcctttttatttttccatttctctttctcccgtggcaaaaggctcctttctctttctctctcactcactttctttctctgtacaagttggaagctttctctctctcaaagcagcaaggtcctccaccaccaccacctccaatctccgtctttcacacagagagagatactgtgtgtttgaacaagttttgggcttttggtggtaatgtggtggctatggataaggactcatgtggagtggggttcatggcggaattgtccgacgaaagtagccgcaaaacggtgattgatgttttggagatgctggtgcgcatggacccatcggacatcgctattaggcttttggagccactcaaggcggagttccctattttgagctacgccgatttctacccgttggctagcgttgttgccgttgaggtcacgggtggacctgaagttccattccaccctagaagagagttggctggcgttgttgacgttgaggtcacgggtggacttgaagttccattccaccctcgaagagagttggctggcgttattgccattgaggtcacgggcggacctcaagttccattccaccctggaagagagtcaacccgaataggaaatcaactcaacataacaacaatgggagaagttagatgtttcctttctcaaatactagcactttggaggcttaacaacagctatgctctcgactttgtagttgatagatacacatgcaacatttgttaa

SEQ ID NO: 17121 - DNA, 1035 bp, Glycine max
  Peptide Sequence Number=SeqID_108806
atgagagaacttggtacttatagtgtggagaggaagttgcgggtccttgttgatagaggttgttacggtgacgtaacagccctggcagataattatcggcttgtagataaaagccaggccctaaggatgactctgttggctgcctctctatctgactgttggtctggggatgttcaacaaagctttgaattaggtgccattgttggtgataatggtgtacgtgaggccatacttccatatgacgtgtttctaggtgaacttctctacctcattagctgtgatttctcaaagtggtcttgcctcgatccacttggtgaagtagccaatgacgactatgtctatgctgggagtttggagtgtctcctggatgatagtcttgaagtgttcgatctttttggtgttgcccaacttagaaagcaagtttgctttggtgttgctctccctagcactgtttccttggtctggtatctgttggcaacctgcccttggacaagctttgaagttgagcttgagggcttgctctatagtgacattattaggtccttcgaggatgattcctaccccgctccctttcacgttggacacaccgtcaacatagaggctccaccagtctcaagtgatcaaactctaaaggttctacggaccatgccaccatcctccctgctagttcatgcttcgcaaaacctgtttgatggggtagttcgtcttgactaccacttgatgactctagaaatagggcctgagacgtcaggccgagtgcttcttggtgtcatggggtatacggatggtgaagtagatagagagctagtgcttcccttcctcttgactggcgatgtggcaatggtcttcttgaaggctaagaaggcttgttcgtctatgcatctccaatatggttgtgcatttgtcgaggatggcttctattccctaatgtgtgatcatgaagcccaggaacttgcctctgttgaccttgaaagtacattttttcgggttgaggcgcatgtcctatttgcggagctcttcgaagacctcttctag

SEQ ID NO: 17122 - DNA, 2700 bp, Glycine max
  Peptide Sequence Number=SeqID_108807
atggatgtgaccaaagtaggctccacgatctcgcatgttggattgggatttccctttgttaagaggacaaaaggacgaacctgcaaaataaaggactctgatgctccagtaaggctagacgtttgtgcttctgtgccagggatgagatggagggttgattgtgtattggagtgccacgtagcttaccatgtattgtctagtgttgagggtagtagccttgacaagtctgtgaggcttatcaagcccccccagcctggacaagtgttgtatgggttgctgttgttaagttgtccaggggggcatgcttttggttttctagacgaagtcaggcatgtcaggcgagtgcagtgcacgcgcgttgctcttgcatacgtgtcacctatggagtgggcacgtactagagatgtggtcatcccaatcggtggttcctcctcaaagaagacatgccatggagcctctgatagcgagtcctcttcctcagagaggttgacggcttcacgtcgtgttggtggaggcacctttcgcttatgtatgagggcacaaccttctattgcttctatggacgaggaacccgttccagtcaccacgattctccttttttctgtttctgggggagcaagaaggaatggtgacgaggatattagggcttcccccatgtgcatcgtagccacagtgttgggtcgccttcatcctctcttgtcgtcgttggctatgagtggtgtcgccgctctgcatcgccaggtgaaattggccaatccggagggtacctacaagatagtcgtccaggcttgcgggagtgacgattttccctttttaagggtagtgtcggcacttgaatgtaacccctctcaacttcaccccaatagttgggctatgtcagaccctactaggttcaagtcgtttgaagaggatctattgaccctggtgaagagggttgacaaggttatcttagtgcaactttcaggctcactagatatgcggggcattctgtctcttccttttgctagtgtgatgaccacaagcgctctagaaattccacgtccttctttttcaactccaccggttcccccctcggctgtgttggcatcagggtctccttcttcctcttcccaccccaatgtctccttagataaaatctacagttctcgtgatgtcgattcactatggggtcttcctccaaagaagtctggcgattttggaggaaaatggacaacaacactaggaagctctgaggccactactcaaaatgtttggagagtggagcatcctaaggtggccaatgccattgtagccttagttgaggtcgtgagttcaaaccatcgactattattcaaggttggtaatgttcttgtcaagctgctgcgcaccagattggatggtgatgagttgcttaggcgctgcaagggcttgcaaagggagaaaaatgacttgacagacaaagtggagagcactgcgatagagaaggatgagcttgccaaggtggttgctgacctccaggcccaattgaaggagtcagagtccaggctggaggagtttgagttgagggcatcaaaagagagggaggccagcaaaaagcttgaagaagagttgttggtgtataagaaagaggttatggagaagcatgaaaagggctttcataaggccgttaggcaggacgtgaaggatgatgttctgcttgaggaaagagagatagttgttgaggaggaggatgccggcgaggaacagggcattgggatgacacgagataatctcgtgtttgatttcgacctgcttaaaggtcttgtcactcatcttggtgatgcttcctttttctttgcaaagcttttccctttatgcttgagtgatcttaccaagggtgtgccttatatttttttaagagtgtgtaccaaaggtgcaccttgggtttcttgcattcctatagagataaaatttaagaatatgaaagcttgtgaaggggacgcattcgtgttgggttttggagaggcgaaccttgggtttgtccagcctttggagaagcgagactcaccaagggtgtaccttgggtttgacaagcctttagagaagcgagactcaccaagggtggaccttgggttttatgagcctttggagaagcgagactcatcaagggaaaaccttggggcagaccttgggtttgatgagcctttggagaaacaagactcacaaagggccgaccttgggtttgacgagcatgcgaagatgcgaccaggaatgccttcgtcctgggcttgctatgaccctgaatgggccttcccagttgggaccaagctttcctgctcggggatcttttctggcttcaccttggactcgccatacaagggctttaaggatgactctgttggttgcctccgcttgaccgttggtctaggggtgtttgatagagtttacaaggccatacttgcatatgaggtgttttcaggtgaacttctctacctcgatggctggaatttctttatttccatcccctatatggcgaaaggccaaggggaaatcatgctatggatgttgtcggggggggtcacccagtctggccttctcctcctttcctgccatgacctccttggtgtctatggttggtgcttggaaggtctcctggatgatggtcttgaggtgttcagtcttcttagtgcttgccaacttggagagcaagtctacccttgtgttttttcccttagtatgtga

SEQ ID NO: 17123 - DNA, 276 bp, Glycine max
  Peptide Sequence Number=SeqID_108808
atgttagtattcaatagtgctttgaaaggacttgacaatactcaacaaagtaaatccaagtctcctgctaggtggattgttgttaaatatttcactgatcctagaccattggaaccagaaagattgaagacgcttcgcaaccagtgggcaaagatcgaacaggatataaaaactattttgctaattttagaggctttggcacctttagacctctctggatggattgctagtgtaggagctcccatctacactacagagcaaatagtcactccgtga

SEQ ID NO: 17124 - DNA, 658 bp, Glycine max
  Peptide Sequence Number=SeqID_108809
atgactacaccacccaggcctcctcctcctcctactgatgcagcatcacattcccctcataccttgaagcggatagagagacccctggtccatgtgcatcctacgacttggaaagccgacgattcccacagaaagaagttaagaacatattttgggattatcgttcgtgataaggtggatgtgacatacgagaattggaaacaagtccctactgcgcaaaagaatttgatatgggaggatattaagtacgacattagcaaagagaagtggactcaattttgtcaaagtcacagagacccttcgtgggaggcacatgccattcagaaacaaaacactgcctctcatgtgttgtctcgtgtgggttttaagtttcttgaaaaaaagttgatggatgaaaagaaaaagaaacaaatggaggaagctgctcaatctggaagcactgacaccgtgattgatccttcatctcccattagacgacacaagaagtggaagatggctcgcaccaagaaaactaggcaaatgacgtatgaggcagcaaaggaaattgctaacaagattggactcgcactgcctcttgagccaaaggttggtccttcagctggtcgtgtcagcacaaaggagagttgtgttgatccctcagggaacaactcagacacgg

SEQ ID NO: 17125 - DNA, 663 bp, Glycine max
  Peptide Sequence Number=SeqID_108810
atggccggttacatttcactacttcagtgctggatttacgagcactttctgtcggtccatcgatgtgtcattgatacttatgctgaggctagcccacgtgcctgtaggtggcttacgggtaaggcccagatgacagggattaagggagccccgtaccgagcacgtattgatgccctgacagtgaccaacgtatgttggatgccgtatgctgagcatcggggagttcggggctatgagctcctcgtacacggggcaagtactgatatagacgaccggtgggtacacttttcagatcatctggtgcctacaggggagctctatgtagttcctgggcaggtggccccagactacatggagtggttttttcagattttgtacccttttgtgacgccgacggaggagattgctgagccgagacctgcgcctccccctccccctcatgatgatgacttcgtcgagccacctatccccgaggttctagtcgtgtcggatctccctaagcattctgtggttgattgcacaggatgtgtaaggattgttgagcatttggagcaggtcatcaatctcaggatggtcactgaagggactgacttatatgatatcatggatctttgtctgaggatagctagagtatttctttttgtatttgttaaaacacattga

SEQ ID NO: 17126 - DNA, 816 bp, Glycine max
  Peptide Sequence Number=SeqID_108811
atggacaagtcggaagaacgttcttccgcgcctgttgcatcggtccatttccttcccgcggaagaaccttcttccgctgccatccgtggaagaaccttcttccacgagcccactacctcagcacgtaggcaacgggttcctgtgcctgaggacgttacccagagagtcgaggatgttcctcaattgcctggggatgtacctcatgtgtctgatggttggccagagatgacaggcgtcgccgatggtgttgagacagatcgagtggctagtgatgggagcttaggggcacctgctgatcatgaggggttccccggtgggccacgctacccatttgttttgataggatttgctgatcatgtggcacacagcatatggagtggacaggaactacccgatctcaagttggtctcccatggtaggaaagtagataaatttgggagaccggctgctgagatcgaaggtatgattgcggccaccggattggatccactgatcaggtgttctgtaatcaccactgatcctggacttatattcgcctttgttgagaggtggcatagggagacgagtagcttccacctcccagtaggagagctgatgatcactctagacgacgtttcgtcactcctgcacattccaattactagtgcgctgcattcattcgagtcgttggttacatctgacgtagtggccctgttgacggagctacttaaggtcaacccagacgaggctatagctgagacacgtcaggcaggtgggcctcatgttcggttgtcctggcttcgggacatgtaccagagtaggtgccaggccaggtag

SEQ ID NO: 17127 - DNA, 827 bp, Glycine max
  Peptide Sequence Number=SeqID_108812
atgaaacagctcatctactacaatatgatcccttccctcacaacgcctttccttccccatgctgccacaacaacctcctccacctctagtggcgcatcttcattgtctccattgagccaaaacccgccatcaatagagaaaattcgaggcttttccttcgagtggagtcgtcaacgaaggttttgggttttggtcgagaaaggtgttggctttgaccttgaggcacatatgtttatggtgcttttcaagctcactaactttgaaacctcttattcgcatccctctcacttgaacgctttcacactctcatttgcaacttcttgcgacactaaaacttcgtcaccatcggcattgcaacctcttgtagtgctgcaacaccatgtcggtgtcactcatgacgctgcaacctcactgtcactctcgaggttctgcaacctcagtgttggtgacaaaagtgtcactcacgatgttgcagcctcactgtcactcccgtggttctacaacctcaatgttggtgacaaaaggacccgaatcatttcatttcttctcatccttcgtgttactctcacaggatgcaatataaaagaagggagagggaaagtttacgaaaagaaaagggaaatgaaagcagtggccaatgctgcgaagtgtggtagagcttgtatcgccattggcagtagcgggacgaaggcggtatcgccagtagcaccagcgagacagctacataggcttttggcttcacacagcagcttagggcactatttgcaggctagggcatggcatgctgagggttcacatggatacagtttcatattcacatgcgccct

SEQ ID NO: 17128 - DNA, 1086 bp, Glycine max
  Peptide Sequence Number=SeqID_108813
atgggtgatggaacaggtagggagaagggacagaggttcacgaaatatatcagggaactagttgatgatggaagtgattacaggaggggtaggctggtcgaggggggtgaatgtgtgtccttggacaaaaatgggtacctgcgaagaagaggtgtcacaatccaatatgctactgttgcccaccattacttggagcttggtcatctgggatgtcggcagattcagaaacctagccatacgcgactagataaaattatgagtactgttgtagtcgatgaggatcacgacacgatgatgacgaataaagccatacattctaaaggtttttggtgtcgacatccctgccgacgcgttaaggctaatctgaggtggagaattagggtcgtctgtggtagctgggttgttgggcataaatgggttggaggagtaaccgtggcacaacttgcatctgtgatcgaggatccatttctcgtcacaatgatagcaggggcctttgtctcatccagaggtgttggagggtcccactatgtttggttgtgggcaaaatcagggaaggaacagtgtgacggagcagggactgctgcatcgatcattgagcttgtcttcctggagtttggcccaggcagccgcttggggcagagaataatgattgaagagcctgaacctcccaaagtaaggcaccttgaggattttcgtagaatgaaggagcaaagcaggactctaaggcctggagcattgtcgaccacaatgtacaccttgataatcaaagaattgggaaattttaaagatccatcccattggatcttggccgtcaaatcgaggaacttcgagctttatgtgaggccgagactgtcagatcggatttggtgtttgtggagattttggggatgtgggggtggtggtgatgggtgcgaagaggttagtggtggtttttctgttgttttggttgggcatggtggttggggagtaaaagtagaggcagtccttgaggtggttaggcctcttagtgatccttatgggtctgctagtggatatcgtggtgttgaagttgctatcaacttctctttatacactttctttctctag

SEQ ID NO: 17129 - DNA, 312 bp, Glycine max
  Peptide Sequence Number=SeqID_108814
atgactgacttaaaatctacctttcaccctgctcttgctgtatccaacatcaagaatcatgtcccaatcattcttgagatggaaaatgtccaatacgcgacatgggctgaacttttcaaaattcacgcacgatcccatagggtaattgatcatataattcctccgcaggatggcaagcagaagacaccaccaacggaggaggagacagaactctggttgacactagacgccaccattctacaatggatttatgccaccatttctcatgatcttttacatactattcttgaacccgataccacggcaatggag

SEQ ID NO: 17130 - DNA, 234 bp, Glycine max
  Peptide Sequence Number=SeqID_108815
atgctgcaatgcgaaggattttcctctaagctcagatatgattttgaatttcccaacggtgagaatgttcgaaattgggttgtgaacgtgatactcaaatttcacgacgatccaacggtgaacgagtatgagatcgtcgtttttctgagacaggtttggtgggctgcgggaaaaagaaagggtgttgagaggagaaggggaaaaacgaaaatgaggccaaaaagaggcacctga

SEQ ID NO: 17131 - DNA, 144 bp, Glycine max
  Peptide Sequence Number=SeqID_108816
atgtggaccaccacgggggaggagcttgccacccagctcgcccaggcgagcaaggttgcttcctccagaagcaacaaccttctggaggaaggatctagaaggcccaagtgggccagattgctatttgtaccccctttttactaa

SEQ ID NO: 17132 - DNA, 441 bp, Glycine max
  Peptide Sequence Number=SeqID_108817
atgaacaacaatgtggctgatgcattgttagttccggttacttgtagtcaagatgttctagacttgatgagaattggtcagaagaaccgtgttgtaggtgctacaggtctaaatgaaagaagcactcgttgtcatagtgttttgactgttcatgttagaggaagggggttagtttccaactccattgttaaaggttgtgttgatgttgtggatttggctgaattggaccaatgtatttttgtttctaactgtggagctaactcagtgactgagagtgtttgtggtggggttcctatgatctgcaggccattctttggtgatcaaggggtggttggaagattgatagaagatgtttgggagattggggtggtaatggaaggaaaggtgttcacaaaaaatggattgcttaaaagcttgaaggacaagcagcacaggatttga

SEQ ID NO: 17133 - DNA, 297 bp, Glycine max
  Peptide Sequence Number=SeqID_108818
atgaaagggtgcctcacaacatacttgaggactccttatatagccaaaaatctaagaccggtagttgtcggtagttttgaccgggactatttgactgtttgttacaagacaagtagttttgaccgggactttaatggctacaggacagacggttttgtgaccgaatttaaatttaatctaaacagataccaaaacaatcatcttcgttttggtaaaaggggtcttcttcttcttcttcagcagaacttgtttcttccttctttgaggatgaaccttcttcttcctactgtaacataa

SEQ ID NO: 17134 - DNA, 741 bp, Glycine max
  Peptide Sequence Number=SeqID_108819
atggttactagacagattctgaaaccgaacgttattgggcctggggttaacatcttggctgggtggtccgaagctattgggcccttcgggttgtccgatgacacacggaaaacccagtttaacattatgtcaggtacgtcaatgtcttgtccacacataagtgggttggttgcattgttaaaagcagcacatccaggatggagccccagtgcgataaaatcagcactcatgaccactgcctatgtacacgacaacaccaagttcccactccgtgacgcggcggggggtgcattttccaacccatgggctcacggtgcatgccacatgaacccacacaaagcactttctcctgggcttgtctacgatgccacagcatgggactacgttaagttcctatgttcctttggaaagttctctgaccctggccaattgaattacccttccttctcgatcctctttggtggtaagagggttgtgagatacacgcgcgtcttgatcaatgtgggtgaaacgggctcgatctataatgtcaccgtggatgcaccatccacgatgacaataaagatcaagcctaccagacttgtatttgaaaaagtaggggaaaggcaaaggtacacggtaacctttgtgtccaagagaggtgtgggggattccactaggtatggttttggaagcattatgtggagcaatgcgcaacaccaagttaggagcccagttgctttttcttggactttgttgtga

SEQ ID NO: 17135 - DNA, 159 bp, Glycine max
  Peptide Sequence Number=SeqID_108820
atgcaatgtggtactatgttagtgaaaaatcttgtcaggcgcctaggagtacatgacaagacagaccacacactgggagaccaatcaggatcactctgttttgagagaatgctccaaccatatgggatcggcataggcttcaaggaacattcaaactga

SEQ ID NO: 17136 - DNA, 807 bp, Glycine max
  Peptide Sequence Number=SeqID_108821
atgactaaatcatcgaaaaagcgaaagggcacatccacctccattgtcgctgttggccatcgacgccacggaacatctggagcacccacagcaccagtctctccttccttgtcatctctacgatcatctactctgttctctttagatgatcaatgtctacgtcaaggtgtaccttttgaggacactattgttgatgactggaagtttgattattttagccatgatgcccgccgaatggtctgcaatgaccaggcgaatatgaccagcagattgcttgctaggtcattgacatttgactgtcacatcatgcattatataattgtccgcattttgctaccttgttcttctaacccggctcaagccttcgaggaggacttgattttgatgtaccgaatgcataaggcattatggaccaatgcacatcttccatatcctcagttggtcaccctttttcttcgtcactttcaaattcctcttgatgatgaatcttttgttcaagtcaagagatcttttgtcattgatgctggtgcagtaacttcatttggttaccgcaaggatcataatggacaatggcttaggaaacaggacttatcacatgagcgtattccgtcacctccatcacagcaagatgtttcctctgctttcatgaatgacgttctttctgaactccgtgggcttcgagcattcgttggtgattgtttcgatgtcatggatgcacgttttacaggaatggacacctgtatcactcgacttgaagacgatatgggtttcattcgccattgttttgatcccccggctgatccatag

SEQ ID NO: 17137 - DNA, 375 bp, Glycine max
  Peptide Sequence Number=SeqID_108822
atgaatgcaaagagaagagaaggtatagttggcgtgctggtgcttctaaagaaaagaatattgatgcggcatgagaagttagggaaccaaaatacggtggcgtataccgccgcactcaaccatgacattcagccaacaacgcaaggcatggtccaggccctccgcgctggcgagcaccttcactgtgtgatggaggatcatcggcatgagggaagagtcgcgagttcgagaacgaggtttcaaaaactttcaggtggaagagaagataaagcgcctatggcgatgaagagggtgaacataaatgagagaaagggtagcaccgacattttgcaagccacctcatgccataaagaagggaaaatgaataaacgatag

SEQ ID NO: 17138 - DNA, 231 bp, Glycine max
  Peptide Sequence Number=SeqID_108823
atgatgacaaaggtgatgacaaaaagctcaaagatcaatcaaagaacaactcaagtgaatcaagaaaaatcaagagttcaagataagaatcaagaagaattcaagactcaagaagaaagtttagagtcaagaatgaagattcaaggttcaagatctcaagaatcaagatcaagattcaagactcaagattcaagaatcaagagaaggcttaatcaagataagtatgaaaag

SEQ ID NO: 17139 - DNA, 348 bp, Glycine max
  Peptide Sequence Number=SeqID_108824
atggacgaagatcaatggatgcatgatggtataatgtctgaagaagttgatatggatgatgaaaataaagaagaatgtgatgtgaatgaacaatatgttaattgttcgaatgcgttcaatacttctcagtgggctcgatcagttgctcatgaaaacggatatgtggcagtgattatgaggtcagacacaaacactggtattagaggaaagacttcatttgtgttaattggttgtgaaagtagtgatcagtataggtctaggaaaaaagattttgttagaagagatactgggagtaggaaatgtgagtgtcccttcaagcttcatgggaaaccagtggttggagggtaa

SEQ ID NO: 17140 - DNA, 504 bp, Glycine max
  Peptide Sequence Number=SeqID_108825
atgcacattgttcatgggattaacattagcaaatttacatgcaatcatgacgtgagaacacgaattacagggtttagggttgtgcgagatttcgaaggtggcttgatcgtgagcgctcttgaaggagaattccttgccggagcaaatcttgttgaggatgttccgatacttcttcttcagccttcggatcttctccacgagttgattcttgttgaaatcgagttggagtttcgacttgatttggtcatagaacaaagcggtgtcgttgtggtgcgaggatcctcgctgcgatatgtagtcgaggaacccttgcaagagctcgatctcctcgtcgtcggtccacagccgctgaaacagtcgccgcgagtcatccagcggcaacgacggcgactttttctccgcaagtcatcgagctcaacttgcattttgtcgaacttcactatctctgctgcacctcgaggtctatgcccagcggtgggtaccggaggagtatttacaaactaa

SEQ ID NO: 17141 - DNA, 2412 bp, Glycine max
  Peptide Sequence Number=SeqID_108826
atggcttcaggcatttccattccacctgatcttctcttcaccataaaaaggagctattttgattcccctctgtcctcaaggcttttgcctaaccagccacagcactttggatggaactaccttcagatgggtttgggaagaaaaatagaccctgagccaggtaggtgtagaagaactgatggcaagaaatggagatgctccaaagaagcatacccagattcaaagtactgtgagaggcacatgcacagagggaagaatcgttcaagaaagcctgtggaagttttaaaatcaacaacaacaccatcatcatcaacaacaaactcaaatgcttcttctacacaacaagcaatctcatcaatcaccaaaattaatagcactctctcacctcttgcatcatctgagactcaccaacaccaccactatcctcaacactatggctcctttctctatcatcatcaccctccttcaaggtcctctggcattggcttgtcttttgaagacaacagtgctcccttgtttcttgacactggctcatgctctcagtccaacacagactgcaggagtaggtatgtttatggagagaaagaggaggtggatgagcatgctttcttcacagaaccttgtggtgttatgaaaagcttctctgcttcctctatggatgactcatggcaactcacaccattgactatgagctcctcatcttcatcttccaagcagaggagttcctttggcttgtccagtgattactcttgcttgcaacttcagagccactcaaagcagcagcagcaagagcatcatcaagatcagggttgctacatgtttggtgctggtcaagttgtgaaagaagaacctcagaaaacggttcatcgcttctttgatgaatggccacacaaaggaagagaaggctcttggcttgatttggatgacaaatcttccacaacccaactttcaatttccatccccacatcttctcatgatttttcaactttcagttccagaacccaccatgagttttgtcttactggacttgactgcctttgtaataatggttcgtcatcatcagattccgataatgcttgccttcgtcgggctatgcttgaggaagggagagccagtgttagagatggaggaagcacaaatttggctaagaaggtggagctgccagcgttcacaaggacagacccaattggttggattgttagggctgaaaaattctctaaggtacaagaaattccttcattccataagctgcaatatgcattcatgagcatggagggtgctgcgacacattggttctacatttggagaaaaaaaaccccaaattcagattgggggtcattttccacaactttgatcaaaagatttggagatttctatggtaacccacatcaaaaaaagggagatttttccacaaagttcttgaaagagaggaccaacacttcaaagctgaaacacaggttgcgcaagatattgaatgaagttgattcccgtgcctctcaacaaggcaaaaatagcatggagggaaatgcatcagaatgcagtgatgcaaaggctagttcttggacaagaaaggtggaactacccagatttgacagaagcatagaagggggaactgatttaaagggtagcagttttgattgtgacagtgacccattgcagttcttgaaatcagaaaacagaagcaaagaaggttcggtaatcaagtaccacaccctttgtcgtggagaagaaaccaaaaatgatgaagcaaaattggcaagagaaaaaaagattgaaaagataattcttgataaaccaataacagatttgatcaagaagtcgaaactgatgatgcaaccaagcctcattgttttcaagattcagatttccataaaaaagattgttatgatgaaacaaaaatcattcatgaagctcaaaaatggagccaaggcagaagggaggtacagagacagtcatgatgattcaattgatcccccatggagggacaccaaagaggcacatcttgttagtgtaaatgattcagttctgaaggatgagaaagaggaaggggaagttttggaattctaccaagtatgctcaactttttacataatggcctttggcaggaaagcaccacaatgctatcataaaaggcagatgaagatcatggtgatgaagatgaggcaagggatccagcttccacaattccaaccagaaacttgtagtttaaactggatggcaggatttatatcgctaaacttggatgcaggtgtagctaatgacatgattatagagaaggggtggaaagagattgttgcatcacccatggaggtcaagattaatcagaatttgctttcatccctacctccaccagagccaccaaactcaacccgcgtgcaaggtagtgggtcattcccagctgagctacaatga

SEQ ID NO: 17142 - DNA, 2094 bp, Glycine max
  Peptide Sequence Number=SeqID_108827
atggctggagtgacaaaggaggacgagtcgggtagtcctagttggggtgcttcattttttacacagacaacagaggatgtggctagagctgttgctgctgcaatgaattctccgaggccatctgtggtatattcatcgaaaaatgatcatggtggaagccaacttcaaaagctacagtatcaagttacgaaaatgataaaaggattttctcgccctacagaagttaaatatacaaattacaatccagaaatcttgacaactcagaagcgtcaatgggctgcaaactttcagttacagtacatggaccataaatcttggaaggagccgacaaggctgtttgaaagcatggtggttgttggacttcatcctaattgtgatattcaggcactgcaaaggcaatattttttaagaaagtctgaaggccctggtaaattgagaagtgcacttggttatcagaatcaatcccgtgtggaagcggaacccaatttagaacctcaggttttatttgtttaccctccagaaaaacagatgcctcttaaagacaaggatcttctctctttctgcttccctggaggcttggaggttaatgctgttgagagaaccccttccatgagtgagttgaatgaaattctatttgggcaggaacaccttaaacaaagggatctgtcttttgtatttaggctacagggtgctgataattcaacactttacgggtgctgtgtcttagttgaagagttagtgcaaaaaccctctggatttctctccttgatttctgataagcaggcgacttattctcctttgaaacgccaacgccatatattaaccacacagagatgttactgcattctctcaaggctcccattttttgaattgcactttggtgtattgaatagcatcttcatgcaagaacggctagagcggttgacgagaattggtggagatttaaatttagaatatgctgaagatagctgcgaggaagaaaatttggaggaaaaatctgagtgcatgttggtgaatgatagattagaagatagacatgatgacaatccaatgatttctcaatcaagcctaagaaattcctcacctgaaaacattgagaatgatagtaattatcccaagaaacaaatggttaacggggatctgcatacctttaaggagagagtcaatgatgacaatgctgtgcctagtgatcctgaaactgatagaaaaactgtcagagaagaatctggccctaccaatgctgaagaaagcgatttgtatggagatgcttttgtaacaaacaaacagtctgaagataggcgtttaccaaatgccattctaccactcctgcgctattgccagtatgaaagctctgaatcttcttgcagttttcagggttctccttgtgatgacagaaattttaggagtgatgctgatgatactgagacagaagatgcttcattctctggccaagaggatttaaatgacctacaggatattcttgaatgggcgaaggcaaataactgtggaccattacagattataagtgagtattatcgcttaacttgccctgcaaggggctcagcacttaggtttcatcctttggaacacctgcatcccttggaatatcacagaccagatgagacaattctacatcttgctggttcaactgttgacttgaaatcttgcagtacgggtctggaatttgcagaggcacataattctcttttggctgaggaggaggcaactgcattatctatatgggctgtagcttgcatgtgtggtaccttgaggcttgaaaatgtgttggcattctttgctggagctctactggagaagcagattgtttttgtctgttctaatttgaaactaaaggtggttcgctggagatgcgtcacacgccagggccctgcgtgggttcatgtgcagcagtgttttgagttggctgtgcacgtatacggcatggcagtcttcaacggtgatgatgggcattgttcacctatgaaaaagacagaaatgtctaccagagatgcctttttggtggagggagagaagaccagtgtgacgctggctggagatgcgtcatgcgtcgtgtgcgtgaacttcacacgctag

SEQ ID NO: 17143 - DNA, 492 bp, Glycine max
  Peptide Sequence Number=SeqID_108828
atgggcccttgcagccgatcaggacggtgtcgaggacactgcacaggccatccagaagcagaatattgccccccacgtttttctcgtgggggctatgattatttggagcagaagctcctggctgagaagacgaagaagaagctggaggaagctggacaatcaggaagcgttgatggcgtcatcgaccctccatccccggtcagacgccacgtgaagtggaagatggtccgcacgaagaaaacaggggagatgacgactgaggccgcaaaggaaatcgctgagaagattgattcctttgaggagcaggccatacagggatccttcgtcccccatggacgtcagaatgttctcgccgctgctattggacgtccagagcaccctggacgtgtccctactgctggagccggtgtcaccatcaagaaatactttggatcgactccacagacatctcgcagctcttcctccctcctcctgatgaattgcagcaactga

SEQ ID NO: 17144 - DNA, 540 bp, Glycine max
  Peptide Sequence Number=SeqID_108829
atgaactttttccgcatttggaactttttgagattttccaagggtttttgcgagttggccaacgaaggaagtaatactgagaccttacctcctgtagagctacttatgttcgagttaaaacgtgttgaaatttcacaactcacgtgctcgaaaaccctgctgcactctctcttctctttctcctcccacttaaaatctgccggaaaccactcggtcgacacccacattgccccacattcatttcaatactgtcggaaaccgcttgctggaacccacagaacctcctatcgaagaaaagtcgaagaaaaccctacactgctgttggaactgtgggtcgaagaaaaccctacactgctcttggaacagtcgtgggtgctcaaagctcaaagctttctacgctgccagttaacaaggtatgagctctaccttagtatgttgctcttcttattgattgtgctttacgtggttttcaagcttcacgagagttacacaccgaacaaagtttccatccgtgctggtgatggttttcacaacttgaag

SEQ ID NO: 17145 - DNA, 378 bp, Glycine max
  Peptide Sequence Number=SeqID_108830
atggttaagtttgggtctttgcctaggggaagtaacccatcttctatcacacttatacctaagaggtttaagagtgtgttgcgtgcggttattgatgggagacaaggggtgttcctatggaggagtatgcttgatggggtgatcattgctaatgaggtggtcgaagaagtgatccgtaaaaaaagcaacttcccgatagcggtttttgccatcattggcaacaatggtggaaaaaataaaacgcgaagaagaaacttacctcgaagaagaagcagaaacgcgaagaagaagcagacccacaccttcctcctaatcacgacaacaatggcgacaatggcttgggaggttcacttgggaggcgaagaagaagaagaatga

SEQ ID NO: 17146 - DNA, 2235 bp, Glycine max
  Peptide Sequence Number=SeqID_108831
atggaagaagacaaaggcgtggcagacaagaaagtgacaaagaacgaggtgttactacgaatttcagactctgaagaagccatgcatgctgagaaggatcaaagagagtctagaagttccctagaagctgaaagcagttccctttctcctcagcacagcacccacataggtaaagggtttacagattctcatggtgaactcacagagcttgagaatctaagaaacaaaggtcaagtttccacagagttggtgacaactacaaagaggttgatgggtcgatcggaattttcgaggccaaagtccagaatggtggagccaccatgtccaaaagatgcaaactttgttgaagaacaggctcaaatgacaagttccaattcatctgcatggaattctcccaacaagaatgctcctgaagcaactattgttaccccaagaacccccttgcctgggactcctggggaggaagaagatgatgatgaagaagtgtacaagactgcacatgttgaaatgaggaagagatctggtaagaagtgtagagtattgggttttgttgagtggtatgcttttgtttgcataatggggtttttaattgcaagcttgacagttcataagttgcaacatagggaaatctggggtttggaactgtggaaatggtgtgtgttggtgtcggttatactatgtggtagactggtcactgagtggtttatcaatgttctggtcttcttgattgagaggaacttcttgtttaagaagaaggtcttgtattttgtttatggtgtgcagaagagtgttcagggctttatatggctaagtttggttctcttgacatgggttctgcttttccaccacggagtggagagaacccgaaatgttagtaggattcttaattacataacaagggcatttgtttcttgtcttattggagcagctatatggttagccaaaacattgttcataaagctgttagcttcaaattttcaatctactagattttttgatagggttcaagaatcaatctttcatcaatatattctgaggacactttcgggtcttcccttgatgaacatgtctgcaaaagtaggcaagacttcaagtagtggtcaactcagttttaagaccatgattaatgagaatgaagggaaggaagaacaagtcattgatgtagacaagctcaagaaaatgaaacaagagaaagtttctgcttggactatgaaagggttgattgatgtgataaggagttctgggttgtctaccatctcctatacaccagagagtgccgatgaagatgagagtgatcagaaagataatgaaattactagtgagtgggaggcaaaggcagctgcttatagaattttcaggaatgttgccaagccaggaaacaagtatattgagaaggatgacctcttgcgattcatgaaaaatgaaaaagtggaaaatgtgcttccactatttgaaggggcagttgagacaggaagaattaagaggaagtctctgaagaactggctggtgaaagtctaccttgaacgccgatcacttgtacattcactaaatgataccaaaactgctgttgatgacttgaatatgcttgcttctgtaattgtgcttattgtgatcactattgtgtggcttcttataatgggtttcttaaacactcaagttcttgtctttatttcatcccagcttttacttgtggtttttatgtttggcaacacagctaagactgtatttgaagctattatatttgtttttgtgatgcacccgtttgatgttggtgatcgctgtgtcattgatggtgttcagatggttgtggaagagatgaacatactaagtacaatctttttgagatatgacaatgagaagattttctatccaaattcagttctggcaaccaagccaatcagtaacttctacaggagtccagaaatgagtgattctgttgaatttgctgttgatgtttctacttctattgaaagtattggagctttaaagacgaagttaaaagcatatttggagagtaagcctcaacactggcgccccaaccacagcgtattggttaaggatattgagaataattatggggataagaacaaccgaagatctgaattagtcctggagttaaagaaaattcttgaagatcttaatattaaatatcatctgctgccccaagaagttcatctcagccatactaatggtttccctcatagtctatccagtttgagatcaaagatggtgtga

SEQ ID NO: 17147 - DNA, 271 bp, Glycine max
  Peptide Sequence Number=SeqID_108832
atggccagagaagaggaggaaccaaattggatgtccccctacaagaacttcctagttcggggggtcctaccatcaaacgaggatgaaaccatgtgcctcaaatggaaggccagctactacgccatccttgatggcgagtcgaggcatatgcgcttagcgagtaacattctccaagcaaggcatgcagctcacttagtatgttgggaaaccctagaagaggatcagtcagggatgcactcgcccaacgtgtcgccagctcgcccagcaagtc

SEQ ID NO: 17148 - DNA, 477 bp, Glycine max
  Peptide Sequence Number=SeqID_108833
atgttgggtcctcttactgagatacttgatgcaattaaaaataggataagagtttacatcaagtactcagcagaattccccaacaatggatttagccttccatcacaaggaagcaccttttacaagcaggagaaggggtttgagagcaattcacagatacacaatggggaggatgtctcctccacctctaaggaccgaaaaatcgctaaaaaacctagaatctacctaaaagctaaggtttttgctctcttgctttattctgcgcctctattctctatttttctctattctccaccaagctcttgtctcttctttcactccaggcttaaaaaggactttttgacctcgaaggcacacttagcgccatattcgcacttagcgcgagtaagtgaacatccgctgagcgagctggacgcgcttagagcaggaagagacaaatgtatcgctgagcgagctgacgatgtgttgaacgtgtag

SEQ ID NO: 17149 - DNA, 1386 bp, Glycine max
  Peptide Sequence Number=SeqID_108834
atgagtcttcattcttcatctagtgttaatggtgagggttctactcctaaggaccctttgtataagatattagatgagttgagatcccttaagttgtggaaagaaaaacaagagagaaaagaaaaaggaaggcatagggcacatcctagaccttactcccattggagagaaaaggaaagaaagcctcaagaggctaacattaacctcctatacttccatgggaaggacaatgtagaggctaacttagattgggaaataagggtaaagcaacaacttaaaaggaagtctacttcaaaatcttatggctctcactcttatccaaagaaagaccaaggtcgaggcatcttagggaatactagctccataaagtgctttaaatgtcttggaagagggcacattacttctcaatgccccaccaacaaaaccatgattatgagggggcaagacatttatagtagccaagatgagactactacttcaccttcctctagtgaaagtgaagaagcaaaacaggaagaatctattaaagagatctacccccaagaagaaggacaacttttaatggttaaggaggagtgtaagaaggcaagtgtctcctccaagaggttagctaagaaggaaagacattttgaaataaagacaaatattaaagaaatttcccctcttagacaacctccacattttctcctttgtaaaaagacacttgttagcattgccacacctcttaggcttgagtttattcctcaagtaaaggagttgttggatgagggtttggttcgcaagagcttaaatccttgtgctttgttggtgcccaaaataggtattattaggcaccaaatccctatgataggtggtatgatgaatgtgttgagtggtgcaacactctttcgtaaaatcactcatgcacccaacatcttcatgatttgtgtacatagggactcattagggcttcccatggaccctaagagaataaaggtcattcctgagtggcctactccaccaacaccactcattgagttggtgaggaactatattctctcatgggaagatggccaggaaaggggagcaaaggaatccattgatgaagaagatcctaggcctacaagctccaatggagcttacatcacaggagccatagccataggccgaggcccaaccgaagtcacacgagaggccactccacggacttcgcctgctatgacaccacttgtggaggtctccgaggagaaggatggtgctgcagacacaaattatgtagctgatatggtagaagcacatagcacttgggatccctggcccgctacagctcaagagacatctcagccagcccaggatgctccctcctcacttcaggatgagcctgcaccagcacaggaggagccatga

SEQ ID NO: 17150 - DNA, 774 bp, Glycine max
  Peptide Sequence Number=SeqID_108835
atggcctccagaaagagaaaagttaccacttccagacccagggaaccttatgatactaccaggtttacatctgagggcgtctgggagaggtacgagcagaacattcacttccggaacatccttccggaaaggaatgtggttttgtacatatcggagtatgatgagttccgcagagaacttcagaggcgctgttggcacaaggccttgactaggctgttggatgggcatattgatgtgaccctggtcaaggaattctacactaatctctatgatcgagaggacaaatctctgaggcaggttagggtgaggggaaaattagttaagttcgatgttgagtccctcaacgcatttctagagacaccaccagtcttggagcttggggagcagtacaccacctacaccagattctatcattcgcacccagaccctcaggagtttgctgccggactctgtattccagcgcacggttttgttcttaatgctgaaggggcaccttggaagctcctgaggaaggacctcaccaccctcgcccagacatgcagtgtgttatcatactccaacctcgcccccacctctcacatgtatgatcttaacatggacaaggcgagatggcccagtccaactcctctcggctcggcttcccagctctcatcatcgccttgtgcgtggccagaggagtcatatccaactcttttaccttcgagtccctgtgccctaccattaatttggcatacatcaggaagaactgctggaactcggatgatcccacgatga

SEQ ID NO: 17151 - DNA, 201 bp, Glycine max
  Peptide Sequence Number=SeqID_108836
atggggatcgttgaccgtgggggtgcatgggcttctgaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17152 - DNA, 204 bp, Glycine max
  Peptide Sequence Number=SeqID_108837
atggagtcgccaactgtcgcaacctacccctcggcggtagggcgacgtggggctcacgggtgcgtcttccataggaggaaaatgcgcggagtcgccaccaacgtttattcgaggaaaacgtcggaaaaaccggaaaaggcgtggtctacgaactttaagtgtgaaaggtttgggagttgtatttacgcacggggaaggtattag

SEQ ID NO: 17153 - DNA, 444 bp, Glycine max
  Peptide Sequence Number=SeqID_108838
gtagttgtgtctccgccaaaaccacctccgaagcccgatccggaggtcgatgatccgctttatctgatgacattaaccatcctagaacttttcttgaggccttatcaggttagatgggatgccaccgtgttcggggtcgttaatccagatttccccctgtacataaagcacgaagacctctccaaaatcgcacacgatggtcaatgtctcagcatatcagtgttacagttgtggattctgttccactgcagcggacactggaagatggtggtcatcctgcccaaggaacacttagttgtctggttttgttcattgcataataggccagacaactaccttaaggggattattaatagacaaaaaggaagtactaagtgcggctactatgtgatgcactggatgtccaccatcattttaggaacttttagaaataattgggaagcg

SEQ ID NO: 17154 - DNA, 556 bp, Glycine max
  Peptide Sequence Number=SeqID_108839
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatggataattttgtctatttggatatttttggaggtgcaagaagaacaaagaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17155 - DNA, 324 bp, Glycine max
  Peptide Sequence Number=SeqID_108840
atggtacatttggtaatccatttggcacatgaagcaagagtgggaggtcctgtacattaccgatggatgtatcctattgaaagatatctatctagggtggagactcattttaatcaatttgctcgaaatgatgactcatgttttgcggaaaatgtaagtgttttaaatcctagaggtagaccattggggagaaagaagcaagttggattcaatgtgaagaagagaaaaagagcttctcggatttctcttgataagaaagcattggttcaagcacatacatatgtgcttttcaatagcaacaatgttcaccactttccaaagtaa

SEQ ID NO: 17156 - DNA, 524 bp, Glycine max
  Peptide Sequence Number=SeqID_108841
gtaggcccgtctatccgctcaaggttactgctcgtgcgtcgaaaaaggaaaggcgaattgggaccaactcttggctagcatgggggggcgttgtaattggttccctcgctagaaggaaggaagaatcaagattctatcttcatgcgaaggatgtcaaatgtcccttgatgggaaaaaggggttgtattaattataatcccgtcctcgccataagacagcttggctaccccatgagaggagtgccatcaaacgaaagcatcacgcctttcatcgcacggggttttagtgaccacaacgcgagggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaagtctga

SEQ ID NO: 17157 - DNA, 306 bp, Glycine max
  Peptide Sequence Number=SeqID_108842
atgggttctccacctgcctccactcctcctcctcctcctcctcctacttcggacgcatcggcttcgccgtctgccatgaagcggacacgcaaagcctcacgtctacgatcgctgtccactagaccacctggttctgagagaccagtggtgcatgttgatcctgctaccaggaaggccgacggtcctcacaggaagaaattaagaacatatttagggattgtggcacgtgataaggtggacatcacctacgagaactggaaggaggtccgtactgctcagaaggacctgatttgggaggatattcag

SEQ ID NO: 17158 - DNA, 741 bp, Glycine max
  Peptide Sequence Number=SeqID_108843
ttctccgttcaccagtatcccaagttcgtgaatattaatcagtgcacgcttcgtgttcgattaattgcctctgagcctaacttgcgttcatgcttaatggacgaagggctaactggtgaaggcccaaatgttagaaccaacccgctagctagtcatggaggggctagcgtgaacgtcgtcgaagaggatgggccatcgcgggcaaagagattaggagaggtagctacttctagacgattcatctatcaatcactgcaagcggcatgcatggtctcccgtggcggaggcgaaggggacgaatgtttgtttcacctcggggagtcgcacgacatggaaacctgtcccgcggtagaagaattgcttcagcggctcatggactgggggcagcttgaagtgtccataggagggagggaagaaccacaaatttgcatgcagtcggaagagaagagggttcctctaatccccaaggccttagtgatatgttttactagaaaagggaccggttccacacccatataccccggggcggcgcccaagccaacgccatttgcatatcaaagtaataaggccattccgtggaagtatacccctcccgcgtccagcgaaagagttgcaaccgaagttgactccctatcagctaaggtaaccaacatcaccggcctcagtggcgtaacccgcagtggtcgggtgttcgcttaccctcacccggcggaattgccctccaaagggaaagcgcccatg

SEQ ID NO: 17159 - DNA, 954 bp, Glycine max
  Peptide Sequence Number=SeqID_108844
atggttggttcacacctttttcgccaagaggtgaggcatgcttgcccgctagaaagtcaccactcatgcacagagaaaggaggcgcgaattgggaccaactcttagcaaacaaagaaggagcgtctatcaaatggttccctcgatggaaagaaggaagaaccagagttcttatttcgtgtaaaggatttccgaatgttccctcgatggggacgaggggttgcatcagttacaatcccgttcttgctataagacaacttggctaccctatgagaggggcaccactagaggaagaaatcgcgcctaaggtccgcaaggcatgggaggtggtgcgaaagaaggacaaagaacttaggggcagtaagaatgggcccatccgtggctatagtaagtggttgagagcccacgtgcaaggtttggattggctcccgagtttgagaaccgcaaaaagggaggaagttgaggcaccggaggaagacgaagaggtgcaggcccttagagcagaactcgagcaagcccaaatagtcaaagaaaggttcaaatcagtagctctgaagatccgaaaggagaatgccgaactaagagatataaatatagctaccaccaaggccttggaacaagagatcaagagggctcgtagggaagagcacggccggaacaagtttcgaggggctctgtggggcagcaacagcgagcttaagctccggagagaggaaagggaccaatcccgagtagacagtttgatcttaaaagatgagttgaaggtttgctcaaggtccaaaagaaacctgtctcagtggttatgcgagatagagaccaacatgttagctatcatcagcaagtaccaagaagaactaaatctagccacggcccacgagcatagagtggcggacgagtatgcccaggtgtacgcggaaaaggaggctagaggatggaccaatttgctcttaccttga

SEQ ID NO: 17160 - DNA, 825 bp, Glycine max
  Peptide Sequence Number=SeqID_108845
atgccgggagcaagacaagcccgtcagggcgcgtcagcggttgttgacgggtgtcgggactggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgtgtgtgttcattgttgttttgttctctggagttgattcattgtcgtttttaagatgcatgatcttgttgcagcttgaaagatggtccgaagttgttaaagattaccaggccttaaaacgtgaactccctaacgacaatgaagttgccgagtctcttcgtcaggctcaactagcattagaaaaatctcgacaaatggtgtatggtactaggtttggagttgaagttgaacaaatctgttcattagacaaatttaaagctgcattagcctctgcaggtatatcggtagtatacttcaaagaggcatcaaatgaactatgcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 17161 - DNA, 465 bp, Glycine max
  Peptide Sequence Number=SeqID_108846
atgaaaacaaaaggtcattttggattggagatcatgcttggaatgatatgttatcacattggaatgcacctgagtatcgttccaaatgaggactttcagcaaactcatttacaaaaagatattggtcgatttattgatgatagatctaggcagacacataccctgctgaagaacatagacttaggagttggtgttgggattcagctgcggggccaaagcgtaagggatgcctttattgttagagtttgtggtcttagttcctttgtcccacatcgcttggtctgtaaaacttgtgtggtcttagtcccacatcgcttgtttagtggaggcagtgggagcaatggcattagaagaggggaaggtgaagatcgagaagttcgatggcagagatttcagcttttggaagatgcagatagaggattatctatatcagaagaagctgtattagcttttatcaggggttaa

SEQ ID NO: 17162 - DNA, 444 bp, Glycine max
  Peptide Sequence Number=SeqID_108847
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagaaaccaagaaggatacagtagacaaatcaatatgtcaggcattatggggggatccagggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 17163 - DNA, 282 bp, Glycine max
  misc_feature (259)..(259): n is a, c, g, or t
  Peptide Sequence Number=SeqID_108848
atgattgatcagtggaacaatcgccatgcttttagggtcgacgcttatccccgacaagaaggcctattgagctttaactcggactacatggtctggtataggcgaaagacaaagatgtttgttgacccacaaaatgcaaacacgactgcattggctgaagttgcggagacattacaatacatggtgtctcctcaagggaggaatacatggacagttgatgatctcgtgccttatgtggagaaaattacaattttatccngaagagcaagagagaatcactga

SEQ ID NO: 17164 - DNA, 105 bp, Glycine max
  Peptide Sequence Number=SeqID_108849
atggccgaccagcaggctaccaagtccaaagccaaagctcaagacgttaaagaagcgctactaggaggcaacctagtaccttttaaatttctgcctgctatttga

SEQ ID NO: 17165 - DNA, 489 bp, Glycine max
  Peptide Sequence Number=SeqID_108850
atgggttctccacctgcctccactactcctcctcctcctcctcctccttctccttctcctcctcgtcctcctcctacttcggacgcatcgacttcgacgtctgccgtgaagcggacacgcaaagcctcacgtctactagtccacctggtgttgagagaccagtggtgcatgttgatcctgctacagggaaggccgacggtggacatcacctacgagaactggaaggaggtccctactgctcagaaggacctgatttgggaggatattcaggcgaaatttgatataccagaggcttctaacagtaggacgaaaaggaagttactacagaccgtgggggagagatggaggcagtttaaatcagacctcacgaggaaatggacccttgcagccgatcaggacagtgtcgaggacactgtctgtgacaaatacgacatcagcaaggaaaagtgggcccagttttgccagactcgcagagacccttcttgggag

SEQ ID NO: 17166 - DNA, 207 bp, Glycine max
  Peptide Sequence Number=SeqID_108851
atggttgtgaggctaaaagaagagaaggttcaagcagttgatgtctcgctaagcgaggcatatgcgctgagggggggacatccgctaagcgagacatgcagctcacttagcatgttgggaaaccctagaagaggatcagtcacagatgtatgcgcccagcatgccgcaagcttgcccaacgagtcatttgtcccttctcgcgcttag

SEQ ID NO: 17167 - DNA, 832 bp, Glycine max
  Peptide Sequence Number=SeqID_108852
atgaaaatagccacctggctgatgttgatgctgttgctgttgggcttgatgcccatgggaaccggcgccatcgccttctatttcatgcagcaaaacggcaacagcatcggcaggatgagcactttctccgacgaggaagcggcgctgaaccgcagttggcgtgctttgctgcaaacgcagacgctgatcgacaacatggcgttcgagcgcatggcgcagacggacgccgccgatatccgtaagggcatcactgaggcacgtaacgagctgcgcagcgccgacgttgcgttcaacctgttttgggagacgccgggcctgacggtatcgcgcccggatctgggcgaggcgatgaaaacggtctatctggcgcagcaggcggtgctgaagcaagagctgacgctgttggccgacacgccgcaggcggcgctgatcgagcggctgcacgccatggccgctgagaagcgccaggtgcgccagcggctggatagccagtttgccgactacatgcgggccacggtggccgctcatcgtctggcggtggaggcggcggtgcagacccaaaaagtctttgcacgcctgctgagcggcaccctggcggcgatcctgctgctgctggtcgccgtgcaacgtgatttccgccggcgcttgatcctgccgctgcgccagatcgccgaacacttgcaaaaggttgggcgcggcgatctgcgcagcgagatcgcggtacgcaacagcaatgagatcggcatgctgttcgccagcctgcggacgatgcagcacgagctgagcgccaccgtgcaacacgtgcgtgatggcgtggagtcgatcaatcacg

SEQ ID NO: 17168 - DNA, 257 bp, Glycine max
  Peptide Sequence Number=SeqID_108853
gtcacaagaagctaaagtcttgtagtgctaaaaggagcagtcgtgctaagcggaacctgtgggctcagctcgcatctatcactaagcgcaactacagcatgcttagcgtgatgagaaaatctggaagagcacaagaatcgaggccatgcgcaaagcaagacattcgtctcttaccaggctcaacgcacgactggcaccaagcccaaatccacttactcgtgctaagcgcgatggtggcgctaagcgtgatatcgtga

SEQ ID NO: 17169 - DNA, 399 bp, Glycine max
  Peptide Sequence Number=SeqID_108854
atggtagcctggcctggggcccaaccttctcttcacggggaagatgaaggtcccacagcccaggtaccacagcatgtggaggatgagccatatgaggccaccattccagagccattcattatagaagaggaggcaggtgagacacaggtgagacaggtaggtgcagccactcctaagagatctcttgaggtcacttcaaagcctcctgcaccagtggtggacctatcctcgcctcagcatgcagcagacccctccactcctatcctagagatacatgaggacccaaccacaccagtcctgactctagacacttctcctccagctactctagtacttcatctaacagatgaggaggatgttcagacacaggatactcaggaccagtcacaggaattctaa

SEQ ID NO: 17170 - DNA, 465 bp, Glycine max
  Peptide Sequence Number=SeqID_108855
atgggttctttaaactttgcaaatgagaccattggaaaagaaaagtggtacaaggagagtgttaatgattcatctccaattctaccaattagcactccctctccatgtcatactgttcatcacaacaagaacctcattaacagccacaaggacatgaaactccaccacaacaagggcaaggacaacaacctgaatctacacaagcagagttctatccatggaagctctaacttgagaagacatgtgtaccaacaatgtaagaaaaacccacacaggcatgttgataaaaagcaaaagacaactttttttggaagtgatagtgagagtgaccctaataaagttaatatgaaacttgttgattttaatcaagagcagactctaacaacacttgcaaatatgataattattgatgaacttaagtttgttcaaaataaagggtttaggaagttcattgaagatgcttaa

SEQ ID NO: 17171 - DNA, 216 bp, Glycine max
  Peptide Sequence Number=SeqID_108856
atggccttgcttgtttcgtttgttgtaagcgtgaggaagaatctagaagaagatgagttgtcaggttcactgagcgcactgctccaggtcatcaagcgcaccgcttcagctcatccactaagcgagagaagcacgctaaaccaaaatccacttatgtgtgctaagcgattcaaatttgcactaagctcgcgagcacggaccaacccacctatttaa

SEQ ID NO: 17172 - DNA, 300 bp, Glycine max
  Peptide Sequence Number=SeqID_108857
atggagcattttcttgagcaagtagcctggcctgaagctcaacttccattggtcaatccagagccagctgacccacaatctccagtcgtgaatccaccttcttcgcctgagcttgaagcagttcccccatctcctcctctgattgtcatttgtgatgcatcatcagatgaagcagctgcccctcctgattcactagctgcagaaacaactaacccccctatttccccaattggaggaattgctgatcattctgattcgtcatctggagaagctgttgctctcactaattccctagtttaa

SEQ ID NO: 17173 - DNA, 421 bp, Glycine max
  Peptide Sequence Number=SeqID_108858
atggcagaaccatcaaagaagcgaaagggcacttcaagtcggagtcaacgacattccgggtcacaggaaacgccaattccttcctccattccctctggatcattgttttcatcaaaggaacaacggatacagtacacaaacctcttttcctctcgttccattattaacccaaaattcatagatatggatttcttttcaaatgagagttttgaatgctttcaagcatttgaaaactctaatcttatcccattcatgtctttaaaattacctatttattctgatctagtcaaagtcttctattcaaacttagaaatccaagaaggtcccctaatgtccgaggtttatgggattaagatggtcattgaccagtccctattctatgatttaacccaattgccaagcgaaggtgtaccatttgaag

SEQ ID NO: 17174 - DNA, 672 bp, Glycine max
  Peptide Sequence Number=SeqID_108859
atggagagaagtatgatagatgctgtcagtggtggagcccttggagacatgactcctgctgaagccagaaatttaattgagaagatggcctccaactcccagcagtttagcgccagaaatgatgccatagtcattagaggagtgcatgagctggccttgaatcagaaatctatacctgttgcaagggtttgtggtttgtgctcctctgctgaccaccatacagaccttttcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaacagtcctag

SEQ ID NO: 17175 - DNA, 165 bp, Glycine max
  Peptide Sequence Number=SeqID_108860
atggggatacaaaagaattctcaggcgggagacacaaaagaattcaggcggttagtccttcgttcttttggaaaagggagaagagagacacaaaaagaattcaggcagttagtccttggcaaattctttttggcaaagggagaagggaatgaaaaagatgaatag

SEQ ID NO: 17176 - DNA, 275 bp, Glycine max
  Peptide Sequence Number=SeqID_108861
atggctgcaaaattcatagaggaaacaggactgatatcagttcagcaacaaggagcagattcttggatttggaagcaacattcaagcggtatctatttgaccaatactgcttacaagtttctgatggaggaaataaggggggatccaatggatgggagctttgtgtttctgtggaagcttaagataccaccaaaggcaaagatttttacctggagactcatcaaagaccgcttaccagctaagttcaaaatatatatgtactcacagtacctctg

SEQ ID NO: 17177 - DNA, 863 bp, Glycine max
  Peptide Sequence Number=SeqID_108862
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagcatgtcacatcatctcaacaacggatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17178 - DNA, 126 bp, Glycine max
  Peptide Sequence Number=SeqID_108863
atggtcatggacatggctgacacatttggagaagattttggtattcatttcaaccaatggtcatccaatatcagagcaggatttaatcatatagttctgtcaagagcagacttgacagattcctag

SEQ ID NO: 17179 - DNA, 402 bp, Glycine max
  Peptide Sequence Number=SeqID_108864
gcacattcttggtggtgaagcttggataggatgcttcaatggaggaaaagtcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17180 - DNA, 416 bp, Glycine max
  Peptide Sequence Number=SeqID_108865
gcatagaacatcaagttgatctccttcctagagcttcattgcctaataggccaacttacaacagcaagccccaagagactcagcataaggatgcacatgccaaagttgagtatgtgaaaagattgtatgaccaagtgaaggtgcaaattgcaaagaagaatgaaagctatgccaagcaagcccacaagaaaaggaaggaattggtacttgaacccggtgatgatcctggacatttgagggcaaatgttttccaagaaggagggaatgatgagaatcatgaaactggccaaattgatgaggaaaatgttatggatccaccacaacctgtgcagaggggtgttactgagttgggtgaagctgccttgaacccaaggaacttgtgcatgatggatccaacgtggcatccctggttctaa

SEQ ID NO: 17181 - DNA, 159 bp, Glycine max
  Peptide Sequence Number=SeqID_108866
atggctaagttgtcgtactatcacgagggatcgggatctccgacaagcactttagttcctttggacttagaaattaaagctacattgagaaggaacagggctgagaggagaaggaaacttttgcaagacaaaacagttgcatccattcttgaggaatag

SEQ ID NO: 17182 - DNA, 531 bp, Glycine max
  Peptide Sequence Number=SeqID_108867
tcaaggtgtaccttttaagggcacccttgctgctaactggaaatttgattattctagttatgatgctcatcgcatggtctgcaatgaccaggctagcatgactggcagattacttgctggttgtcatatcgactgggcccatttagttcgatatcggatgcgtaaggcattacaggccaatgcacctctgccttatccacaccttgttactctttttcttcatcatttcattgttcctttggatgatgaaccatttgtcaaggtcaaaaggtctttctctattggtgctggtgaagttacctcatttggttaccgaaaggatgttgatggtcagtgggtttacaaacatgacttgcctctgcctattcctgacgagcgtaccccatctcctccaccacaatggggtgattccacttctcttctgactgaagtcctcacagaactccatggtcttcgcgcttttatgggtgaacgctttaatacgatggatacaaggatcactcgactcgaagatgatatgaacttcattag

SEQ ID NO: 17183 - DNA, 504 bp, Glycine max
  Peptide Sequence Number=SeqID_108868
gggctagcgtaaatgccatcgaaaaggataggccatcaaggtcaaagagattagaagatgtgggcgaaagtgacgaatgtctgtttcatctcggggaatcacacgacatggaaacctgccctgcggtggaagagttacttcaacggctcatggactgggggcagctcgaagtgtccgagggagatagggaagaaccgcagatttgcatggagtcggcagaaaggaaggccgctccatggaagtatacccctcccgcttttggagaaacggcggcaaccgaggttgactccttgttagccaagtggccgggtgttcgctccccctcactcggcggaattgccctccaaggggaaagcacccatgatccaagagccgcagacacggtcaccccctcaaaagaagtggatcccccgatggtaaaaggagctgaaaagaaagaaggtcttcaaggaaaggtggtgaccttgcaaaaggctcatgagttccttcgtctcatccaacaaa

SEQ ID NO: 17184 - DNA, 741 bp, Glycine max
  Peptide Sequence Number=SeqID_108869
atggccgatgggttcgacgaggaggccattgcccagctgttatgcacaccggggcatgatttcgcccggaccactgcagggaggcgggtgcggatcatgcgctccagcatgaccaccttgacccagatgtggatgacattgctgcttagcaatgtcttgcctagggatcataactccgatctccctctaccgaagtgtcagctggtgtatgccatcctgacacggatgagcatccacgtggctcagttgattgctgatgccatctatttgtttgcaggtatgccacccaccaggcaccctctaaacccagataagtctaacagggccctggggtttccgggattgatcacgggcctctgccagtcgttcggggttcccgtcacccccagcaaagtgatccgaccaccgatcacccgagccttcattgagaagtactgcacgcctaggcaggcacagggtgacgcacctcagggagcgggcgcaccgccaccacctcctcaggccggtcccactggatcactaggcatggagcgttatctacaacacttggggcagagttccaccccctttgtgtgccctaccccggagcagtttgcggctgaggtcgcatggccgggagattggcccgatgcccaggcaggggaggagcctgcaggatcccccggtaggatggacgagccccgcatggacaaggatatgactgacctattcgatttcttgggagggagcggagccacatga

SEQ ID NO: 17185 - DNA, 444 bp, Glycine max
  Peptide Sequence Number=SeqID_108870
atgtattacgggactcaatcagacatcggagtaaaaagtcatggtcgtttgaattggctcaaaggttctacgtcaatttggagcgtctcggtttattacgggactcaatcagacattcggagtaaaacgttatactcgtttgaattggctcataggttcaacattcaattttcgagtgtctcgatatattacggggactcaatcagacatccgagtaaaagcgtctcgatatattacgggactcaatcagacatccgagtaaaaagttattgtcgtttgaattggctcaaaggttcaacattcaatttcgagcgcctcgatatattacgggactcaatcagacatccgagtaaaaagttattgtcgtttgaattggatcagagctttaacattcaatttcgagcgtctcgatatattacgggactcaatcagacatccgagtaa

SEQ ID NO: 17186 - DNA, 198 bp, Glycine max
  Peptide Sequence Number=SeqID_108871
atggaggcatcaaagatgaagtttttcttggttttggtgattgccatgttggcgatggtagcaactggggtttcagctgctgaggcacctgccccaggtccttcatccgatgccaccaccttctttgtacccactgctcttgcttctctctttgatgcattgaattggagatttggagtgagggaggaagagaagtag

SEQ ID NO: 17187 - DNA, 814 bp, Glycine max
  Peptide Sequence Number=SeqID_108872
gaaagaatgcgctttacagtgctcttaccgaatgcgttccaaagctagagtaatgagtgaaatagagaaggtgcaagagcagatgaaggccgacatggaggccatgaaagagcaaatggccacaatgatggaagccatgatgagtatgaaaaaaatgatggaggtcaatgcgactacagttgtttccgcaagtaccgccatagaagtggacccaactcgcccatctagcctcaatcaagtaagtcctccagtctcgatgacatttttcccaccatatgacttgcctcccaactatacaccacccaatgttgcacacgctcctgatgaggatgtcgataactctactcctatactcattgagaatcaacaaccccaatttgatcatgcacatgtctctcaacccatagaggagacacatgaagcaccccgagaccacaatctagtcgacttcgaacctcacctcggatatgccactgaggggcaagcagttggtggaagagtccctcttgctatggtggaaaggagaaaatttgatcatatagaggaaaggttgagggccattgaaggaggcagagattatgcttttgctgacatgacagagttatgcctagtgcctgacgtcatcatcccaccgaagttcaaggtgccgaatttcgatacgaaagtcttactggggcagcttgatgtaagctccattggagcttgtaggcctaggatcttcttcatcaatggattcctttgcttcttggaagatgaatggcagcggaatggagaaggaagagagagaggagacgccacttcaaggagaagatga

SEQ ID NO: 17188 - DNA, 1080 bp, Glycine max
  Peptide Sequence Number=SeqID_108873
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattgggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgtttatcatcgatgcaagagccgagatatccgttgccgagagtcattgtatgtaaatgttgtgtcgtgacgactcccgcgggacaccgtctccggtacgaacagggagtcgcacatgacagatttgagttccttggcgcacgaagcgtcggg

SEQ ID NO: 17189 - DNA, 681 bp, Glycine max
  Peptide Sequence Number=SeqID_108874
atggaactgattgagaacatgacaactagtgaccatgctatcttgcgtgacagaacacacattcccacaaaaagaagtctgttagagctttcatcacaagatgctctattggcacagaataagctattagctaaacaacttgaatcactcacggtgaccttaagcaaattgccaacacagttacaagcagctcaaccaactcattcaggagttatgcaaattgaaggttgtagtatatgtggaggggctcacgaatctggtggttgtatggctcaagatgatgcatttaaagaagttaattatatggcaaatcataacaggaaaggatttcacacaggtggtttttcaggatatcaacagggaggaaactttaatcataatcaaggacagggctggaggtcacatctaggaaatcagttcaacaaagaccaaggaggttcttctaatcgacctcttaaccaagggccgaacttgtatgatcgaaccaccaaggtggaggacatactgactcaacaattaaaaacctggaaatccaagtgggacatcttctcagagaagcctcttgagaaagcttctcaaagaagcctcttgagaaagcttctcaaagaagccacgagggagcttctagaggaagcctcttatgaagcttctagagaaagctacatgaagctgcctcggtaa

SEQ ID NO: 17190 - DNA, 75 bp, Glycine max
  Peptide Sequence Number=SeqID_108875
atgcatatacgtgatctaggaaatggccccaaggaagcttgcctcaaagagatccaggaaagacaaggcggttga

SEQ ID NO: 17191 - DNA, 561 bp, Glycine max
  Peptide Sequence Number=SeqID_108876
atgtccaaatcttgtgaatttgggatgatcggccctctcgatgagtcgatctcatgctttctcataaggttggacccttcggtactagtacctatcaccttcagagggcttcacgccctcgccttcagaggactacacgtcctcgccttcagaggacttcatgtcctcaccttcagggggctacacgccctcgccttcgtagggctacacgccttcaccttccgaggacaacatgtcctcaccttccgaggactacacgtcctcgccatcagagggcttcacgccctcaccttcagaggactacacgtcctcgccttcagagggtcatgtaccttcacctttagaagactacacgtccttgcctccagaggactacacgtcctcgcctccagagggactacatgtcctcgccttcagagggctgcacgccctcacctccagaggactacacgtccttgcctccagaggactacatgtcctcgccttcagagggctgcacgccctcacctccagaggactacacgtcctcgccttcacaggactacacgtcctcacctttag

SEQ ID NO: 17192 - DNA, 681 bp, Glycine max
  Peptide Sequence Number=SeqID_108877
atgctgaggaactcgcctgcctcctctagcgatacttctttcttgccacaaccatcccttttctcagaaagaccttttattggaacatcctcgttcggagtggggatcactttgtcattttgtccttccgctatcttcgccttccctttagcgtttgcgggctgtgtcggcaggtcagggggtgtgaacatgcaaccgttgcaggtcatgccactcagccccatgatattggttactttggccgacagcgagctgatgtcggcagcttcttccttcctttcacttggaggcgtatacctccatggaactgcgtggctatttttgtatgagaatggaataggtctaactactaaggggtatcggggcgtttggggagttgcatctctggctaggcactgttcggttgagtggctcggggttttcccatggtatgcgcaggttgcgttagggttataccactttgggaaaggaggctgggatggcaagaggtctccgtacgtcattgggatcggggtgaattctggagttggcctcgggggaaagttccttatcgcattggaaccggtgccaaaatgggcattgccggccgggcgagtcgggaggagaacccgactcgagctgagaaggacgggtgatgttgtgtatactgatgggtaccgtaggagatttgcggcggcttga

SEQ ID NO: 17193 - DNA, 705 bp, Glycine max
  Peptide Sequence Number=SeqID_108878
atgtttggaagcaaaggtgagaaccttggcaagtcaagaagaatgggcccgttcatggatgtcctggcgctcttgatcttcggagtggtcctctttccaaatgtggatgggttggtggactgggcagtgattgatgcttttctcgccttttacaaccacaaggaaagcccggttgtcgctatcttagccaatctatatgacacattcgaccgaagatgtgagaagaactgtgcaaggatcgtttgctatacaccggccctctacgtatggttggtttcacacctttttcgccaaaaggtgagacacgtttgcccgctagaaggccaccgctcatgcaccgagataaaggaggcaaactgggaccgactcttagcaagcaaagaagaagcgtctgtcaattggttccctcgatggaaagaaggaagaaccgggattcttatttcgtgtgggggatttccaaatgttcccttgatggggacgaggggttgcattaattacaatcccgtcctcaccataagacaacttggctaccctatgagtggggcaccattagaggaaggcctcgcaccttttattgcgcgaggtttcaataacaccaacacgagggtgcttcagagggtccacaaggcatgggaaagggtgcaaaagaaggacgaggaacttaggggaagtagtaacgggcccatcggcggttaccgtaggtag

SEQ ID NO: 17194 - DNA, 276 bp, Glycine max
  Peptide Sequence Number=SeqID_108879
atggtggcgcgtgttatgctcaggaacggatttgagcccggaatgggtctaggcaaggacggcctcgaaaatgccgatgtggtcgatgtcgcaaccgacccttcggtgggagggcgacgcgtgactcgcgggatgcgtgttccacgaaaggaatacgcgcggagtcgccaccaacatttatttgaggaaaacgtcggaaaaaccggaaaagacgcgatctacgaacttttaagtgaaagattcgggagttgtatttacgcgcggggaaggtattag

SEQ ID NO: 17195 - DNA, 453 bp, Glycine max
  Peptide Sequence Number=SeqID_108880
atggctccgaaaaggctttccgcaaagagatctaggagggatgccgcggttgaagggaccagtgccactcccgagtttgatagccaccgttttaggagcgtcgagcaccagcaacgctttgaggccatcataggatggtcattccacagagagagacgcaaggagatagctcaccgacattggacgtcgctggtcactcccattgctaagtttgacccagacatagtcctggagttttatgctaatgcttggcccacagaagagggagtgcgagacatgcggtcatgggtgaggggtcagtggattccctttgatgcaaatgccctcagccaattcctgggtgacccgctagtattggaggaaggccaggagtgcgagtttagtcagaggaggaacagggccgatgggttcgacgaggaggccattgcccagctattgtgcacaccggggtag

SEQ ID NO: 17196 - DNA, 267 bp, Glycine max
  Peptide Sequence Number=SeqID_108881
atggttgcctttgttaggcagtatcagtacaattttgatatggttccggataggatgcaactacagaacatttgcaaaaagggggacggatctttcaaagaacacgcccaaaaggtggagggatctggcggcccaggtggtacccccaatgatggaaagggagacgatgatcgtgatggtagacacattatcgatacgatactctactatgaaaagatggtgggctacgcaccctcaaagctttgcggatttggtcttcgccagtga

SEQ ID NO: 17197 - DNA, 823 bp, Glycine max
  Peptide Sequence Number=SeqID_108882
accggtcatgggtgcatggcatgatcttaaaagaaaagttagctgcgtgcgcaagatccaagaggagtttggctcaacacttggaagccacggagcaaaacatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagaacagatgaaggtcgatctatcggccttaaaagatcaaatggcttccatctcggaggtcatgttaaaactccagaaaaccatagaggataaagccacgacaaccgcctccagtacagttagggaagccgagccggtgctgcagcccaccttgaatccgggcctagacagaaacacggccgtgttcggtggaaggtatagtccgcaagcctatccttatggcctgcctccagacttcaccccccgtgccaccccggaagatttaagccaagtccctactttcgaggggcaactcccaccttatgaagactatcccgggcaagacgatggggaaggagatacccatcttggccccctgctccacctcaaagatccgtccccacatgaactaccccaaccgaacatagtccgccatatcccggcctcacccacacctgtaaaagaatctgtccccttcgcggaagataagagaaagattgaggcgcttgaagagag

SEQ ID NO: 17198 - DNA, 261 bp, Glycine max
  Peptide Sequence Number=SeqID_108883
atgggggtgcaaatagcaattttaaaattttcaaatttgagccttccaggacattttggaagcggggttgcttatggaggaagcaacccagctcgcctggctgtgttgggtgagaaaaattgtttccgtgaagaaaatccaagccgaggtacttctgtaaagcttccgagatgttttcgtgagcaaatcgatgaaggtttttcgtcgttcttcaccgtttttcatccgttcttcgttcgttcttcgttcttcaatcggtga

SEQ ID NO: 17199 - DNA, 735 bp, Glycine max
  Peptide Sequence Number=SeqID_108884
atgggttggtggacgctggcagcgatcgacgcttttctcgctatactagccaatctatatgacaccttcgaccgaagatgtgagaagagcaatacaaggattgtttgttgtactccagccctctatgtatggttggtttcgcacctttttcgccaagaggtgaggcatgcttgcccgctagaaagccaccgttcatgcacagagaaaagaggggcaaattgggacggactcttagcaagcaaagaaggagcatctgtcaactggttccctcgatggaaagaaggaagaaccgggattcttatttcatgcggaggattttcaaatgttcccttgatggggacaaggggttgcattagttacaatctcgttcttgctataagacaacttggctaccctatgagaggggcaccacaagaggaaaagctcgcacctattattgcacgaggtttcaataagaccaacgtggagccacttcagaaggttcgcaaggcatgggagatggtgcaaaagaaggacaaagaactcagaggcagtaacaacgggcccatcggcgactaccgtaagtggttgaaagtccacatgcaaggtttggattggctcccgagtttgagaaccactaaaggggaggaagttgaggcaccggaggaagacgaagaggtgctggcccttagggcagaactcgagcaagcccaaacagtcaaagaaaggttcaaatcagcagctctcaagatctga

SEQ ID NO: 17200 - DNA, 876 bp, Glycine max
  Peptide Sequence Number=SeqID_108885
atgccaatcaggatccccgacgaattaccggcagtgaattttttgcgtaatgagaatgtctttgtcatgacctcatcgcgcgccagtgttcaggagattcgtccgcttaaagtgttgatccttaacctgatgcccaagaaaattgaaaccgaaaaccagtttctgcgcctgctctctaactcgccgctgcagatcgatgtccagctgttacgcatcgacagccgcgaatcgcgcaacacgcccagcgagcatctgaacaacttctactgcaacttcgacgatatcgctaacgataactttgacggcctgattgtcaccggcgcgccgctggggctggttgatttcaatgatgttgcctactggccacagattcagcgcgtgctgcactgggcgaaagagcacgtcacttctaccctgttcgtttgctgggcggtgcaggcggcgcttaacatcctgtatggcattcctaaacagacgcgacagaacaagctgtctggcgtctatgagcatcagatccttcatccgcacgcgctgctgacgcgcggatttgatgacaacttcctcgcgccgcattcacgctatgctgatttccccagccagctgatccgtgactacaccgatcttgagctgtttgccgaatcggaaagcaccggtgcctatctgatggcgagtaaagacaaacgcctggcctttgttaccggccatccggaatatgacgctcttacgctgtcgggtgagtaccatcgggactacgaagccggcctgcaccctgaggtgccgttcaactacttcccgcaggacaacccggaattgccgccgcgcgccacctggcgtagccacggcaacctgctgttctccaactggctcaactactac

SEQ ID NO: 17201 - DNA, 327 bp, Glycine max
  Peptide Sequence Number=SeqID_108886
atgtggacaatcattgaccagtataaagagaagttaaacctagttgctaaccatgagcaaaggctaaaggatgagcatgcaaaagtatcggctctgcaagcggaaaaggaaacaagagagagagtgatagattcattacacggagaagctatgatgtggatggataagttcgatttcactctgaatgggagtcaagagcttcccaggctattagccaaagccaaggcaatggcggacgtgtactcagctcccgtggaagttcatgggcttttcgattattgtcaacatatgatcgagttgatgtcccacataattaggaaccgctga

SEQ ID NO: 17202 - DNA, 594 bp, Glycine max
  Peptide Sequence Number=SeqID_108887
atgaatgccggagccctcatttctgggcagattacttctatggcccagtctaactcctcaagactcaagtttcctgctcttatcacagctttatgcaggaccagaggagttgcctccaatagtcttgtctttgaacgtctgagcccgatcattaatttggcctacataactcctcctccagcgcgtattgcagcagctccttctaccccacctcctacagattttcagcatttcaaagccatgcttcgaagcatacatcaggggaaaattattttgctgcaaagtctccagctgatagcacctccagactccatccctacagtagagcaatttaatgaatgggtagcctggtcagggactcagcctcctcctcacagggacgacgaggatcccgccgctcaggtaccacatcagccaacggatgagtcattagagtcttccactcctgagcccttgatcaggaagaggagggtagttgtaactcaggaagccgcagctactcctgaaaagtctcctgaggccattccagagcctctggcaccaaaggcagataccacttctccacagcaggcagcagatccttcaacgcttgaa

SEQ ID NO: 17203 - DNA, 196 bp, Glycine max
  Peptide Sequence Number=SeqID_108888
atggttacttccatacttcaacttaactcgatgaaccttttcgtaaaagcacgagcttggttctaccccataacccagagaaaggcacttttgatcgccaattcttcatcaacatttcatagggatgaaagactcgggaatacgcatgcagtgcatggaaaatatgggtttatgatcccaacatggttggctcatg

SEQ ID NO: 17204 - DNA, 756 bp, Glycine max
  Peptide Sequence Number=SeqID_108889
gatcacttcctagttactgcattttcatgtttatttgattcgggtacggcctcgatcacaccccctcgccttcagaggactacacgtcctcctcttcaaaggactatacgtcctcttcttcagaggaccacacgtcctccccttcagaggacttcacgtccttgccatcagaggactacacgtcctcaccttcagagggatacacatcctcaccttcataggattacacgtcctccccttcagagggctgcacgccctcgccttcagaggactacatgtcctcgcgtcctcgccatcaaagggctacacgcccttcccttcagagggttacacgccatcaccattagaggactacatgtcctcccctttagaggactacacgtcctcacctttagagggttgcacgccctcgccttcagagggctccacgccctcgtcttcagagggcttctcgccctcgcattcagagggctacgtgtcctcaccttcaaagaggactacatgtcctcgcctttagagggctacacgccctcaccttcagagagctacacgccttcaccttcaaaggactacacgtcctcaccttcaaaggactacacgttctcaccttcagagggcttctcacccacgccttcagaggactacacgtcctcaccttcagaggggtacacgctctcaccttcagagggctgcacgccctcaccgttagaggactacacgtcctcgctttcagaggactgcatgtcctctccttaa

SEQ ID NO: 17205 - DNA, 1056 bp, Glycine max
  Peptide Sequence Number=SeqID_108890
atggcgaagcagcaaacacacgaaatcaatgcaagcactaacaataacattaacacaactaaaactgtcaccaccaaggtgaaacgaacaaggagaagtgtccccagaaattccccacctcaacgcagctcaatatacagaggagtcactagacaccgatggacaggtcgatacgaagctcatttgtgggacaagaattgctggaatgagtcacagaacaagaaaggacggcaaggtgcttatgacgatgaagaggccgcagcacatgcttatgatctagcagcattgaaatactggggtcaagataccattcttaattttccgttatcgacctaccagaatgaactgaaggaaatggagggtcaatctagggaagagtatattggatcactaaggaggaaaagcagcggtttttctcgtggagtttctaaatacagaggtgttgcaagacaccatcataacggaagatgggaagctcggattggcagggttttcggcaacaaatatctttacctcggaacttatgcaacccaagaagaagctgccacagcatatgacatggcagctattgaatatcgaggactcaacgctgtgaccaattttgacctcagccgctatatcaagtggcttaagcccaataacaacaataacaaagtcaattctaataatcttattgtctctatccctaattgtgcgaccaactttaccccaaactctaaccaacaacaaggattcaattttttcaacagtcaagaatcattcaataataatgaagaagcggcaatgactcagcctcggccagctgctgccacgtcagccctaggacttttgcttcaatcatccaagtttaaggaaatgatggagatgacttctgccatagatttgtcaacaccgccatcagaatctgagttgccgccatgcacatttcccgatgacattcaaacatattttgagtgtgaagattcccatagatatggagaaggggatgacatcatgtttagcgagctcaacggctttgtgccccctatgttccattgtgatgactttgaggcttga

SEQ ID NO: 17206 - DNA, 165 bp, Glycine max
  Peptide Sequence Number=SeqID_108891
atgacgaaggaagtgatccatgatcacaactctgctgcgcctcggctccacttttcctcttcttcttcttcttcttcttcttcttcttctactacatttttctttggttttaggctgctgaaaaagccatctagtgcaggggaaactcacccaagcaagctgtga

SEQ ID NO: 17207 - DNA, 294 bp, Glycine max
  Peptide Sequence Number=SeqID_108892
gtgcgtaacggcaaaagcaccgccggacaatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatagcttaa

SEQ ID NO: 17208 - DNA, 741 bp, Glycine max
  Peptide Sequence Number=SeqID_108893
atggcccgcacgaagaaaacaggggagatgacgactgaggccgcaaaggaaatcactgagaagattgattcctttgaggagcaggccacacagggatccttcgtcccccatggatgccaggatgttctcgcggctgctattggacgtccagagcaccctggacatgtccgtgctgctggagccggtgtcaccatcaagcaatactttggatcggctccacggacgtcccgtagcacttcctccctacctcctgacgaattgcagcagctgacccagcaaatcagggaccagctagaggagtccatcatagagaaagtgacgaggcaggtcatggcatccttcagccacatgcagtcccagcttcagtcgcagatgcaatctcagggacttgcagtgcctcctgagcctctggttggtccctccggtcctcgagtgtgcacaaaggggagttgtgttgatccctcaggaaacgatcctgagaccgatgactctgacaggtgcggcttgtacataaaagcagatcttgcccacctggttgtcatggggagagtttatgagggatccactgttgttcataacactcctttgttgcttggccaagtaaaggttagtgtggaggaggttatagatgcagatgctccagttcttgtacccactgatgaggtttccttagtagggcacacacttcacaccttccttgcttggccgacacatctggtcaaatctttgtttcatgaacag

SEQ ID NO: 17209 - DNA, 240 bp, Glycine max
  Peptide Sequence Number=SeqID_108894
agttgtatgcctttgctctgttttgcttggctgtgatagcttgtgcggtgggcaacaagggatggtgggtttatgcgcgcattgtggatgtggaaaacttgttgtgcaccatcgcccgaccgccacctaagtggtacctggagatatgtcgcgggggtcacgagaccttggggacgtcaggtggggtgctattgcccaaaaccaagcttgaccaatcccgacccaacccgggcatagtcg

SEQ ID NO: 17210 - DNA, 231 bp, Glycine max
  Peptide Sequence Number=SeqID_108895
atgccctcaccttctgaggactacatgccctcaccttcagaggactacacgtcctcaccttcagaggactacacgtcctcgccttcagagggctgcacgtcctcgccttcagaggactacacatcctccatttcagaggactacacgtcttctccttcagagggctgcacgctctcgcctttagagggcttcacgctctcgcattcagtgggctccacatccgcaccttaa

SEQ ID NO: 17211 - DNA, 555 bp, Glycine max
  Peptide Sequence Number=SeqID_108896
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccaagaagtattactttgggaagctatttagcatcaagcttatcgataccgtcgacctcgagggggggcccgtcgggaaacctgtcgtgccagctgcattaatgaatcggccaacgcgcggggagaggcggtttgcgtattgcgcgctagcggagtgtatactggcttactatgttggcactgatgagggtgtcagtgaagtgcttcatgtg

SEQ ID NO: 17212 - DNA, 216 bp, Glycine max
  Peptide Sequence Number=SeqID_108897
atggtaaacacgggaatgatgtatactattacgatgtacaaagatatgcatgacaagatcaaggaaacaagacatagactaccaacgacaatgcatcatcaaaagaggaaaactctagataaggctttactgtcatcaagcaagtcggagacccaacatgaccatagatcgacctccacttcctatgtctcacacagacccgggtatagggcctaa

SEQ ID NO: 17213 - DNA, 324 bp, Glycine max
  Peptide Sequence Number=SeqID_108898
atgactaggggcaatccaggtgatttacaaccctttaatcctaaattagatagaacctttcatagattagttaggcatattgtgcatcctggtcattttgtgcattctgttgagggtgattctgaatattctgattttgaacattccactactaactttcatactgagaacatggctcaacctccacctcgtgagaggactcttagggagatggttgcacttgatttcacttatgaaagcttgtgcattcaatatcctgatgagggtgttccatatgttctcaagactggactaatacatttgctgcccaagtttcatggtctt

SEQ ID NO: 17214 - DNA, 259 bp, Glycine max
  Peptide Sequence Number=SeqID_108899
tctctcgctaagccaatctgctggcttagcgaggcatccgttgagtgcacccctcctttcggctgagcgtgaggaaagatctggaagaaggatgagctgtgcatgttcgctgagtgaagggaagcttcccagttatggatgtggacaaaggatcaagctgaatgttttgatgatgccaaagtttcacatgcgtctcaaagctttattcaagacaaagaaattaaagatattcaagatggatgatcaagacaatctctag

SEQ ID NO: 17215 - DNA, 447 bp, Glycine max
  Peptide Sequence Number=SeqID_108900
atgaccatgattacgccaagctcgaaattaaccctcactaaagggaacaaaagctgtaaaagatattcaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17216 - DNA, 284 bp, Glycine max
  Peptide Sequence Number=SeqID_108901
gttacattaagcaaaaaggcaacagaaatgaagagaaagaaggagttctaaagcaggcccagcccaacactggcgctaagcgagcgtcaggcgctaagcgagcaaagaagacaggcgctaagcgaggcgttgaactcgaagatgcagaatccgttacgcgtgctaagccccagctatgcgctaaacgcgcgatccaacagaagcacaggctaagcctgcaaggcgcactaagcgtgcgatccgaacgcgctaagcgcgaggtgtcgcgcttagcgcaaatatga

SEQ ID NO: 17217 - DNA, 422 bp, Glycine max
  Peptide Sequence Number=SeqID_108902
atggccaccattgaattatcgagtagatatgggagcaagttagcatatgacaccggaatttggggcaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17218 - DNA, 382 bp, Glycine max
  Peptide Sequence Number=SeqID_108903
atgactagaggcaatccatctgacttacaaccctttgatcctaagatagataggacatttcatagattagttaggcatcattttataccttttgatcattctgagcattccataactggtgaatctgtgcattttgttattggtgattttgaacatcctgatcttgagcattataattttgagcattctgattctgagcattctgattttgcacattctgagaacatggcacaacctccacctcgtgagaggactctaagggaaatggctacacctgatttcacctacgaaagcttgtgcatccaataccctgatgaggatgtcccatatgttcttaagactggactgattcatttgcttccaaagtttcatggccttgcag

SEQ ID NO: 17219 - DNA, 919 bp, Glycine max
  Peptide Sequence Number=SeqID_108904
cgtatgttttccggtgcatcatcttccaaatcagcacaaagcaccacgccatatggcacgagtcctttcacagtctccatccggaagccaatagccccgttgaactgcaccgcatacaacctcaccggaacatgccccacaaacctacaagaccatcagagcactccagccaccgccacgtgtccagattacttccgttggatccacgaggatttgaggccttgggcccgtacgggcatcacgcaagacatggtggagagggcaaagcaaacggcaaattttagggcagagattaatataaagccatggcatattttgttgggagagttgaaagaaggcactacgaggataccatggctgaacagagagccttatgcttactggaaagacacactcgagtcgagcgggagtcaaagctggaagtccaaagtttctggaactcaaactagtagtgtgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaaggtgtgagaaaggtggtttctgatgctgtgcataagagagacgatgatcctgagagaagaatggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagcttaaaggtatggttgggacatggtttaccaacccagcagagaatcaatcttcacaagattcatctatgaattatgaggcaggaagggcagaagtggaacaagttaaccaaggtgcagcag

SEQ ID NO: 17220 - DNA, 673 bp, Glycine max
  Peptide Sequence Number=SeqID_108905
cgccacgcttcccgaagggagaaagccggacaggtatccggtaagcgccagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctttgccaactgtcccacttggatttcaaggctaggcacttgttgctgaggcctattaaatggtccaccctggtccttgttgaattgatttcccagatgggacctccactgcccttgttgctgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17221 - DNA, 491 bp, Glycine max
  Peptide Sequence Number=SeqID_108906
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctcccagctgggctgtgtgcacgaacccccgttcagcccgaccgctgcgccttatccg

SEQ ID NO: 17222 - DNA, 156 bp, Glycine max
  Peptide Sequence Number=SeqID_108907
atggaggatagggtcacaactgaccgatcgtcgtcccttcccggcgttggacaagcagagaacgtcgctgtgaggtgtagaataggtagcaaaatgcctttagcaatttacacctttggatatggtagcaagatgcttggatttgtgtacatgtaa

SEQ ID NO: 17223 - DNA, 162 bp, Glycine max
  Peptide Sequence Number=SeqID_108908
atggatgtacctctacttgaattgatccacaagagatgtaccctctcttgttctcagtattacagcccaactagatggaagaggaagaatccaaagaattctcaggcagttaatcctttgaatcttttagcaagagagagaaggaatgaagaagaagaatag

SEQ ID NO: 17224 - DNA, 956 bp, Glycine max
  Peptide Sequence Number=SeqID_108909
atgagggcaaagatattagagaatattgtaatcatgtctagacttttacgatctttttcccgtatctcttttcgctcaaactcctcctcatcatcttcctcaagaaactccaatttattaaatgatcaagataaccagacccaagaggtcgccccaaaacacaatctcttcgatgaggaagtccgattcgaagatatcaatcaaaacatggatgactggaacattctagaaatccctcaggatcaactatacgttcctgaaacaataaaagacaaacacaactttgattacataatcaaaacagtagaaaacaatattcctctaggacaagatataggggaagaatttcatttactttcaataaattcaatttatgaacatagccccatcaagcccttaattgatatgggcatagatgcagcggttttaatgtgtctaagagacattaggcataatcaatttgaagactccctaattggaacagtcgaaaccagcctaggacaaggtccaatatattttaactgttatccaaacaaaacagtgagtctgatgaacataaacattcttgactctctgttcttaaacatccactttcatggccttgacatgaaagaaggatcaatcccagcagccttaatttataggatccaatacaaggtcatgaatacttgtgcatctagagtcctgttaaaacctcaaaaaggagaaacaaccttttttatcactgatatgacaaaggctaacgtttctctcccgagaaaaataaaatgggatgaagtaactcttcctgaaagatgggttatggataaggccacgccgtctattccccgacccgctccaaccatagaacatattaagcaagataactccggaaaggtagagataaccttcaataggagaaattctttttcatcaaggatagaagcctctaggtctgaatacgagtcagccagaag

SEQ ID NO: 17225 - DNA, 752 bp, Glycine max
  Peptide Sequence Number=SeqID_108910
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccaggggaggacccttgggtactagtactctcaccttcagagggctgcacgccctcgccttcagagggctgcacgtcctcgccttcaaaggactacacgtccttgccttcagagggctacgcgccctcaccttcagaggactacatgtcctcgccttcagaggactacacatcctcaccttcagaggactacatgtcctcgccttcagagggcagcacgccctcaccttcagaggactacacatcctcaccatcagagggttgcacgccctcaccttcagaggactagacgtcctcaccttcagaggactagacgtcctcaccttcagaggactacatgtcctcgcctttagagggctatgcgtcctcactttcattcttgcgtcactccctgatattggagggcgaccaactgtgctagcacaaccagagagggaggctatcacgcagctactatgcataccgggacaagatttcacccgtgttggtgcaaagagacga

SEQ ID NO: 17226 - DNA, 432 bp, Glycine max
  Peptide Sequence Number=SeqID_108911
atgcgaccttatcctatcttttgcaatccctctgggaactccctcagagtgtatatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17227 - DNA, 309 bp, Glycine max
  Peptide Sequence Number=SeqID_108912
aagtttcacgaattggtcaagaagagaagaatcgagtggcgtcaaaatttcaaccatggaaaaagattccaagaagactctacaactcttagatgctacaagcgcaaccaacttggtctcatcaaagcaaattgcccctcaaacaagcaatggcctgagaagaatgagaagaaaagtcatgaagaaagaagattcaagaaggcgtatattgcatgggatgacaatgactcatccgatggttcggagaaggagattaaccttctatacaaggactatgagagcaataagaacatctctcaagaagattaa

SEQ ID NO: 17228 - DNA, 344 bp, Glycine max
  Peptide Sequence Number=SeqID_108913
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccgatttggtgtgaaggctaatccaaacaagaagcatttggtcttgaacctcccaggtttcatactcaaggttgactcgatcagcgatgtgatcgtcctcggtgag

SEQ ID NO: 17229 - DNA, 395 bp, Glycine max
  Peptide Sequence Number=SeqID_108914
gttctgtcgtgcgttatcccctgattctgtggataaccgtattaccgcctttgagtgagctgataccgctcgccgcagccgaacgaccgagcgcagcgagaaacagctatgaccatgattacgaattcgagctcggtacccagccaggcgtattgagtgccaaggtcatctatgagagggacagtggaagatctcgaggttttgggtttgtttcttttgaaactgctgaatctgcacaggctgctttggacattatgaatggtgtggaggtacaaggtcggcccttgcggttgaatttggctgaagcaagggcaccttcatctcctccagtaattcagaaaaatgtaggaagcaatgttgaaagctcggaattggtgtctagtgccagcacataa

SEQ ID NO: 17230 - DNA, 525 bp, Glycine max
  Peptide Sequence Number=SeqID_108915
atggttataggagatttcatcagcagactctcctttcccgttggaatatttgtctctttggctaaagcatgttcgcattttagtggagtaaacaccgagactttttccagtctcacaagttatccagaactacgtaggtctgagttcctcattggaggatacgtaggagcaagagcctcgcttttgtcgaccgcaccgctttttgttgccatgacccaagagctggtaacccgcggagacaccttacggttatccgcacctcgtcattcagtgaccccaagtgtgattgacgagcagagaccaatatggtcatctgcgccctttccggagatgtcagcattttccgatggagacttttcaagtctcacaagttatccagaactacgtaggtctgagttcctcattggaggatacgtagggaccaagagccttgcttttgtcggccgccccataatctttgtcatactgaccctgaggtcaggtgacgtgcacccttgtatcatccagaggcggcgggcccgatga

SEQ ID NO: 17231 - DNA, 213 bp, Glycine max
  Peptide Sequence Number=SeqID_108916
atggagtcacctattaatggagttggttccttatcagagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17232 - DNA, 2118 bp, Glycine max
  Peptide Sequence Number=SeqID_108917
atgaattctctgtttgccagtacggcgcgtgggctcgaagagctgttgaaaactgagctggacgcgctgggtgcgcaggatttgcaggtggtgcagggcggcgtccacttccgagccgacgaccgcgtaatgtaccaaagcctgctgtggagccgtctggcttcacgtattttgctgccgctgggagaattcggcgtctggagcgatctcgatctctacgtcggcgcgcaaagcatcccgtggagcgagctgtttgacagcaacaccacgttcgccatccacttcagcggcaccaatgaggtgattcgcaacagtcagtttggtgcgctgcgcatcaaagatgcgattgtcgatagctttacccggcagaatctggagcgtccgagtgtcgatcgcgagcagccgggcatccgcatcaacgcgtggctgaacaaagatcgcgttagcatcgcgctggatctgagcggcactgcactgcaccagcgcggctatcgccagcaaaccggccaggcaccgctgaaagagaacctggcggcggcgattgtgatgcgctccggctggcagagcggcacgccgctggtcgatccgatgtgcggctccggtacgctgctgattgaagcggcgctgatcgcctgcgatcgcgcgccgggcctgctgcgttcgcactggggcttcagccgctggaaacgccacaacaatgcactgtggcaggaagtgcgcagcgacgcgctgcagcgtgcgcgcgctggtacggccgccaccacgtcacgcttctttggctatgataatgatggtcgcgtgctggagtgggcacgtgccaacgcgcgccgtgccggcgtgtttgatctgttcacctttgcgcagcaggatgtgctgcagctgaaaaatccgctggcgggcgaagcgatgcgcggtacggtgctgagtaacccgccgtacggtgagcgtctggagagcgagccggcgctgattgcgctgcacagccagctgggccgcatcatgaaacagcagtttggcggctggaatttgtcgctgttcagcgcctcacccgagctgctcagctgcctgcagctgcgcgccgatcgccagtttaaagcgaaaaacggtccgctggagtgcgtacagaagaactaccagctggcggagaacagcgccgaaggcggcgcacagattgcagaagactttgctaaccgcctgcgtaagaacagcaaaaaactggacaagtgggcgcgccagtcgaatattgactgctaccgcctgtatgacgccgatctgccggagtataacgtggcagtcgatcgctacgccgactgggtggtgattcaggagtacgcgccgccgaaaaccgtggatgcgaccaaagcgcgtcagcgcctgtttgacgtgatcggtgccacgctgagcgtactggagataccggccaatcgcctggtgctgaaaacccgcgaacggcagaagggcaaaaaccagtaccagaagctgagcgagaagggcgaattctttgaagtgcaggagtttaacgcgcggctgctggtgaacctgacggattatctcgataccggcctgttcctcgaccaccgtatcgcgcgccagatgctgggccagatgagccaggggaaagatttccttaacctgttctcctataccggtagcgccagcgtgcatgccgggctgggcggcgccaaatccaccaccacggtcgatatgtcgcgcacctatctggagtgggccgagcgtaacctgcgccttaacggattaaccgggcgccagcatcgcctgatgcaggcggactgcctgagctggctgcgcgaaagcgatgagcagttcgatctgatctttatcgatccgccgaccttctccaactccaaacgtatggaagatgacttcgatgtgcagcgcgaccacctgatgctgctgcagaacctgaagcgcatgctgcgtcgcggcggcaccattatgttctccaataacaagcgcggcttcaaaatggatctggacggcttgcagcgtctgggtctgcaggcgcaggaaattacgcaaaaaacgctgtcgcaggactttgcgcgcaaccgtcaaattcacaactgctggctggtaagccacgccggtaaggaataa

SEQ ID NO: 17233 - DNA, 144 bp, Glycine max
  Peptide Sequence Number=SeqID_108918
atgggagggcgatgcgagggctcacgggtgcgtcttccaagggaggaaaatgtgcggagtcgccaccaacgtttatttgaggaaaacgtcgaaaaaactggaaagggtgtttccctcgctcctacgtatcctcaattgcgatga

SEQ ID NO: 17234 - DNA, 138 bp, Glycine max
  Peptide Sequence Number=SeqID_108919
atggtactagttttgtgcaaggatatgaagtcttgcacaagctatttacaaactggcttatcggtagaactacaaaggaaagaaaaggctacaaaggaaagaaaaggctctcccatactttcttcttcttttgattag

SEQ ID NO: 17235 - DNA, 114 bp, Glycine max
  Peptide Sequence Number=SeqID_108920
atggctatgacatgtatacaattccatgccaagatggctcttcaaacttcccgagcattggagtcattttggttctcatcaatgttgaaaatgattaaaggtacaatagagtaa

SEQ ID NO: 17236 - DNA, 240 bp, Glycine max
  Peptide Sequence Number=SeqID_108921
atgaaggtcccacaacccaggtcacgagaggtcacatcagatccacccataccagtggtggacctatcctcacctcagcatgcaatagatccctccactcctatacttgagataccagaagacctgaccacaccagtcctgactctgaacacttctcctccagctactccagtacttcatctgacagatgaggaggatgttcagacacaggatactcaggaccagtcacaggaattctaa

SEQ ID NO: 17237 - DNA, 309 bp, Glycine max
  Peptide Sequence Number=SeqID_108922
atgcagctggcacgacaggtttcccgactggaaagcgggcagtcggactgtgtacgcccatttgcaccagagttggagcacatttgtgggaggccattaggactaagatttgacaagaaaaatggagatctgtacattgctgatgcctacctaggcctaaaagtagtggggtctgcagggggtttggccaccgaagtggtaacagaagttgaaggtcagcccttgcagttcaccaatgacatggacatcagtgaagatgaagaagtgatatacttcactgattcaaccacaatcttccagagaaggtaa

SEQ ID NO: 17238 - DNA, 324 bp, Glycine max
  Peptide Sequence Number=SeqID_108923
atgaagagggaagagaggagaacaagctgtgatttatactggagtttcccacttcccgcgcattacgtccagccaatcaacaacccaacccttgagatttatccactctctttggacaacgccttccttgtgttcaagaactcaccttacaaaccaagagactctcagtctcttaatcccttttcagaagcattttcaactttcaccggaattgggtgcaagccattggtctatttgctcaagcaacctgcgctcctgagtgttgacttccaagaccgttcaataagagattactcgtcttgcacgttggtggggttgctgtaa

SEQ ID NO: 17239 - DNA, 48 bp, Glycine max
  Peptide Sequence Number=SeqID_108924
atgtacactgggcttcaagagttatcaatgcaaaagaatttattccag

SEQ ID NO: 17240 - DNA, 507 bp, Glycine max
  Peptide Sequence Number=SeqID_108925
atggaagttttatacacaaaagttagtcgtattgatcgactaacaattgcccaatctaactcttgcagacttaggtttcctgctttgattatcgctttatgccgagcccgaggggttgtctctaacagcctcacatttgagcgcctgagcccggccattaacttggcctacatcaggaagaactgttggaacgttgatgatctaacagttgctttccggggggctaagagggcgagggcaaggccagctgatattccatctacttctgcagctccagcacctactccagcatctacttctgcagctccttcagtcccagctcatgttgactatgagcgctttaaagccatgcttcaaattagtgtcgcaacctacccttcggcgggagggcgacgcgggactcacgggatgcgtgttccacaaaaggaatacgcgcggagtcgccaccaacgtttatttgaggaaaacgtcggaaaaaccggaaaaggcgcgatctacgaactttaa

SEQ ID NO: 17241 - DNA, 351 bp, Glycine max
  Peptide Sequence Number=SeqID_108926
atgggtctgggcaaggacagccacgggaatgccgatgtggtcgacatttggggtaacccatacaaatatgggttagggtatgaacctgggagaccgggaagaaggaatgcaccgtcaagactccgggcagatagggcatggcccggtcatgttagccagtgtttcacaagtgccgggacaatgttcgaggaagaggtggcggcaataggagaggaatctccacaagatccaacaagtttcgtatgcgagggtcgattctttgaggatcctaacaacgagggtttgataatcaattttgaccgagaagtaagtctaacgatgaatgaaggaggggaagaggatgtcctttaa

SEQ ID NO: 17242 - DNA, 147 bp, Glycine max
  Peptide Sequence Number=SeqID_108927
atggcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 17243 - DNA, 484 bp, Glycine max
  Peptide Sequence Number=SeqID_108928
ttacaaaagtatatcctcaacagcattaattgggacgccagtgcctgagattgaagggttggttcccaccacaggattaagtccattgatcgggtgtttagttgtaactggcgatcctggacttatatccacatttgtggagaggtggcacagggagaccaacaccttccaccttccagtaggagagttgacgatcacactggatgatgtgtcgtcactcctccatctgcctattagtggcgccttccacagctacgaggctctttctgtggacgagacaatatttttgttgatggagttgcttgaggtgtccggtgaggaggctagagccgagataaggcttttcgcgacctgggtcagagtgggggctatgcctggggagctaccgcgctgtgtcgcatctaggagcactttccgagtgtgcatcagtgcgtcatcgatgatgcgtatgaggagacgtccccacgtgccgcccggtggctga

SEQ ID NO: 17244 - DNA, 207 bp, Glycine max
  Peptide Sequence Number=SeqID_108929
atgtggtaccatgtcagtgaaaaaccaccctggggcgctcaaaagtcactctcactaagtaagatcatagggagaccagtcagggtcacgatgttttgcaagaatgctccaaccatatgggatcagcataggcttaaaggagcactcaaacctggtgacccccaaggcctacacttcaaagagtccgtcagggcctctccctcctga

SEQ ID NO: 17245 - DNA, 48 bp, Glycine max
  Peptide Sequence Number=SeqID_108930
atggaagaggcagagaaggagattttggaaacatttagaacagtagag

SEQ ID NO: 17246 - DNA, 444 bp, Glycine max
  Peptide Sequence Number=SeqID_108931
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagccgcaaatgcttga

SEQ ID NO: 17247 - DNA, 222 bp, Glycine max
  Peptide Sequence Number=SeqID_108932
atggcagataccacttctccacagcaggcagcagatccttcaacgcctgaagatcaaaccacactagtccagtctccgaatgcctctcttgtatctactcccgtactgcatttgactgacgaggaggagtatatgtcataccctaatttcgcccggggaccatccgttaatgggatgcgaccctcgtttgaccacttcgaggtacttggcacccatcgttag

SEQ ID NO: 17248 - DNA, 413 bp, Glycine max
  Peptide Sequence Number=SeqID_108933
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccaccgcatcacacagaagagcttgaccctgaaaaactggaggagcaagctactgtattggagaaagagctgatcctgaaagggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 17249 - DNA, 414 bp, Glycine max
  Peptide Sequence Number=SeqID_108934
gtggagggcaaagaaggcctccttctgggggggccagagccatcagtgagataccactctggaagagctagaattctaaccttgtgccaggacctacgggccgagggacagtctcaggtagacagtttctatggggcgtatgcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 17250 - DNA, 231 bp, Glycine max
  Peptide Sequence Number=SeqID_108935
atgcttattagcatgctcaagaagtacacaaatggtagggacttggttagaccagttctgaggagtgaaaaaaaaaatgtatccatatgcctcaaagctgctgcccctcttatggtagtccttcgattggtggattctgatcaacaacctgccatgggtttcatatatgttgagatggattgtgcaaaggaaaggattaaaagtaacttcaataatgtgaagaaaaagtaa

SEQ ID NO: 17251 - DNA, 252 bp, Glycine max
  Peptide Sequence Number=SeqID_108936
atgcagaaaggtctttggaccagacaatatctgaacaatacagaattgtcactgtcataccctaatttcgtccggggacctttgcttgatgacatgcgacctttctttggtccttcacccaggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 17252 - DNA, 207 bp, Glycine max
  Peptide Sequence Number=SeqID_108937
atggtttttcacttaaggcttgtaatgagcttcaaaataaagaaaggggaacataggctcaaaggggctatcaaaggaattaattcaaggcatgtgaagaaggaagtattaacaagagtcaagccaaggctattgtgcaagcaatcaatggggcaaaacacatcgaataaaatagatgatgatggctcaaattctcaccaagggtaa

SEQ ID NO: 17253 - DNA, 366 bp, Glycine max
  Peptide Sequence Number=SeqID_108938
atgcctcagcccaacatcgtgggggcttctcaacaccgcccattgcaacctctacgcttctccgtggggagattgcctccgtcagtggaaggaagggagaaatgggagctcatcgaggagaggctaatggccattgaagggtttggtgactacccgttcactgacatggcaaagttgtatttgatgcttgacgttgtcattcccccgaagttcaagatgggtgcgtacttcagagatgagaagctgttaatgcatttcttccaagagagtttggccagagcgatggtcacttggtataccaatttggaggcttctcggatccactcacggaaggacttgattactgccttcattaggcactactag

SEQ ID NO: 17254 - DNA, 534 bp, Glycine max
  Peptide Sequence Number=SeqID_108939
gtagctgtgtctccggcaaaaccacctccgaagcccgatccggaggtcgatgatccactttatctgatgaaattgaccatcccagagcttttcttgaggccttatcaggttagatgggatgccaccgtgttcgaggtctttaatctagatttctccctctacataaagcacgaagacctctccgaaatcgcacacgatggtcaacgtctcaacatatcagtgttacagttgtggattctgccagacaactaccttaaggggattataaatagtgctatcaagggtcttgatgatgctccacagcctaaatcaaaggcttctgctaggtggattgtcgtcaagtgtaatagacaaaaaggaagtactgagtgcggctactatgtgatgcactggatgtccaccatcattttaggaacttttaggaataattgggaagcgtattttaacgatcctagaccattggagccagagagattaaaagcattgcggatccagtgggcacagttttatcttcgagttagagatcaggcctag

SEQ ID NO: 17255 - DNA, 279 bp, Glycine max
  Peptide Sequence Number=SeqID_108940
atgattggggatcttggacaagaatatgttcagcaagcacatgcccctatgtatgaaacattgcaaagttattcgaagaagccttttgtattcggggtgcaagaagtctttgtcgttgttgtcagtggtgttaagtctggtggtgcaagatacgcttccaaaggaaaacatgttgctaaaaagttactatcaggggaagaagatactgtgcccaatgggtatgaagatgatgacgagtgtagcagtgatgaaagccccaagaaagaccccctagcgaag

SEQ ID NO: 17256 - DNA, 312 bp, Glycine max
  Peptide Sequence Number=SeqID_108941
atgacagtcaaggaattcatttgcaaagatggaccctgggatctaaataatttggagcaactgttgcttagacctctctgtgaggacatttccttgttgaatcctccaaaggatgatgctgttcctcttttcggttccatttggaggtggaagggcaccaagagaatgagaccgttgatgtggaagattgttaacgttgatgtggcgattagatcatctgacaatgaggttgcgtgcagtggaattgttcgccatcatcatggtaatttcttacatgattttatggcagacttggactgtgttctattctag

SEQ ID NO: 17257 - DNA, 420 bp, Glycine max
  Peptide Sequence Number=SeqID_108942
atgccatccactatttgcagggatcgcgcccgcaagacaccatgtggacccggagaagtccagcagggccctgaggtttccaactctgggattgcacccgcaagacacccaggggacccggagaagtccaacagggtcttggggtttctagctctgattaagggcctttgtcagttctatggagtgcccgtcgccctcaacaaggtcatcaggccccctactaaccaagctttcatcaagaagtactgcacccccaagcaggcgcagggcgagacaccacagcagccaagggatggccggcagtgggcaacagacacaccgccgccacctccaaatcccctcagctcatctacaaaagctagagtgttgcctatgacccgtggtcgaccagtagacgaccaagtccaaagccaaaggtaa

SEQ ID NO: 17258 - DNA, 170 bp, Glycine max
  Peptide Sequence Number=SeqID_108943
atgcacacatggctcaggaggagggtacttccagatttcagatacctgagccatctcctacacctgctcctgaggagacccagccatctacaccagtcacggagccagagcagcctatccaggattcatcagcagctccaacactggatcttaatgaagatcagccatag

SEQ ID NO: 17259 - DNA, 156 bp, Glycine max
  Peptide Sequence Number=SeqID_108944
atggctgaagatcaaccaagaagagtgacccttgaagactactctagttttgttgtgccgcaattctttactagtatagtgcggccagagctatacaaggcatttatttcatggcctaccgatgagacccatatgcacactggccgcttacattga

SEQ ID NO: 17260 - DNA, 201 bp, Glycine max
  Peptide Sequence Number=SeqID_108945
atgcgtaaggagtatataccgcatcaggcgccattcgccattcaggctgctcaactgttgggaagggcgatcggttcgggcctcttcgctattacgccagctggcgaaagggggatgtgctgcaaggcgattaagttgggtaacgccaggggaataaccaaggaagatgccctcatccaccttagcatcaaatttacctag

SEQ ID NO: 17261 - DNA, 237 bp, Glycine max
  Peptide Sequence Number=SeqID_108946
atgtcggagctaagagaaatacccttcgcaccggagaaaaaggaatcacatgaagacagtacaagtggagacttcaatcacttctccgtctctctaacgtttgggaactctatcagagcagttggaggaaaaaccgaaggaattttaggaaacgctagagatgccgctgtcactgtcggaagacacatgagtccgcttagaggttatgaaatgatgattcaaactgtgcgtatgtga

SEQ ID NO: 17262 - DNA, 423 bp, Glycine max
  Peptide Sequence Number=SeqID_108947
atgaccactcttacacaaatatggatgacgttgctacttagcaacattccactcggcgaccgcaatgccgatctccccctgcggaaacatcagttggatcacacccgcaagacacccagtggacctggagaagtccaacagggccctggggtttccagctctagttacgggcctctgtcagtcctacagggtgcccgttccccccagcaaggtcacgccatcctaggggtagcgcctacaagacacctagtggacccgaaggagcccaacagggccctggggtttccagctctggttacgggtctctgccagacctacagggctcctgtccccccagcaagttcatcccatcgtgacatagggaccgcgcctgcaagacaccctgtggacctgaagaagtccaacagggtcctaggtttctag

SEQ ID NO: 17263 - DNA, 632 bp, Glycine max
  Peptide Sequence Number=SeqID_108948
ttggaacctcttacgtgccgatcaacgtctcattttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 17264 - DNA, 693 bp, Glycine max
  Peptide Sequence Number=SeqID_108949
atggagaatcaagaggagtgggtcccgtttgcggatatactagctttgctaattgttggggttgtcctctttccaaacgtggacggtttagtggacctagccgcgattgatgctttccttgcatatcaccatagcaaggagagcccggtggtagctatcttggcggacttatttgatacatttgaccgaagggggcagaacaatcaactggtttcctcgatggaaggaaggaaaggagggagttctcttctcatgtgggggctaccccaaacaaggacgaggggttgtattaactacaatcccgcactttctataagacagttagggtaccctatgaggggagcaccgacagaagagagcctctcgcctttccttgtgagagatttcggcgcgcaaagtttcaagattgtacaaagggtccgcaaggcgtgggaaagcccgttaaggaaagataaagaacttaaaggcatccgtaatggcgtcatcggtgggtatcatgaatggctaagagttcatacacgaggattagattggctctccaagttgaaaattatcaacgaggagaacttcgaagctccggaagaggatgaagaagtccaagctctaaaaacagagctaggaaaggcaagactcgccaaagaaaaattcaagttagccgctacagacatccggaaagagtgtgccgagttatga

SEQ ID NO: 17265 - DNA, 423 bp, Glycine max
  Peptide Sequence Number=SeqID_108950
atgcggctcgtgcttgccgatatcgacgcccatgccggggatgcatcgccagaagcggatgccatgcgcctcggttttgccgaaacctatatgcgccacgccctgtcgtgtcttcccgccaatggcgatgtctggctgcgcctcgccatggttcgctcgttgcgcaacgcctctgccatggaaatcgccgtgctgacgaatttctcccagctttatggccccgccgatgccaatctgatccgcgggcgcttcgtcatctggcaacaatttaccaaaggcgccctaccgcaggctgaggcggcccgtgaagccgacaccgcgatcgtctgcggcaggcagggcgaaatattgcgatggtcgttgcggcatgtctgctcccaggagcttcagaccggcatgcaaagcgccaaaccacggccctga

SEQ ID NO: 17266 - DNA, 57 bp, Glycine max
  Peptide Sequence Number=SeqID_108951
atggttcaaggaaaatttgtcccaaatttgggggaggtattatcaagggaaagctaa

SEQ ID NO: 17267 - DNA, 354 bp, Glycine max
  Peptide Sequence Number=SeqID_108952
atggtagctacggcttaccaaacctcccatgaatgtttagaagagaccattatagatatcttagtggcaggattttctggacaactgaaaggatgcgcagttaagacggatctcaatggaaaagtcattactaatgacgatgataaagagattcctgacgctgttaacacattaatttttacaatagcccaacatttcattggagacccatccttgtggaaagatagaaccttagcggattttaggtggtatagagatactttcctaactagggtttacacaagagaagatagtcaacaacctttttggaaagaaaaatttctagccggtcttcccagatcattaggagacaag

SEQ ID NO: 17268 - DNA, 1287 bp, Glycine max
  Peptide Sequence Number=SeqID_108953
atgacaataaatccacagcccctcgaaacgatcgaattcgcctcgcgcgatgagattgaagcgttgcagttggcgcgtctgaagtggacgctgcaccacgcctacgacaatgtgccgatgtacaagcgcaaattcgaccaggccggcgtacaccccgacgatcttaagcagctgagcgatctggcgcgcttcccctacaccaccaagcaggatctgcgcgacaactacccgttcgacaccttcgcggtgccgatggaacaggtggtgcgcatccacgcctcctcgggcaccaccggccggccgacggtggtgggttacacccagcgcgacatcgataactgggccgatatcgtcgcccgctgcctgcgcgccggcggcgccaccgccaaagacaaggtgcacgtcgcctacggttacggcctgttcaccggcggccttggcgcgcactacggcgcggagcggctcggcgcgacggtgatcccgatgtccggcggccagacggaacgccaggcgcagctgatcctcgatttcaaacccgacatcatcatggtgacgccgtcctattgcctgacgctgatcgacgagctggaacgcaagatgggcggcgacgcgcgcggctgctcgctgcggctcggcgtgttcggcgccgaaccctggaccgaagccctgcgccacgaaatcgaaacccgcatgggcatcaaggcgctggacatttacggcctgtcggaagtgatggggccgggcgtggcgatggagtgcctagaaagcggcggcggccccaccatttgggaagaccacttcctgccggagatcatctgcccggaaaccggcgtcgccctgccggacggcgagcacggcgaactggtgttcaccaccctgaccaaagaggcgctgccggtgatccgctaccgcacccgcgatctcacccggctgctgccgggcgacgcacgccagatgcgccgcatgggcaaaatcaccggccgctccgacgacatgctgatcatccgcggcgtcaacgtcttcccgtcgcaggtggaagagcagatcatgcagttcgagcagctgtcgccgcactatcagctgcaggtcagccgcagcgggcacctggacacgctggcggtgcgcgtcgagctgaaagaatcggcgctcagcctcagccaccagcagcgttgcgacatctgccaccagctgcgccaccacatcaaatcgatcgtgggcgtcagcaccgacgtcagcatcgccaactgcggcgatattccgcgatcggaaggcaaagcgcagcgcgtg

SEQ ID NO: 17269 - DNA, 297 bp, Glycine max
  Peptide Sequence Number=SeqID_108954
atgtttacatcaggaagccttcgtaacagccaagagaagaacaagatgaaagattgcaaaaagactagtggggaggatgtctccttccccacgaggttctcccgaccactcataaactcatctcaagctctcaaactagctcctacttcaagctctggtctctgcagatcttcgcacaacaaaatctctcaaaactctctggaacttggacctttctctctagaaaccctagacatgcaaagctctgaatcccagtccaaaactcccctcacaaaatctgattttaggattaaatag

SEQ ID NO: 17270 - DNA, 295 bp, Glycine max
  Peptide Sequence Number=SeqID_108955
atggagtcgtacgtttttgccaatgccggtactgaaagcagctatgggcgtgccgcgaaaccaaaagtatacagtggcttacccggaaatgacaacatggaccctatcggccaagcaatcgtaggtctagttccgctagctctatctcgtactggccagctagctacctcccgagctcgttcctggagagatgcgggaggagcagtagtaggacatccgaggcgtggagagggcaacaagtctactaagccgagtagtacagagcgggctggagcagtagtagtggcagtcaagg

SEQ ID NO: 17271 - DNA, 522 bp, Glycine max
  Peptide Sequence Number=SeqID_108956
cttcacgtcatcaatgatactccagtggctgtccaacgtcacttccaaccttgttgagcttgaccttagtggtaacctcttggagggttccacatcaaaccattttggccgtgtaatgaattctcttgagcacctcgacctctcatataatatattcaagggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacg

SEQ ID NO: 17272 - DNA, 189 bp, Glycine max
  Peptide Sequence Number=SeqID_108957
atgaagaatctaatttggtgctcaactgggaaaaatgtcactttatggttcaagaaggtatcatgctgggacacaagatttctagaagaggaattaaggtggataaggcaaagattgaggtgttgtgctgggacagcgaaagggcagaatttttcataccatttactatgccagcaaagtcttgaatga

SEQ ID NO: 17273 - DNA, 657 bp, Glycine max
  Peptide Sequence Number=SeqID_108958
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17274 - DNA, 154 bp, Glycine max
  Peptide Sequence Number=SeqID_108959
atcagttcagggcagaggtcgcatggcccagagattggctgaggcccaggcaggggaggcgcccgcagaggctcccggtgatgcagatgaggcccgcatggatgaggagatgacgaatttactcgatttcttgggagggagcggagccacatga

SEQ ID NO: 17275 - DNA, 348 bp, Glycine max
  Peptide Sequence Number=SeqID_108960
atggtcgtcattgtcaatgcggaagcttgtggttacatgagcatgaactactaccaatatatagatgttgtttatacaaacgagcacatcttaaaagcttactccgcacaatggtggcctcttggaaatgaagcggctattcctcattctaatgacgcatggacacttatccctgacccaaatacaattcgtgccaaaggtcggccaaaatcaacaaggataaggaatgagatggattgggtcgaaccatttgagcaccgacaaaaatacagtagatgtggagccgaagggcataacaggcgtcgctgtccaatgcaatttgagcgtggaagttgttcaaatcattga

SEQ ID NO: 17276 - DNA, 180 bp, Glycine max
  Peptide Sequence Number=SeqID_108961
atgactctaagacaacatgaatcaaagcttggaggccttggatcttcttcaccaatggagtcctttgcttctagaagatcagtgacagcagaatggagaaggaggaaaggtcattggagatgccacttcaaggagaagatgagtcaagaacaagctcaccactatagaagccatggataa

SEQ ID NO: 17277 - DNA, 471 bp, Glycine max
  Peptide Sequence Number=SeqID_108962
atgaccatgattacgccaagctcgaaattaaccctcactaaagggaacaaaagctgcatagaacatagggagatccaagttttcaacggtgggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17278 - DNA, 195 bp, Glycine max
  Peptide Sequence Number=SeqID_108963
atggataaccatcagcatagaaatcatagtgatccaacacaagccaggataaagaaaaaagctaatattcctgattcatcagaggatgagagttttgaatcaacacaaggctctgcttcagtttcttcacctgaaaatcaaaactatatgtcctcagctaatgagcctgcaattaatagagaaggtaacaattaa

SEQ ID NO: 17279 - DNA, 295 bp, Glycine max
  Peptide Sequence Number=SeqID_108964
gggaacggatcactcattcttccattggggacaggtgcacgaacgacaactccaaacgtcacacatccgtcgcctacttaccgtttaggtggcaccagcgatatccagctaagccgcatattgagcgcagcggatatgcgggatttcagttggatcagatctttcgctttgacggaagcttttggacctagcgaaaaggactttataagccttcgcgcaagcaagcgcgagagaagcaagcaaagtcgaagctttgccagaagcaagacgaggaagcagagctgtcgtataagcg

SEQ ID NO: 17280 - DNA, 276 bp, Glycine max
  Peptide Sequence Number=SeqID_108965
atgtccaatcaaaagagcaccgagtcagccatcaagaatctagaagtccaggtgggacaattggcaaagcaattggaagatcgaccgtcaagcagctttggagccaacacagagaagaatcctaaggaggagtgcaaggctgttatgactagaagcaaaatggtgagcataaatgaaggtgagaagaggatatgtgaagaaaaacaacagctggtgactgaaccagaaattgacccagtggtagaacctttgagtgagactgaggaagaagtgtga

SEQ ID NO: 17281 - DNA, 576 bp, Glycine max
  Peptide Sequence Number=SeqID_108966
atgtgccctcctccgtcaaaggtcaacactaaaggtgcaccaaagaaatcaatgaaaagaagtcaaagatccacaaagcgtgatccatcttactgtgagtatattgatgcttttcattttgttcaaagcagcaactcttcagtgaaacgtagtgcatcatcttctgaaccgccgaagccaacaaggatcatcccgatgttggatcaatttgcgccatttatacaggatttcattcacaacgttgtggatgtgaaagcggacggtaactgtggatatcggtccattgtcggtttattagagagatttgaacaattaaggttgtccctacttgttgatgggtttttcaaggttagtgtggacaagtggatggatataacggagatgggatatgtcattccatcacggtataacatttatttgaaagaccattgtcctttaccgcctttagcgttgttgtggtcaaccaattgttattctcaggcaaagcagtggccaacttcatatgttagtagaatgcagcagtacacaagcttgatgtcattcaaaagagactatgtcgacctaaatgaagactga

SEQ ID NO: 17282 - DNA, 192 bp, Glycine max
  Peptide Sequence Number=SeqID_108967
atgttggtgcgcatgatccacactcgtctctttgcagcggcacgggtgaaattttgccccggtatacatagtagctgcgtgatagcctccctctctggttgtgcttgcacagttggtcgccctccaatatcagggggcgagggcatgcagccctctgaagttcaggacgtgtcgccttttgaaggcgagtga

SEQ ID NO: 17283 - DNA, 156 bp, Glycine max
  Peptide Sequence Number=SeqID_108968
atgtcaaaaggggtacggaaacaaagtgagggaggagcttgccacccagctcgcccaggcgagctaggttgcttcctccagaaggcaccgccttctagggaacttcctggaaggcccaagtgggcctggttgctatttgcaccccctggttactaa

SEQ ID NO: 17284 - DNA, 81 bp, Glycine max
  Peptide Sequence Number=SeqID_108969
atgggtcttaaatttcatgatgatccaacggtgaatgagtctgagatcatcgttttattgagacagataggatactcatag

SEQ ID NO: 17285 - DNA, 438 bp, Glycine max
  Peptide Sequence Number=SeqID_108970
atggcaaaggggtgcggaatgaccaaattttgtctccgcgtgtcatcgggcccgccgcctctggatgacaaagggtgcagaatgaccaatttttgtctctgcgcgccatcggacacggttgtgtctgaaatggcaaaggggtgcggaatgaccaaattttgcttccgcgtgtcatcgggcccaccgcctctggatgacaaagggtgcatgaatgaccaatttttgtctctgcactgccatcggacacgactgtgtctgaatggcaaaggggtgcggaatgaccaaatttgtctccgcatgtcacatgacctcagggggtctccgcggattaccaactcttgggtcatggcaacaaaaggtggtgtggtcgacaaaagcgaggctcttgctcctacgtatcctccaatgaggaactcagacctacgtagttctggataa

SEQ ID NO: 17286 - DNA, 752 bp, Glycine max
  Peptide Sequence Number=SeqID_108971
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatgttatttctgttgtgactactaaggtcaaaatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17287 - DNA, 123 bp, Glycine max
  Peptide Sequence Number=SeqID_108972
atggccccctctctctacaggatactgggctgcctcgcagcgacgttctatgctcgtccagcgccgggaagggacgacgatcggttagtcgtgaccctatcctccatttgtgtccgtccctaa

SEQ ID NO: 17288 - DNA, 207 bp, Glycine max
  Peptide Sequence Number=SeqID_108973
atgctcagaatgatgcatgcacctgacctcaactctcagatgcaatacggtacgtaccgtatccaataccaaggaaatagactaagcgtgttgacacctcacttaggaaaccatgcagtattttgtcgaggccacccagtcgtgcaccgtaactccccccctccccccccggtgatcagcctgggccacaagggagttccctactag

SEQ ID NO: 17289 - DNA, 270 bp, Glycine max
  Peptide Sequence Number=SeqID_108974
atgcctaaattatctcccaacatgcatgtgaaccaagaagtatcaacaagagtcaagccaaggctattgtccaagcaatcaatggggaaaaacacagcgaataaaataaatgatgatggctcaaaatcttacgaaggagaaaaacaaggatttcaattcacaaaattccaagaaactcctatttcaaaaacaattacccattacctatacataaccaaaaattcaaagagaaacatgcaatgttgtacacaaaacataaaaccaaaataa

SEQ ID NO: 17290 - DNA, 249 bp, Glycine max
  Peptide Sequence Number=SeqID_108975
atggggggagttgcttgtgcacgacagggtgacctcaacacttactgcctagttttcctaagtgagagtgtcgtgtggacacacttgagctatttccttggggatggtaccacattgcatttgagagttgaggttagcaaagctttccaagttaattttgatgatgccaaagactcaagtcaagaatcaagagtcaagcaagtttcaagaatcaaagagtcattcaatcaagaatcaagattaaagtga

SEQ ID NO: 17291 - DNA, 172 bp, Glycine max
  Peptide Sequence Number=SeqID_108976
atggtttttcacttaaggcttgtagtgagcttcaaaacaaggaaagggaaacaaggctcaaaagggctatcaaaggaattaattcaagaattaagccaaggctatgtgcaagcaatcaatggggcaaaacacaccaatgattatatgatggatggctcaaattctcacaaag

SEQ ID NO: 17292 - DNA, 773 bp, Glycine max
  Peptide Sequence Number=SeqID_108977
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggccggtgctgtcttcaacggtgtagctgattggggtcggatcgcctttaaagtctgcttctggggtaaaggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17293 - DNA, 165 bp, Glycine max
  Peptide Sequence Number=SeqID_108978
atgtttgggatggaaaatgctaaacacatggccactcctatgagcactgcctgctatctggataaagatgaaaccggtcagttaatagacataaagaaatatagagatgcaaaactgatagaaagagcactagtgaaacttgtcattttattggttccgctctag

SEQ ID NO: 17294 - DNA, 334 bp, Glycine max
  Peptide Sequence Number=SeqID_108979
ccagcatcaattagaccttgcaccttacgcttcagagccctacaatgctcaatggaacgctccggggcttctccgtgacaagcacacgttgcgttcgaatcgtattctcggagaaatggaggttgatgaaccttggctggggctttttcactgcaaaattcatttcttggttggtgttttggtttatgctaaagggatggcctttgtggatgactgggtggtgggtaatgagaagggttgttattggctgagtaatgacattgttgggttggtgggaaacttggtcactcactttgatcctttcgtcggtgaagaccatatcatcaaagcttga

SEQ ID NO: 17295 - DNA, 423 bp, Glycine max
  Peptide Sequence Number=SeqID_108980
ttaccctcaacgttgagaggactacacgccctcgccttgagaggactacacgtcctcaccatcagggggttgccacgccctcacctccagagggctacatgtcctcgccttgagagggctaacacgtcctcaccttgggtactagttaccctcacctccagaggactacacgtcctcgccttgagaggactacacgtcctcaccatcagagggctgcacgccctcacctccagaggactacaagtcctcgccttgagagggctacacgccctcaccttgggtactagttaccctcaccgtcagagggctacatgccctcaccttgaaaggactacacgtcctcgccagcagagggctgcacgccctcacctccagaggactacacctcctcgccttgagagggctgcacgccctcacctttag

SEQ ID NO: 17296 - DNA, 573 bp, Glycine max
  Peptide Sequence Number=SeqID_108981
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattagaagattcctccagaaggctgttgcttctggaggaagcaaccctgctcgcctgggcgagctgggcggcaagcatctcccctattttgctataaataggggaggaagtgaagtggaaaaggccgacgcgcttccgaaacgtttccgtgaggaatttcgcgaaggttttcgaccgttcttcgacgttcttcattcgttcttcatcgttcttcgatcttcaacgg

SEQ ID NO: 17297 - DNA, 809 bp, Glycine max
  Peptide Sequence Number=SeqID_108982
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccctggtctgactcgtcgcctgagtggacagataggataaagcacaagctgaagcatgttccacagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17298 - DNA, 292 bp, Glycine max
  Peptide Sequence Number=SeqID_108983
ggcccgtaatatccagctgaaacgagtctggatattagagtacattgagcaactgaactggaaatgcctcaaaaatgttctttacgatgccattggagatatatcaacgggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 17299 - DNA, 449 bp, Glycine max
  Peptide Sequence Number=SeqID_108984
ggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 17300 - DNA, 143 bp, Glycine max
  Peptide Sequence Number=SeqID_108985
atgatgacaaaggtgatgacagatcaatcaaagaacaactcaagtgatcaagttagaatcaagaacaattcaagagttcaagatagaatcaagaagaattcagacacaagaggaaagttaagagtcatgaatcaagattcaag

SEQ ID NO: 17301 - DNA, 297 bp, Glycine max
  Peptide Sequence Number=SeqID_108986
atgtatgaatatcctaggagaacccgtgccttaatgagtaatcattcatttccaaattcatatggatgttcatgctttgttggaaaaaggaaatgcctccgaagaaactctccacgaagaggtctagaagagacgccgcagcggaagggtccagtgccacccccgagtttgatagtcactgtttccggagcgccgagcactagcagcgcttcgaggccatcaaaggatggtcgttccacagagagaggcgcgtccagctcaaggaggatgagtatacagactttcaggaggagatag

SEQ ID NO: 17302 - DNA, 477 bp, Glycine max
  Peptide Sequence Number=SeqID_108987
atgaccgctaggaaatgcaagagtatcgattcaagacccacggttcaatatgatacaaggatatttcactccttagatgcatggaaccgatacacggataatgtattggggagaaacatcttgcaagagaggaaggtggagctctaccacactgagtttgatgattttaagactgagttgaaaaggtgtaatctccataaacgccttaccaatttggttgatgggagcatagatgtggctttggtgaaagagttctatgcaaacttatacaactccgagggtccttcaccaaagcaagccagggtcagaggccatctagtgaagattaatgctgacagcctcaacacattcctagagacacctgtggtgttggcagagggtgagactttgtccacatactccagatactgcaggttgcttcaaatcctagggagattgaggctgctctatgcataccaggccgagggttcatcttga

SEQ ID NO: 17303 - DNA, 201 bp, Glycine max
  Peptide Sequence Number=SeqID_108988
atggagattgttccatggtggggtaaaaataacagaggtagggctttcactgggatgaatgtgaaatgggctagaaggttgctggatggggtcgataaaaggaggaggggggggggggggctcatatatcctaaggtctcatatatcctaaggttaggattatggtcttcttcttttggacatcaaacccttggagcataa

SEQ ID NO: 17304 - DNA, 441 bp, Glycine max
  Peptide Sequence Number=SeqID_108989
atgggtgaagtagaggaggtacaagaggagatgaaggccgacatggaggccatgaaagagcaaatggccacgatgatggaagccatgatgatcatgaagaagataatggaagccagtgcggttgcagttgccgctaccagcactgttgctaaggtgaacccgatgcccccatctggcctcaaccaaatgaatcatccaacctcagctatggtaggcaaagatttgggaagtatgggcggcccccatgatgtgcaaattcaaaacgagcacgccttcccgccatatggcctggctcccaactatacaccacccaatacactcccaatgaggatgtcaataactccactcctatacccattgagagccaacaaccccaaactgatcatgcacatgtctcttaaaccgtgggggagacacatgaaattccccaccacaatctag

SEQ ID NO: 17305 - DNA, 276 bp, Glycine max
  Peptide Sequence Number=SeqID_108990
atgaaggatgcaggtgaagagcaggttagaccagagattgccaccactcctgagagatctcttgaaggcacttcagagccccctgctccagtggtagacctctcctcaccacagcctgcagctgacccctctactcttgtagttgatacgccagaggaccagaccacaccagtcctgactctgaacacttctcctccagctactccagtacttcatctgacagatgaggaggatgttcagactcaggatactcaggatctatctcaagacttttaa

SEQ ID NO: 17306 - DNA, 411 bp, Glycine max
  Peptide Sequence Number=SeqID_108991
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggcagttcgctccaagctggactgtatgcacgaactcccccgttcagtctcgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 17307 - DNA, 315 bp, Glycine max
  Peptide Sequence Number=SeqID_108992
gattgtcatcatcaaaaagggggagattgtggaagcaatgacttccaagattattttgatgatgccgaagaatcaaaagttaagcaagttccaaagaatcaggagtcaaaaaagcttcaagaatcaagttttaaagaatcaagattcaagaacaatcaagtttcaagattcaagattcaagattcaagaacaatcaagtttgaagaatcaagattcaagtacaatcaagatcaagattcaagactcaagattcaagaatcaagagaagactcaatcaagataagtactgaaaaagtttttcaaaacattgagtag

SEQ ID NO: 17308 - DNA, 210 bp, Glycine max
  Peptide Sequence Number=SeqID_108993
ggtaatgtttcacagtttaatgaatcttctacctatttgatgggatggttaagagattatctatggttgaactcttcacaacttatcaacggatataaccctttggaattgattgaaactttagcatgggctcatgaacgcacacctttggctaatttgattcgatggagagataaaccagtggctctttccattgtgcaagcaagattg

SEQ ID NO: 17309 - DNA, 165 bp, Glycine max
  Peptide Sequence Number=SeqID_108994
atgggacgaatcgctaggtggcaggcgataaagggaagcgcattggcagattatttggcccaacaacccctccaagattatcggtcgatgcaccctgagtttccggatgaagacatcatggccctattcgaagagaagcggacgcacaaggatatagacaaatag

SEQ ID NO: 17310 - DNA, 533 bp, Glycine max
  Peptide Sequence Number=SeqID_108995
atgggacctctccaaatgcaagccttccgcaaggcgtacggaaagattttagatttgaccttagcagagatatccacagaagccgttgtatcactcacccaatactatgaccggcctttgagatgcttcacgtttggagacttccaattagtaccgactattgaagaatttgaggagattctaggatgtcctcttgggggaaggaaaccctatcttttctctgggtttcttccctccttgagcaaaattgcagttgtggcgagaggattggatcgtgtaaagcaaactcgaaacggcgtcgtgggcctaccacgaaagtacttagaaggcaaggcaagggatatgacgaatcaagaggagtgggtcccgtttatggacgtattagcattgctaatctttggggttgtcctctttccaaacacggatggtttggtggacctagccgcaattgatgctttccttgcatatcaccatagcaaagaaagcccgatagtggctatcttggtggacttatttgacacatttgaccgaag

SEQ ID NO: 17311 - DNA, 238 bp, Glycine max
  Peptide Sequence Number=SeqID_108996
atgcatatcttacgggacacagtcggacattcgacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 17312 - DNA, 474 bp, Glycine max
  Peptide Sequence Number=SeqID_108997
aattgcatctcaaaattccgcgagaggcgggctaccattaccgccccccccccctcccctcccgctccaagagagcccgctgccgtgttgtcgcctctgacacccgcgacccccctcctcctccgcatcgaaaacgcaccccggaaaagtaaacaaacacgcaaagccctccgccgtcccggtcagcccgcccgggtcagccctagggggggttggttactgagggtgggggcgacagtcgagcgcagctccccccccccccctcaatttcctcttcccccagcggcatccggaaggccttccccttgtgagggagggaggggggctgaactgaacagcagggctaggaaggtggcggcggcggcgtctggggagaccggaccgccacgtcgcagggcctcgctcgcccgcccgctccggggtgtcggcccgaatgacacggagggttgttggtcgatggctggcggggcgcgg

SEQ ID NO: 17313 - DNA, 345 bp, Glycine max
  Peptide Sequence Number=SeqID_108998
atgttggtgcgcacgatccgcacttgtctctttgcagtggcacgggtgaaatcttgccccggtatgcatagtagctacgtgatagcctccctctctggttgtattcgcacagttggcgccctccaacatcaggggatgtggagccctctgaaagtgaggacgcgtagccctctaaaggagaggacgtgcaacactctaaagttgaggacgtgccgccctttgaaggtgagggcgtgcagtccactgaaggtgaggacgtatagtcctctgatggcaagggcttgcatccctctgaaggcgaggacatctagtcctctgaaggtgaggatgtgtagtcctctgaag

SEQ ID NO: 17314 - DNA, 210 bp, Glycine max
  Peptide Sequence Number=SeqID_108999
atggaggatttccttgagggtcctctcttaggcaatcatggaacacagctccaactcgaaaatgtaggacacatgaatgacaacgcattcattcatgtggctccggaaaagatgagaatgaaggattgccttgagggtcctctcttaggaatcatggaacacagctccaaactcgaaagtggaggacacatgaacagccctaaccaataa

SEQ ID NO: 17315 - DNA, 372 bp, Glycine max
  Peptide Sequence Number=SeqID_109000
atgatataccacttttttatagtgccttacctctcagcttcgcaagccctatggggtatgggtatgggtagtgtgcataacttcgttatgcacagtatccgttgtggtttctcttacgggggtgttagttctctccatatgtgggaattgcctggtacccctgttactttcggtttcgcgtggcaagctacaccaatttctagaccagttaaagcaaaaaccaccgcaaagggaagaaccgacgccaccgttaatattcccccgacagaaagcatggtccatgcgaaaccacttaagattttcactaaggtgtgtccagccatcatattggcgaataaacgcacccccaaactcacagcacggaagcaataa

SEQ ID NO: 17316 - DNA, 168 bp, Glycine max
  Peptide Sequence Number=SeqID_109001
atggccaggaaaggggcgttgaggaaagaattaatgagtttcaagaacctctggatttgtggtaaaatcctattcaagggggaggaaatgatgcaatcctaccccccaagggtattggatagaagactccggatagaagactccaagaagattgggccaaagatgtaa

SEQ ID NO: 17317 - DNA, 179 bp, Glycine max
  Peptide Sequence Number=SeqID_109002
atggctccgaaaaagatttccaagaagagatctaggagagatgccgcggcgaaagggtccagtgtcgcccccaagtttgatagccaccgtttccggagcaccgagcaccagcagcgcttcgaggccatcaaaggatggtcgttccaccgagagaggcgcgtccagctcaaggagaacga

SEQ ID NO: 17318 - DNA, 522 bp, Glycine max
  Peptide Sequence Number=SeqID_109003
atgtccaaatcttgtggatttgggatgaccggccctctcgatgagtcgatctcttgctttctcataagggtggacccttgggtacttgtacctatcacctttagaggactacatgtcctcgccatcagagggctacatatcctcaccattaccctcatcgttgagaggactacatgtcctcgccatcagagggctgcacgccctcacctccagaggactacctgtcctcgccttgagagggctacacgccctcaccttgggtacaagttaccctcaccgttgagaggactacacgtcctcgccatcagagggctgcacgcccccacctccagaggactatacgtcctcgccttgagagggctacacgccctcaccttggttaccctcaccgttgagaggactacacgtcctcgccttgagaggactacacgtcctcaccatcagagggctgaacgccctcacctccagaggactacatgtcctcgccttgagagggctacacgccctcaccttgggtactag

SEQ ID NO: 17319 - DNA, 633 bp, Glycine max
  Peptide Sequence Number=SeqID_109004
atgcccgtcagccagttcctgggtgacccgctagtgttggaggaaggccagcagtgcgagttcagccagaggaggaacagggctgacgggatcgacgaggaggccattgcccagctattatgcacaccggggcaggattttgcctggaccgctacagggaggcaggtgcgaattatgtgcaccaacaagaccaccttgacccagacgtggatgacattgctactcaacaatgtcttgcctagcaatcataactctgatctccctctgccgaagtgtcagttggtgtatgccacccaccaggcaccctctagaccagataagtctaacagggccctgggatttttggcattgatcacgggcctctgccagtcgttcggggttcccgtcacccccaacaaagtgatccgaccaccgatcacccgagccttcattgagaagtactgcacgcctaggcaagcacagggtgacgcacctcagggcgcggacgcaccgccaccacctcggcaggctgatccggcggagccactgggcatggagcggtatctacaacatttggttcgccagcaagcggccaaccaccgcggacaggtgcagatacacaagtgtctctacagtttcagccacagtcagtag

SEQ ID NO: 17320 - DNA, 819 bp, Glycine max
  Peptide Sequence Number=SeqID_109005
atgcttacttttatccccatcgtgatcgtcgtcgcgctgattgtggtgttcgccggcgtcaaaattgtgccgcaggggttccaatggacggtagaacgcttcggccgctacaccaaaacgctgatgccgggcctgaacctggtggtgccgttcatggaccgcatcggccgtaaaatcaacatgatggaacaggtgctggacattccctcacaggaggtgatttcccgcgataacgccaacgtcgccatcgacgcggtgtgctttatccaagtggtcgatccggcccgtgccgcctacgaggtcagcaacctcgaacaggcgatcgtcaacctgaccatgaccaacttccgcaccgtgctcggctcaatggagctggacgaaatgctgtcgcagcgcgacagcatcaacagccgcctgctgcacatcgtcgatgaagcgaccaatccgtggggggtgaaaatcacccgtatcgagatccgcgacgtgcggccgccggcggaactgatcgcctcgatgaacgcccagatgaaggccgaacggaccaagcgcgccgacatcctggaggcggaaggggtgcgtcaggcagccattctgcgcgccgagggggagaaacagtcgcagatcctgaaggccgagggcgaacgccagtcggcattcctgcaggcggaagcgcgtgaacgcgccgccgaggccgaggcgcgcgccacccagctggtgtccgacgccatcgccagcggcaacattcaggcggtgaactacttcgtggcgcagaaatacaccgacgcgctgcagaagatcggttcctccaacaacagcaag

SEQ ID NO: 17321 - DNA, 210 bp, Glycine max
  Peptide Sequence Number=SeqID_109006
atgacagtaccagaggctgaacctgctgtagctggcgatgagcccatggtagatgctgatgcacaggacaccggtgcagagattgacgcacaggataccgatgcagaggatgttgcagatgaggctgagggatttgctggtggacctagggactcatctgtgcttacggagtatgctgagcatgttgcagccagcgtatggtttggagag

SEQ ID NO: 17322 - DNA, 315 bp, Glycine max
  Peptide Sequence Number=SeqID_109007
atggagtggtttttttttatatctcacccattcatcatagcgacccaggcaggtgaccaactcagacatgcacctgccgcaaaccatgaggagtacatgcagccggccttcccacaggttccagtggcatttgaccccccctccacatgcagtgaagatgattacgacgggtatgaggcgatcgcagaaaggttggagcgtatgctcaaccataggatggtcactgcaggcacaaagttacatgatattatgcaagattgtctcacgatcgccagagggggtgccagtgcatatggaagtgtcagggctcgatag

SEQ ID NO: 17323 - DNA, 447 bp, Glycine max
  Peptide Sequence Number=SeqID_109008
agagggtcatgcggtagtttggatacacccagaccagtcctgctccacctgtcgattcatgggtgttgtttgatgatacacacgataggtggatgcactattcggaccatatggctgcaacatgtgacatctgtgttttgccagggcagtgtgccagtgactacatggactggttcttccgatccagagacagatattcgtccgatcacgaagccagcagtaccgtcgacatctgcaaggtcggatgtcgacgacccgagacatgcagtggaagcttgtgatgcgattgcgaaaaggttggagcgccatctcaacctaggggtggtcacgctaggcacatcgacacatgaggtgatcgaagaatgcctcaagattgtcatgagtgtcataaaagaccaactagtatatgttaggtctcgacgcaggcggcgcacggatcagtcgtag

SEQ ID NO: 17324 - DNA, 438 bp, Glycine max
  Peptide Sequence Number=SeqID_109009
atgacatacgaggtacgtagatggtggtgcctttgtcggggacgtacggatcagttacggattaacttgatctgtaatagatttacggatcaacttgatccgacagttgttatgggacacatggacaaagatcagtggatgtatgaaagtataatgtctgaagaagcggatatggattatcaaaataaagaagcatgtggtgtgaatgaaccacatgttgattgtttcgatgtgttcaatacttctcagcttcgttacaagccagtggttggaggagaaggctggatggtgaagttgatttgtgtagtgcataatcatgaattggccaacttattagttggacatccatatgcagggcaattgactaaagctgaaaaaacagttattgctgatatgacgaagtccatggtgaagccaagaaacattctgctgacttga

SEQ ID NO: 17325 - DNA, 416 bp, Glycine max
  Peptide Sequence Number=SeqID_109010
attttcaggagaatgatagatctcatccagcgcaagctgttgcagcccagatacgcacactgctatataaacatgaaggctgcacgagttctgtaccaagtccgggattgaagagttatttttgtgtggagttgatctctattgttcagagagcaatctctgtcaaatacaatctgcatgttctgaagcgtgatgtcgtgacatccggagccggagcagtttcatggtcttccaagaagcatccaatgctatttagttgtatgaaaatccagtatttcatggaaggaagcatcaagatgagttactgcagcactcagaatcaattggctaacataatgactaagccactcaaatgggaacagttcttaaaccttagaagcatgttgggcatgattgaagcatcagaagtaaactaa

SEQ ID NO: 17326 - DNA, 1068 bp, Glycine max
  Peptide Sequence Number=SeqID_109011
atggcacatagtgtttttgctaatgatattcaacaattgtatgatgctactcagaaattggtcattcttaaacaaactgatcatgacatggttgcctatgtttcaaaagcccaatctgtagtggaagagttaaaattatcattggaagccgataaacttgaagacataaagatgaaacttgctaatctatatacggtgttggtactacgtgagatgcatccagattttgatcatattcgtgaccaattgaaagtattgaaacttctgccatggtatctaatcgagagggacgaggtgatcgtggaaatcgaggaggatgagctggaagaggaggtcgccctcaatgttcttactgcattctccatcagtcctcttgtcctcatactcctcaacagaatggcattgccaaaagaaagaataggcatcttattgagactgctcggacattattacttcatgccaatgtacatgtccgacattggggtcttgataagcttgttgctcgagccatcaaatgtgttttccttggatattccaaattacaaaaaggttaccgatgttactctcctattcacaatcgtttatatctctgcagatgtaacattttttgaagaaaaaccatacttttctccctctatggttgagtccaatactcttcaagaagtttttcctattccctatcttggtccatcaccttctttgcaagaatcagagtcaactgtagattctaccatagatattcctaataatcctccacttgagcaaactcaaagatcacccatcgtatatcaacctcgtcctcgaattcttgtcgtagaacttgaaggtaatgaaagaccagttgaatcatgccctagtccaacggacaacccgaccatggacctacccgaagagaatcttgacttgctcattgctcttaggaaagatactcggtctacaccacttgatcatccaggatggcgacaagccatgattgatgaaatgcaggctttggagcataatggtacttgggagctggttccttttcccccaggcaagaaacatgctatacccagatttatggcctag

SEQ ID NO: 17327 - DNA, 1155 bp, Glycine max
  Peptide Sequence Number=SeqID_109012
atgatgaattccacagaagaagagtatcgtggctgcgagattatggagaaagatgttcatgtcacgtttctcgagttaatgtactatttactcccatctccgtacgagtcccaagagatcaaccatctcactctcgcttactttgtcatctctggacttgacatcctcgactctctccacaaagttgcgaaggatgctgttgtcagttgggttttgtccttccaagctcaccccggtgccaagactgatctcaatgatgggcaattctatggctttcatggatccaaaacttcacagtttcctccagatgagaatggggttttgattcacaacaacagtcacttggcaagtacttattgtgccatttccatattgaaaattgttggttatgaattgtccaatcttgactctgaaacaattgtgacttctatgaggaaccttcaacagcctgatggaaggtatggttttgaaacttggactagagctgtggcctttatacttgtgcaatgtttcattccgattcatactggaggcgaaacagatcttaggtttgtgtattgtgcagctgccatctgtttcatgttggataactggagtggcatggacaaggagaaaaccaaggattacatattacgttgccagtcttatgatggtggctttggattagttcctggtgcagaatcgcatggaggtgcaacttattgtgctatggcatctctccgattaatgggattcattgaagataatattctctcaagttgtgcttcatcttctttgatagatgcgccattgctgctggactggatcttgcagaggcagggaactgatgggggttttcaaggtagaccaaataaatctagcgatacatgttatgcattttgttgtcaaagccttgacaagcatcatatgtttgttaggattggagccgttttaaggattttggggggcttcaaatttgttgacaataaggctctacgtggatttttgctttcttgtcaatataagtatggtggtttcagcaaattccctggggagtatccagacctataccactcctactatggattcactgctttcagcctgttggaagaatctggcttgaaatcacttttttcggaactgggaatcactgaaaatgctgcactggcactctag

SEQ ID NO: 17328 - DNA, 906 bp, Glycine max
  Peptide Sequence Number=SeqID_109013
atgaaatccttgagtagtgtaggtcttggtctgagtattatttttggttgtctcttgttggctctagtagctgaggtttactatttgctatggtggaagaagaggataaccaacagagagattgagaatgattatggcaaccctgtgaaggaattattctacatgttttgttggaaaaggccatcatcatcttctttgaggcaaacaagtttcactcctcctgagttttgttcttcaatgagaattggtgacacccttgttcatgacccagaacaagttcagtctcaaagtggaaaggaatttgttttcaaaccctttggagaagatggcaccgatgcagaatacatgaggcaacaggacctgttactgttaggccctccaagattcttgttcaccatagtagaagaatcaaaagaagatttagaatctgatgatggcaaatccaagtgtgacaagagtggaaaaggttcaaggggtagaagcttgggtgatttactagttgtggagacaccatatatgacacctacaacttctccacctttcttcactcctcctttcactactcctatcagtccctataaccaacgtggattcaaccctctatttgaaacagcaactgatgctgagttcaacaaattaaagtcctcacctcctccaaaattcaagttcttacaggaagcagaagagaagcttagaagaaaactacaagaagacgaaaataagggaaatggagatgaggttgatggttctttcatcacaatagtagttgacaagaaaacagaaagagaggttaatcaccagcctcgtccaccacagtatcattcaagcacttcacagttgtgtgcaaaagggacaggaaaaccaagaacaactttgaggaaagttgttaaaaaagatgttatgtaa

SEQ ID NO: 17329 - DNA, 708 bp, Glycine max
  Peptide Sequence Number=SeqID_109014
atggttagaacacgaggtctacgtcgtatggtaggcacaggtaaaggcagcgaccttagtcagaatgtggctgaggatgttcctcgccgtcgtaggcccactgcctcagcacgtaggcaacgggttacccagatggctgaggatgttcctcagttggctgaggatgtgcctgatgcgtctgatggtagcccagagaggacaggagccgccgatggtgctgagtctgatcgagtggctagtgatgggacagctgctgatgatgaggggttccccggtgggccacgcgatccatctgttttgataggatttgctgatcatgtggcacacaacatatggcgtggacaagagcgacccgatctcaagttggtctcccatggtaggaaagtagataaatttgggagaccggctgctgagattgaaggtatgattgcggccaccggattggatccattgatcaggtgttctgtgatcaccactgatcctggactcatatccgcctttgttgagaggtggcatagggagacgagcagcttccacctcccagtaggggaggtgacgatcactctagacgacgttttatcgctcctacacatcccaattactggcgcgctgcattcatttgggccgttggctacatctgacgcagttgcgctgttgacggagctacttgaggtcaccgcagacgaggctacagctgagacacgttag

SEQ ID NO: 17330 - DNA, 696 bp, Glycine max
  Peptide Sequence Number=SeqID_109015
atgaaattatggtgtcacaccctacgactcgacatcatcgactcagctcacgacaatgccgttgagagcgttgaggttgcgctcaccttagcaactgatttgatgaagagaggatcgtatggacacgtcatttttccaatacacccaatagtgagaagcttacagattcgtatgaggcttatagattggcaatccatgaattcccgcaaacaccgagctgtgcctacacctggggaagcgtccagctgggactcttcccgctttacatcagagatagcatggcacaggtatcaggataacgttcagctccggaacattcttccagagaggaatgtcgagcttgcacctgggatgtttgatgagttcctccaagagcttcagaggtgttgttgggaccaggtcctgaccaggcttccagagaagaggattgatgtcactctagtgaaggagttctactccaacttatatgatccagaggatcgaagtccaaagttttgctggattcgaggacaggtggtcaggttcgatgctgagacgattaatgacttcctcgacaccccggtcatcctggcagatggggaggagtacccagcttactcccagtacctctgcacccctccagaccatgaagccatccttgccaccttgtgtacgccagggggacattttgttctgaatgttgatggtgccccctag

SEQ ID NO: 17331 - DNA, 1494 bp, Glycine max
  Peptide Sequence Number=SeqID_109016
atgaatgatggcttcggtgctggggagggaggggtaatggtggtggtggtggatggtggttgcgcttacgatcgaacatcttgtcttcttgaagcttcgccagcgcggtggcctgtgtccaacaattcaattagccacccgctcgaattcagtcaggagtgcgttccaggatgtgatgaatccattacgaaacatcccttggaaccaactcaaagtcgaaccatccatgtaaaaggaggcaagcgtgattcggtcctcattcggtgtaccctggtagtcgaagaactgggtagctttgaagatccacctgacagggtctgtaccgtcgaatctaggaatctcgagtttgaggtgtggtcgcgggttgggcaaggatgctggaggggagggtgtcggggtaaggtggttcagacgaccaaggataacttcgacaacggtctatggtggtcttacgggtattatggtcagccatggaaggtcgaaccaaatgttacatgctcagaggacgagagtcttgtttcgaggacaagggaacctccgtatgcaaaagtcattcaaatagattggcctagtagtaattctcttgggtctcccttcgtggaatgctacttgcataatattgctggtattgttattgttgttgctaacacacacactgcctcaactgcaactagtaatgtggttgaaaatgccagcctttatggtcgggctggaggtacagcaagtggaatgaggtatacctcaagaatttcagtttacaaagtatgctggccaaaaggttgtgctaactctaacatattagccacggtggaccaagcagtttttgatggggttgatgtattgtcactctctttagggagtgatcctaaacctttttatgatgattttatcgccatagcttcatttggggaaaccaagaaagggatttttgttacttgctccacatgcaaagaaggcccctctccatcaacagtttctaatggtgctccatggatcatgacagttgttgccagctccactgaccgaagctttccagcggaaggaagaactaagatgggagaggtagtgaaagtggcttatggggcgggaatgatagtacttaatactaaaaatcaagctgaagaaatttatgttgatcttcatattttgctagccacttccttaggagcctcagtagtaatgagagcattttcttctaaaggaccaagtatagtgggactagatgtgactgacccagctggtgcttcaatgtcttgtcctaatgttagtggcatagcaacacttcttaaatatttgcacaaggattggtcccctgcagctatcaaatctgctttgatgactactgcttacacattgaacaacaaaggagctccaatttcatacatggcctcagataacaaagcatttgccaccccctttgcatttggttcagaccatgttaaccctgtaagtttgtatgttctaagaaagcagttcttcacgctggtgacttga

SEQ ID NO: 17332 - DNA, 2265 bp, Glycine max
  Peptide Sequence Number=SeqID_109017
atggctacatggtatttcaaagctttgaggattaagcttttcaatgtcgggtatgttttagattctcggacagctgctcctctcattctttctatgcttgaggatatgcttagttcttctaaaacagcatgcagggttcgtgcttttgatttaattctaaaccttgcggttcatgcacatctcctagaaccgatagttgctgatgatgcttccactattgaagaagaatattctcaagaatcctattatgacagtgacactcaagttatggtgcaaggaagcagaaaaggaagttctcagaacaaatcagacacaggctctgcaattgataagtttgagtcttggattttaaatattctgtatgagatactacttcttcttgttcagtctgaagaaaaggatgaatctgtttgggcatctgctctcagctgtttgctgtatttcgtctgtgatagaggaaagatcaagagaaaccgtttgcatggtcttgacataagggcacttgtaagaatcagtagggagaactcctgggcagaattagttcactgtaagcttatttccatgttaaccaacatgttttatgaagttgctgaagttgctgagtctgtatctggcaaacccaagtttcttgtgaatcaacttgatctgattggaggagttcaatttatttttattgagtattcccttgcaaactcaagagaagagaggaaaaatctgtattcggtgctttttgattacattctgcatcaaataaatgaaacatgcatagctactggtgtcaatgattatagtgatgatgagatccaacctcttgctgctcttcttgctcaaacaaatgcacctgaggcattttatatttctgttaaacttggggtagaaggtattggagagattctgagaagatcaattgcatcagcactgtccagatatcccaacagtgaacgactaaatatgctactggaagttgtagcagagaaatttgatgctgtaataagtacgtttactcatttggacaaagagttctctcatatgaatcagataaccaaatctctcaagtttctggaaaatatggaaggtgtggttatgagaaatggcattggtttgcaggcaaagcactcctgggctactttacattctcttcttcattctgaaagaatttcttaccgtcaaaatgggtatatctggttaggtgatctgcttattgctcaaattaatggagaaagagatggaaatatatggtcaagtatcacatacttccagaagaaaattgctcaagctggaactcaagattcttcaaatacatcagatgttcctttgcctattttacttatgtgtggccttctaaaatcaaaatacaactacattagatggggatttttgtttgttcttgaaaggcttctcatgagatgcaaatttttgttagatgagcatgaaatgcaacaaacaagcaacagagatctgggtcatggaaagaaagattggcatcttgagaaagccaatgcaattattgacataatgagtggagctttgtctttggtgtttcagataaatgaaacagatcgcatcaatattctaaaaatgtgcgacatactattctctcaattgtgccttagagttcctcctgctgcatctctgccctttggagatgatgtgcgacatggcagaaatttcaatcacgttaatttaagcaaaaggtttgatggtgataatcatgccaaacaagatacttttcactgggatggacacaaggaagaagcaaatagaagatccggctaccataataactaccacctggatcacgagactgcatcaatggcagcacttttccaaggacgagccgttgtcccaatgcaattaattgcacgcgtccctgctgccatactatattggccactaattcaattggctggagcagcaacagatgatattgctttgggtgttgctgttggaagtaaaggaagaggaaacctgcctggtgctacatctgatattcgggccacacttcttctactacttattggtaaatgcacagtagatcctgttgccttccgggagcgaatgatgaccgagaagccagagaaatatcaacacatgcttcagaatcttgttgttaaggcacaacagggttgtccctcacttataaactctaacttgactttatttttagctgatgtgggacttgggtttttcccaatacacccctcgcgcccagctcttcttgggcttggtgcgtggataacaatggtgagtgaccctttggattaa

SEQ ID NO: 17333 - DNA, 636 bp, Glycine max
  Peptide Sequence Number=SeqID_109018
tgtttgactgatccagactatgatgagatgtcaccacgtgcctgccggtggattgctacgaaggcttcttcgaagtcattaccagcatcgaggtaccagaaacgtctagatggactgacaattgttgatgtttgctggatgccatacggtgagcaccgtggagacatctacgatgaagtcccattgtcgtcagacaccgaccagagagggtggtgcgacaatttggatatgttcaaaccattcctccacagactacggtgtgcatcagattacatgcattggttcttcatgatttctcatctattcatgatacaagcacagcctgttgatctggctagacatccacctgtgacgcaggatgacacatatgtggagccacatatccctgaggtcccagtggcaccagcagcagcaccgacacatgccccttctgatgaggagcagcctagacatgcaatggaggcttgccaagaaatcgcagaaaggtttgagcgtttgctcaacctaaggatagtcaatgcaggcacaaaaatacacgaggtcatggaagactgcttaaggatcgctaggggtgtcacagtagatggcaatgtttatgtcaggtcgcgacgaaggcaacacacggatcagccatag

SEQ ID NO: 17334 - DNA, 786 bp, Glycine max
  Peptide Sequence Number=SeqID_109019
atgttgacaaccaatggaggagaagaagctcgaacttccaacaaagaagaagctccaacggcacaaccaaagcaaatgaaacagcggcacaaggatgttgggtgcaccagcaataatgctagttttttatttcttttttgtcatcacccaaaccaaatcaagatgatgaatgatgaacgggtgttgctagctacaacagccatattgtttgtacacccaataataaaattaacacattcattccttcgttttctcggtttcttctggtttttcattgttgtgagaggtgcattatgccgcttcggtcgaggtgaaagtattacggagtataactcatacgaattaactaattcatatgacttatacggattacctaatccgtataagtcatatggattaactaattcgtatgacttatacggatttggtactccgtacctgtttgctacccgagatgatgttttgcaatgggctccatctgttgcttatgaagttggatttgtggcggtgattatgaagttagacacaaacagtggtataaggggaaggactttatttgtcttaattggttgtgaaagaagtgaccaatataggtctaggaagaaagattttgaaagaagaaatattgatagtaggaaatgtgggtgtccctttaagcttcgtgggaaaccagtgattggaggccaaggatggatgttatacaatgcaagaagtgaataccatttttccataagaggtagtgatactgaaatgcaacatctaatgaagcttcttgaacgggattag

SEQ ID NO: 17335 - DNA, 120 bp, Glycine max
  Peptide Sequence Number=SeqID_109020
atggtggcgaatatattggtcttcgcccttttttactcaatcgtggttactcggctgatcaacatgcatatttgtgtctcgatcccacaacaggaaggatctacacctctcggcatgtga

SEQ ID NO: 17336 - DNA, 768 bp, Glycine max
  Peptide Sequence Number=SeqID_109021
atggttaggactagaggcctaggccgtgctttaggtacggttagtggtagaggtctggggagaggtgatcatgatgattctgacgattctccccagcgccgaaggcctaccgcatccgcacgtaggcaacgagtacctgtgactgttacggatgaggctgacgtacctgcgactgagattgacgtacctggtcctgacttagcctcgactgaggctggtctagatgcggatgagccaatggtagaagctgacattcaggacactggtgcaaacactgctgcagaggatgatgtagacactggtgcacaggctgctgaggatgagcctgagggatttctgggtggtccgagcgacccatctgtactgaccgagtatgcggatcacgtcgcaggcagcgtatggacaggagaggagcgtcctgagttgaagttatcctctcacgggaggaagatgcatagtttaggcaggcctgtccctaccattgaagggctagttgctgggacaggactaagtcctctgattgcgtgctcgatagacactggcgatcgaggacttttgttgtcgtttgtcgagcagtggcaccgggagacttctagtttccatctccctatgggagaggtgatgatcatgctgggcaacgtcgcgtctcttctgcatctgcccatggttggcgacttgcatgcctttcagcccgtgcacatggatgatgttgtacagatgttggtagagttattgatggtcacttcagagcttccagggctgagatag

SEQ ID NO: 17337 - DNA, 2562 bp, Glycine max
  Peptide Sequence Number=SeqID_109022
atggcatggtttagagctggaactagcatagcaaagcatgcaattaggagaaccctttccaagggtggatccacataccttgtgtcaagggcaaggttccttccatcgataccatcatcatcgtcatcaccatatagcagaagcttccacagcacggttttcaaggaacaagctgcacctgttccacgtgcggttcctctttcaaagttaacagatagtttcttagatggcacaagcagtgtgtatttggaagagcttcagagggcttgggaggctgatcccaacagtgtggatgagtcatgggacaatttcttcaggaactttgtggggcaggcaacaacctcacctggaatttctggtcagacaattcaggaaagtatgaggttgttgttgctggtgagggcgtaccaggttaatggtcacatgaaggccaagttggatcccttgaatctggaaccaaggcaaatctctgaggatttggaccctgcactttatggcttcactgaggctgatcttgatagagagttcttcttaggggtgtggaggatggctggtttcttgtccgagaatcgccccgtgcaaacccttagatccattttgacaaggcttgagcaggcctattgtggaagcattggatatgagtatatgcacattgcagatcgtcataagtgtaattggcttagggacaagattgagacccccacccctacacagtttaatagggagaggcgtgaggctatatttgataggcttgcttggagttccttgtttgagaacttcttggccaccaagtggacctctgcaaagaggtttggtcttgagggtggagagactcttattcccggaatgaaggaaatgtttgatagggcatctgatcttggggttgagagcatagttataggaatggcacatcgagggaggctgaatgttttggggaatgtggtaaggaagcccctgcggcagattttctgcgagtttagcggtggtcttcagcctgagggggaagttggactctacactggaactggagatgttaagtatcatttggggacatcgtatgatcgccctactaggggtggcaagaggattcatttgtctttggtggcaaatcctagtcacttggaagctgtcaatccgcttgttattgggaaaactcgagccaagcagtattacgcaaatgacgtggatagaacgaagaacatgggtgtgttgattcatggagatggaagttttgctggacagggtgtggtctatgaaaccctgcatttaagtgctcttccaaattacactactggtgggacgattcacatcgtgtttaacaatcaggttgcatttacaactgatccgacttctggcaggtcttcacaatattgcactgatgttgccaaggctttggatgctcccatctttcacgtgaatggtgatgatgttgaagcagttgttcatgcctgtgaacttgctgcagagtggcgccagactttccactctgatgtggttgtcgacttggtgtgttaccgtcgatttggccacaatgagattgatgaaccatctttcactcagcctaaaatgtacaaggtaatccgaagccatccatcaactcttgagatctatgagaagaaccttttggaatcaggggagttgacacaagaagaaattgataggatccacaagaaggtcacatcaattctaaatgaagaatttttggctagcaaagaatacattccaaaaagaagagattggctttcagcatattggcttggtttcaagtcacctgaacagctttcacgtatccgaaacactggtgtgaaaccagagatcttgaaaactgttggaaaagcaatcacaaccatccctgaaaatttcacacctcatagagcagtgaagaggatttatgaacaacgggcccaaatgattgaaactggggaagatattgactggggatttgcagaggcgcttgcttatgctaccttgcttattgaaggtaaccatgttcgattaagtggtcaggatgttgaaagaggaacttttagtcaccgccatgctgtagttcacgatcagacaacaggggagaaatattgtcccctggaccatgttataatgaaccaagacgaagagatgtttactgttagcaatagttcactttctgagtttggtgttcttggatttgaattgggttactcaatggaaaatcccaattcattgataatttgggaggctcagtttggtgattttgctaatggtgctcatgtgatatttgacaattttttggcttctggtgaggctaagtggcttcgtcagactgggcttgttgtgttacttcctcatggttatgatggccagggcccagagcattcaagtgcaagattggaacgctttcttcagatggctgatgacaaccctcatgttatccctgagatggatccaaccctccggaagcagattcaggagtgtaatttgcagattgtgaatgtcacaactcctgctaattttttccatgttctaaggaggcagtataactcaccttctagtgaagatattgaaactccttatacaggagagtaa

SEQ ID NO: 17338 - DNA, 132 bp, Glycine max
  Peptide Sequence Number=SeqID_109023
atgggggcgcgcaatggaatgaaaggattcagtagggaggggaaggagacattaatggtgtctggtgtcgcggcgcagcagggaggggaaggaggcgtcaatggtgtgggtgattggtgtgaggaagaatag

SEQ ID NO: 17339 - DNA, 258 bp, Glycine max
  Peptide Sequence Number=SeqID_109024
atgagaggcataaatgtgatggcagaagtggatgtccctggtcatgcagaatcatggggtgctggatatcctgatctttggccatcaccttactgtagggagccactagatgtttcaaagaactttacttttgatgtcatttctggtattttgacagtggtggtatttccgtgtttgttaattgttaccttacctgaatatgcatatgtaaaaatgcattattttaaacaactgtcagatagtgtgactttggagtaa

SEQ ID NO: 17340 - DNA, 2154 bp, Glycine max
  Peptide Sequence Number=SeqID_109025
atggagataacctacgcatcgccaagtttctcagacctccgcgccgccgctacctcctcctccatgccgtcgtcagcgcgtcccgtcaggatcattcctctccagcacccgaccgccacgacgtcgtcgtcatcgccgccgaacgctgcgttctcgcgctggacggcgaagctccggcgaatgacgtggatggagtggatcgagttcttcctcccttgcctccgctggattcgcatctacaaatggcgcgagtatttccaggtcgatctcatggccggaatcaccgtcggtgtcatgctcgttcctcagtcgatgtcctatgcaaaattggctggacttcaaccgatatatggactctcaaatttccgtacagcagtgctaaaaattttgaggactaaggaagactctggttttgtgcccctatttgtatatgccatatttgggtcttctcgccagcttgcagtaggtccggtggcattggtttctctcttggtctctaatgtgctaggtaacatagctgattcatccactgagttatacacagagctggcaatattactgtcccttatggttgggataatggagtgcataatgggactcttgaggcttggatggcttattcgtttcattagccattcagtgatatctggctttacaaccgcttcagctattgtcattggtttatctcaagcaaaatacttcttggggtatgatatagatgggagtagcaagatcattccagtagttaagagtataatagctggagcagataagttttcatggcccccctttgtgatgggatccattatgcttgcgatactacttgtcatgaaacacctgggaaagtcgaggaagtacttgcgattcttgagagctgccggtcctcttacagcagtagttctggggacagtttttgcaaaaatatttcatccatcatcaatttctttggtgggtgatatacctcaaggcctaccaaaattttctgttccaaaatcttttgagtatgcacagtccttaattccaactgctcttctcataactggtgtggctatactggaatcagtgggaattgccaaggcattagcagcgaaaaatggatacgagttggattcaaatcaagagttgttcggtcttggtgtttccaatgttcttggttcatttttttcagcataccccacaacaggatccttttcaaggtcagctgtaaatcatgaaagcggtgcaaaatctggtgtatctgggatagttttaggaattataatgacctgtgcacttttgtttctaacaccattatttgagtacatacctcagtgcacccttgctgccattgtgatctctgctgtgataggtctggtagattatgatgaggccatttttttgtggcgtgtagataagaaagattttcttctttggaccattactagcactacaacattgttccttggtattgagattggcgtccttgttggggttggggtttcacttgcttttgtcattcatgagtcagcaaatccacatattgctgttttgggtcgtttgccagggacaactgtttataggaatgttaaacagtaccctgaagcatatacatataatggaattgtaatcgttcgtgttgatgctccaatttattttgcaaacacaagttacataaaggacaggttgcgtgaatacgaagttgatgttgattgttctaaaagacatggacctgaggttgaaagaatttattttgtgattctagagatggcacctgtgacctacatagattctagtgctgttcaggctttgaaagacttgtatcaggagtacaaattacgggacattcagattgcaatatccaatccaagtccagaagttctgcttaccttgtctagatccggtctggtggagttgataggcaaagaatggtactttgtgagagtacatgatgctgttcaagtttgcttgcaacatgttcaaagcttgaaagggggatctaacagtccacaagcaccattctcttcattagaagacaaaccaagtttgtttgcccgattatcaaaagagagaggggagaagctttcaattaccgacttggagtctggtaatggcaggccaccactccccaaggagagagattcccaattggagccattgttgtctaaagatcattga

SEQ ID NO: 17341 - DNA, 243 bp, Glycine max
  Peptide Sequence Number=SeqID_109026
atgtttgatttgcgatgctatttccacgcaccaaaccaaacagaagcatgcacgtgcaaatatcagggtcacctttctatgaaccacagaacattgtggaacgagctagagaaagaaaacaaggagttttttgaggagtatgccaaagccaagagtaaggacgaacgaatgtcggaggaagagacaagccaaatgatacagaagatgatctcagattcctctaaaggtgctggcaacgactaa

SEQ ID NO: 17342 - DNA, 2229 bp, Glycine max
  Peptide Sequence Number=SeqID_109027
atggaatccaaacaagaagcaccaagtgttattttaaacttgatgggtcttgatcaagtgcctacccaacatcccattagagataagcagaaagtgctctctgagaattacctgcagaaagttgcctctattggtgtcagaaagaagcgttcatctcatcagcatcattcctctggaatgaatactagtgaaaaggaagaatttgaggatgttttaaaagtggtcaaagcactaaggcgaggtaagcaccataacccatcaaagggaaatggtaaagagaatcctatttcttgcaaaaattctaatttggatgatgggctgctccaagagatattttatcctaaaagcatgagactgtatcctgaaatgagggagagaaagaaaatatcctatcacatgaattctggtaagcagagttcaaggcctttcagtaaaatttcagaggagatttcaatgcaatcgggaaatgttgcaaacggagttttaaatactgcttcaagttcttttctcagagggaatgaagcatttgccagtgatatgctaaagctgaagcctgcttcaaatatttcagttaatgagatccaattcaatttccctttcctctgttctgattccaggaccaaaactttggcacagggggatgtggctgaaaaattgcgagaacttggacggtgtggtcaagtctgtatacataaccagttgcctatgatttctgaacatggaaatggaacaagagatttgactcatcaaagtggttattatagcaatgacaaaattagaaagaacattagatgtaaggctggtgttaattacagctttgctagaagagtgtcaatacctctttgtgcagcttcagttattgctgataacggtagaactatgaatcaggatatcttgtttcagagatattggggtttgagaaagaatgcatctgcaaattggttatcatggaagtcgaagaatgaaaatgttaaccagaaagaatgtatggaagatgtgaacctcagtcctggccatgagaaactcccttccctttcctcttatttccatagtaatcacactgaagagaatggtataaatcatatgtcagagaagagagtttatgggaaggatttgtctgataaggtaactatgcctcctcaattgtcaagttctagtccttctcccgaattgatagacagtcagatcttgcaagagaggcgcttaatgaatgatgaagtgaagaacaaaacatatgaagacagtagtatgcctatgcaaaatgttgtgtctcctgattcatcagttgatttcttggtatctgatgcaacaactgaggttgttggcagatcacattataacccaaccaatcatcaatataaatcaacagtcttcttgtcacaagaaattgattctctgagttatacttcaaagaaacagagtgttgctcattgttctgggaccttctgctcaaagtcccaccacctaccaccttatcaaaaccaatgtggaaaaattctagatacatcagattttcaagaagattctgtactttcactttgctctgaggctgaccccgattccatcagtagctttgaggaggcatatgaacctagtccaatttcagttttggaacccttatttggagaggacagtcgattcagctctaaatgtggcgatcatgtatatgattcctctgaagtggatgatgaagaatatgatttgaatgtttcaagtgatgaagattgtgagaatgaatatgtagatgaccctgaagaaaagaaagatatagcaggattatttagagctgaagaaagtagggatttctcatatgttgttgaggtcttaaccgaggcagaatgtcctattagcccttctgtcttcgaaatcctggaaaagaaatttggcgagcagcaactttggaagaaatctgaaaggaaacttctctttgatcgcattaacttagggctgctggagattctgcagccatatttgtacatcccaatgtgggaaaagcccatgtcaagaaggttgaatgccgaaccaagccagaacatgattgaggaggagatgtgggggttgcttgttgcacaggaaaagaaagctagtaaagggttagcagacagtatcctcgaaggggagattaggtggatagaactagttgaagatgttgaagatattgttagagagatagtaaatttgttaatagaggagcttgcaaacgagatagttagcttggagaaattttga

SEQ ID NO: 17343 - DNA, 360 bp, Glycine max
  Peptide Sequence Number=SeqID_109028
atggctcagcaatgcatgcatggccatgcggctgataccggccgagatcactggcttggccttcaaggaaaggacacagtgctgttccaagttgtagaagcggaggagaacggggaggttggaatggctgagtctgggaaatgcatgagtgcttttaggattctagtttttctgcctctagaaatggataagaatttgaacgttgccccatggaagattctttgcaccaatgttacggaatatttgaatcttggaaaaattgagcctttaagtgagtacaatttcacaggtactgatttcaattattatgagaggctcttgcaagaatcagatagaacattagtccatgatgtcggccag

SEQ ID NO: 17344 - DNA, 399 bp, Glycine max
  Peptide Sequence Number=SeqID_109029
atggcgcttcaagctgaacaacttttattacttgtgcaaccctacacttgttatttcatccacatcagactcattaatcaatctctcatcaacaacacccagaatatatcaatggagcacacagggtgcaatagccgaaggccttgcaaggggttatttgtttggtcactatatatagtcttgtctcttccttaccctaccatacatgtcgctaacttcaaaagcccaacaaaaaaaagtgagagcaatcacatgaagcttacctcgacaccaacaacgacaatggcaacgagctggctgcgagtgggagtgagaaagagtcgcggcatggaaaggaacacctatgcaggcgacaccagagctacaactgggtcaaagatacgctacagacgtgactga

SEQ ID NO: 17345 - DNA, 1737 bp, Glycine max
  Peptide Sequence Number=SeqID_109030
atggtatcgagaaacgtgtccttgaggcaaatattcgcggagaggagcaaggaaagactcctctcgcgccatgagttgccgctgaatggcagcaacaacagagctgggggaattctgcgtgtccttgcagatcgtactgcgacggtctacaagggcgtgtgcgagttcttccggcagctccaggagatggcgcggtcagatcggcggaaggtggcgttcgcagcaaaggcggggctttcgctggccctggtttcgctgttcatttacgtgaaggaggaacagttgagcaagtactccatctgggctgttctcactgtcgttctcatttttgaattcagcgtaggtgcgacattgagcaaagggttgaatcgttctttcggaacgctttccgctggagggcttgctctcggaattgctgagttggccattttagccggagacttcgaagaacttattatcgtactctgtatatttattgcaggattttgtgcaagctttgtgaagttactgcctgcaatgaagacatatgaatatggctttcgtgtgtttttgttgacattttgtattgtattggtatctggtagtactaccagagattttttctccacagccttatacagattaattctcattgctgttggtgctggcatatgcttgtttgtgagtattttcatataccccatctgggctggggaggatctgcataaattggtggtgaaaaatttcaaaggagttgctacatctttagaaggttgtgtaaatggataccttcaatgtgttgcatatgagagggtcccttcaaaaattctggtttatcaagcctcagatgatccactttaccgtggctatagagcagcagttcaatcgtcaagtcaagaagagtctttgttagattttgcatcatgggagccacctcatggtccgtacaagacattcaattatccttggagaagctatgttaaagtcagtggagctttgaggcattgtgctttcatggtcatggcaatgcatggatgcatactttcggaaattcagactgatacaaaaatgtctgaggtattgctttcctgttttacacataatccatcatcaatgaagttttccttgctgctactcgcacctccagagaagagaatggttttcagtaatgaacttcagaaggttggtaatgaaggagctgaagtattgcgtcaactaggaagcaaagtggaaaagatggaaaagctaagcaatgtagacatactcttgaaagtgcatgaggcagctgagcaattgcagatgaagattgatcaacaatcattccgcttgttcaattcagagagttggcaggatgcaaaaaagcctaaagaaattgaaaataatgacaattgtttgttgattgatgtcaaagacaacgagaacaaaaactcactgatatcttccctcagtgaaacaggagctgattcaagacttaacataaacatagagccttcggttcctgaattgcacacttcacaaagcttgatgtccaataaaatgtcatggccacgtctctcattttatggagataacatgttacttgagcaagattccaaagtatatgaaagtgcaagctctctgtccttggcaacatttgcttcccttttaatagagtttgttgcaaggcttcaaaatcttgtggatgaattccaagatctcggtgagaaggccaatttcaaagacgtctttgatgaaccaatgttgaaagaggcaatatga

SEQ ID NO: 17346 - DNA, 780 bp, Glycine max
  Peptide Sequence Number=SeqID_109031
atggagcaatcaaggaaggtgttaaagacgggtggcggagatgctggtggaggcggtggcttcgaaggtggtggtggatgtgagaacccaaatccaacgcggatgaatctgttgcgcgacggcggcgtccccgagcaggatgatgccgttgtcataggggatctcgtggtaacaatggtggacagtgcagagcaacaatggcaacagatggtcaggccggaagtggcggttgatcgaatgaaagtagagaagctttaccagaacaggatcaatggtgtcaatcgaccatctccttttccaaccatgggaagcagagtcgggatgggtgtggggctttgttgtcggggtgcagggcatggaagtggagttagcatgggaagcatattgggcatgggtgcatcaggtggaggtaaggtaggaggagaggttggtaaagccctgagtgagatggatagctgcttcttcaagctggtcaatggtggactgacaaatatggcgttctggcatggtgaagtagaggagaaggaggcagggaagaaggagataaacacacaagagttttatactgattcggcaacaacccgtgcctacatccagtccccaagcgacctgcggtccttgagatttcttttcaaaccttgtaaaaaaccttttacaagcaaagatccacaagggatgtaccctcccttgttctctttgaacaacctagtggatgtaccctccactagaactgatccacaagagatgtaccctctcttgttctcagtcaaacctaagtag

SEQ ID NO: 17347 - DNA, 117 bp, Glycine max
  Peptide Sequence Number=SeqID_109032
atgcagaaagaagcaaaagcagttgttgttggagttgctcttcgtgttggagtgaagctttacaagaaggggaacgtgttcttccactttcagtcttcaaagttggtttatttttag

SEQ ID NO: 17348 - DNA, 159 bp, Glycine max
  Peptide Sequence Number=SeqID_109033
atgacgcacgatcttccttgtgcttgtgagctatccaaatatgttgttggttgcatcccgttggattcaatccatatgttctggaggagactcagtttttcagatcaagggatatatgagcccaaggtacattctctacaacccaggcatcataactaa

SEQ ID NO: 17349 - DNA, 891 bp, Glycine max
  Peptide Sequence Number=SeqID_109034
atggggtccacagggtgtttggtgcttttttttgttgttgtggtggtcccttatgtcttctttggtagggtggtcccaattttgtcttccacgaggcaccccgaagaacaaacagtgaggttaaagattcaccatggtgggatgtttatttataagccatttaatgtgcatatcaatggtcagatcgttgaagaagaatggggttggaatgtggatattatgtcctatattgacttcatgaagttgattaactctcttgggtacaaatcattcaagtgcttatggtatagggacccccaaaaagcactcagcagagggttgaagccacttaattgtgactttaatattttgcaattggctgaagatgtttttggttttgatgtggttgaagtgttgatgaacaaggattatgttgaggctgaggaagatgatgatgataccagtggttgtagtgaagttttagatagtgactttgaagaaagctgggattggacaaaatcgttggaccctcagacatttagtcggagtagtcgcccaacatttgagactaatgaagtaggcttaacaaattctgattttgatgatgaagatggatactctgatgagttggatactccagatgaaagtgacgatgaaggtcctccaaaagttagatttcctcattttaaggtgcctgaaaatgatgaagatgtaaagtttaaggtagagttgcaattcattaataagaaacaaattctagaggctatcaaaacctttgctataatgtctaagaagaatatgaagttatgggtcaacaagtccattcaagcgagttattggcaggtagtgacattcaaagatgatcgttgttactttagaactgccaaaaatagtaaggctacacttgactag

SEQ ID NO: 17350 - DNA, 180 bp, Glycine max
  Peptide Sequence Number=SeqID_109035
atggctagcggcacagcgtgccccgcaggtgtacccctcgaatctccccaacaattggtatcagagccgatggttcaagttggtgaccggctcagacgagtatgcaagtaccgcaagtggccagaatggctagcggcacagcgtgccccgcaggtgaagcggggtagccagaatggctag

SEQ ID NO: 17351 - DNA, 942 bp, Glycine max
  Peptide Sequence Number=SeqID_109036
aaaaaccgaatatcacttcagatagggagttgctaggtgcacctagcaatattgctgcttcttcttctctcccggaacctgcttcttctcttctccgtgaagcttattctccgcgaggcgcgctaaggctttctttttcttctccgcgaacaggggagaagacgagagtacgccagaaaaaatggcggaaaaggatgacgacgaagtcttccggaagacccgttaggggttcttccggaagttccggaagaacattttccagaaagtttccggaagaagtggttcatccggaagaattccagaagacgcgctcttccggaagaactttcaaatttccggaagaccttttcggaagaaccacttcttccggaatgtttccggaagaaccacttcttccggaagtgatcatggccagaacacgaggtttaggtcgtgccataggtagagttgtaggcagagatagagctgctgacgaggatgctggcgatgtttccgagaggcgtaggcctactgcctcagcccgtaggctacgcgttcatcagatgactacggagggacgtgatatagttgaggacgtcgctgacatgactgatgatgtccctgagcagcctacggaggcacctgagatgcgtgcggacgtacagggtgctgatagtggtgaggggtcagatggtgatgatgctgcagagggattccctggtggtccacgtgacccgtcagtgctcacatcatttgccgagcatgttacacatgccgtgtggagtggacaggaacgtcctgatttgaagttagtgtcacatgggaggaaggtgacactgattgggaggccagtgcctgagattgaaggcctggtggctgtcacaggattaagtccactgatagattgttcagctatccctggcgatcctggacttatatccgcatttgtggagaggtggcaca

SEQ ID NO: 17352 - DNA, 339 bp, Glycine max
  Peptide Sequence Number=SeqID_109037
atgaaggagcggttagggcatgatcaaagtggtagaggaggaggatgggaagttgatgccgaagagggagcagggagagggaggcaagggccatgcaagtgtaccgccatcatgattgacgaaatacgcaagccgttgacacgtggactgataccgctagtggagctggtgatagatatcaccagtggagctggcgagtttggtgtggcaagttctcaccactttcactggcgacttggccttcaggctatgctggcaggaggcacaggtgaacaggaaggtctcgccaacacatcttgcgagatgagcttatatccgccaatggtattggcgatatag

SEQ ID NO: 17353 - DNA, 151 bp, Glycine max
  Peptide Sequence Number=SeqID_109038
atgggcacatcacaagatggaaacggtggtgtccttcctctagcattcgccgtggtcgaagataaaaatggtatttgtctcatacctgatcgtcacgcgagtataaagtctgctgtggctaatgaagcacttggttggcaacctccccacg

SEQ ID NO: 17354 - DNA, 762 bp, Glycine max
  Peptide Sequence Number=SeqID_109039
atgacggacaaaagaaaagttttaggaaaaaataatgaggaaacaagaagttattttacatggaatttggaaatggaacgtgtattgactgatgtacttagagatcaaaggaatttggacaacaagggtgacggaggttggaaaaggtcaacattgaatgttgcagccgcagtgttatctacaagcttcaatgttaatgtcacatcagataatgtcaaaaaccgtatcaaattatggagatcatggtatggtattgtaagtgacatccttggccagagtggatttgattgggatgacactaagcacatgatcacagttgagaatgaaaatgcttggaatgaatattgcatttcgcataaatcagctaaaccgtttcgatacaaggtgcttcaaaattgggatgatatagtggatttgtgtgctaaagatagagccaccggtcatggagctgaaactgctatggatgctgatgaagtgatgagtagagaaacaaatgaagtggaattcatggggaaaaagagacaaggttcgacttcttctggcacacatcctcacaagagaaagatgggagaaaaagaaggaataacaacttctttggataaaatgacgaactcttttaaccgaatggtggaaaaaatggatggtaaagttgatgatgaagatattcaagaagtattacgtgaggcagctttgatactagatcttaatagacaacaatgggctaaagctattaaatggtggctgacgatccaaaacagttag

SEQ ID NO: 17355 - DNA, 285 bp, Glycine max
  Peptide Sequence Number=SeqID_109040
atgacagaagaagtcacaaatgagaatccacggccaccagatacgcgaaccaggagtataatagcacgagctgccttcgaagtggatgaatatgagagaatagagattttgcatcacaggttgtcgaaatttgataaagggtattggagagcctcatacaatgctcttactttactggaacatcttctaactcatggacctaaaagagtacccgaggagtttcaatgtgatatacatgttattgaagagattggacaatttcagtacattgatgaaaaacggtag

SEQ ID NO: 17356 - DNA, 861 bp, Glycine max
  Peptide Sequence Number=SeqID_109041
atggtctcagcttcttcttctccccctcgcaatgccaaatggtggtactcaacttttcacactgtgacggccatgattggtgcaggtgttctcagccttccctatgccatggcatatctaggatgggtgccagggaccttgtttttgttgatatcttggtgcctgaccttaaactcaatgtggcaaatgatccagctccatgagtgtgttccaggaaccaggtttgatcgttacattgatcttggaaaacatgcttttggaccaaagttagggccatggattgtgctgccccaacaactgattgtccaagttgggtgtgatattgtttacatgcttcccaatttcaattctgttactggggtttctgtagcagctgctgtgatgtcactaagaccattccaggtttccatgattagtgttgctcctaatggtattgttcattttcaaatggcaaagactaatgctcttaatgaagagatgagaatgaagacgcaaggtacttcttctcagtcagaggagagtaaagacaagaaggatcatgatgatgaccgtgtgactactgctactagtgatgatcttgttattcaacatgacattgattcgcttaatcttgtatctgatgaaagcatgaagaagttcttcacatcttacactccaggtgattttggagtcttgaagatggataatgatggtgtgtccaaggtgattggtgttggtgatgtacttgatgatgctggttatgataaccactttggttctggaaagtggaaactcaccaagggtaacctggttgtggccaagggggacaaaatttcaaagttgtattggacgaaagctttggttgccagagacagtgcgaat

SEQ ID NO: 17357 - DNA, 171 bp, Glycine max
  Peptide Sequence Number=SeqID_109042
atggcggagaaacagctcatcgttgcagtcgaaagcaccgctgctatgggaccctattggaacaccattctaatggattatctcgataagatgatcagatttgaggttgtgtactacgtaggtgttgtgttggtggtggtgaagttggatgagagttttaacgttttgtga

SEQ ID NO: 17358 - DNA, 1251 bp, Glycine max
  Peptide Sequence Number=SeqID_109043
atgggaaaacgaaataatagagcagctgatccaccacttgaggctaaaacgcctcattttcttattttaatatcagaaggtttcagggaagcccggggtgctttgagtcgttctgggatcacaagtttgccttcaaatcaaagtcctgttaaagtagatgctgtttctgtaacaccagttacaggggcacccccaacttctatgccagttaatggatctattccaaatcggcaaccagttcctgctgggaatgtggcccctgctactgtaaaagtggagccagtgcctgtaacctccatggtatctggaccggcttttcctcataattcgtcagttcctcgtgctactagtactagtcaaggagttccaagcttgcagacgtcttctccatcttctgtttctcaagatattataacaaataatgaaactgcacaggatacaaagcctacagtgtcaatgctgccccttcgtccagtgaatcctgttcaagcaaatgtgaacattttgaacaatctctctcaagcacgacaggtgatgaactctgctgccttaagtggtggaacctctatgggacttccgtcaatgggtcagactcctgttgccatgcacatgtcaaacatgatatctagtgggatgacatcttctgtacctgcggctcaaaatgtattttcatctggacagtcaggaataacatcaatgactagttctggacctcttactgttcctgcacaggttggacaaaattcaggtctcggttcattaacttcgaacacttctaatttgtcttcaagttcgaacattgggatttcacaaccattgggtaatcttcaaggggttgttagtattggacaacaggtgtccggtatgagccaaggaaacctttcaggggcccaaatggtgcaaggtggagttagcatgaaccaaaatgtaatgagtggtcttggtcaatcagttgtttcttctgggactggcacgatgattcctactccaggaatgtctcaaccagtacaatcagttatgcaaccacttgtgaacaatgccgcagctaatatgcctttgtcacaacagacatcaggtggtatgcaatcggcacaatccaaatatgtgaaggtctgggagtgcactgctctttctgtcatggtttttgataggagcccatctcagggaagcttgtctggacaaagacaaggacagccagtatttatcaccaaacttgaaggttacaggaattcttccgcctctgagacgtaa

SEQ ID NO: 17359 - DNA, 351 bp, Glycine max
  Peptide Sequence Number=SeqID_109044
atggttattcaaaagagtgtttgtttccaagcattcaataacatgacacaagtagcatacaatgcttcaaccaacatcttttcacaagatatgcagcttttcaaagatatgaacatgataattaggtacgcaaatggagattacaatttacaagctcaggattcaagtcaatcactcaatttccagctcaacatgggtgcaagggataattcattcatgcacaagctggtgaagcctatggagtggcctcgcgagcgaccttcgactctaactgaggctcctggactgtggaagcctcacctccccccaaatgagaaggctggactcctggccaggccacttgagaagtga

SEQ ID NO: 17360 - DNA, 279 bp, Glycine max
  Peptide Sequence Number=SeqID_109045
atggcagaatcatccaagaaatgcaagggttcattttcctccaccaccactgtaggccaacgccgccatggtgcttccggtgacactctagcaccacccaatccttccctttcctcaccacgctcactaactatattttcctccgatgatcaatgtcagaggcttgcagctggtgtctcgctaagcgaggcttgtgcgcttagcgagaatcatgcactaagcgaggcacttagcccgcttagcgagttaggagaatatgagaagcatctgcgcgcttag

SEQ ID NO: 17361 - DNA, 165 bp, Glycine max
  Peptide Sequence Number=SeqID_109046
atgaggccgatgcgctaccgaatcacgactgtaatcaacttctacatcgttcatcgttcggaatttggatacgatctaagcgcccttaggggccctctttgttgttttgtgtatcttcatctccttcttctatcattggtaaatctctcttcttttgtaaagtaa

SEQ ID NO: 17362 - DNA, 501 bp, Glycine max
  Peptide Sequence Number=SeqID_109047
atggaagagaggaaatcagatgatgtggtgcacggggactcatcctcctccttgagaagcagtgagccgggttcagtcaagtcaaaggcatggctgtttttgagagagtgcgatgaggcgacagtgagtttctatgacgatgacgatggtgaaccaaagcgggtgaaggcgaaggtgtgctttgaggaccgagtcgatctgaatcgggacatggcgcaggcgatccggttggttcgagccaccattgaagatctctccaccatcgatactctgttgagtggagcaatgaccaacttgtacacgtgccttgatggctttgcgtatagcaaagggcgtgtgagggacaaaatcgagaagaagctgcttcaaagatcgcatcacgtgagcaactcgttggccatgctgaacaaagtgccacgagtgaagaaattaacaacttcttcagaatctgatgaggtgtttccagaatatggaaagatgcaaaaggggttccctttgtga

SEQ ID NO: 17363 - DNA, 339 bp, Glycine max
  Peptide Sequence Number=SeqID_109048
atgaagcaagcattggaaatgatggcggatcttgaagttagaagccaggccgaaacttcagtgaatcaagtagctcttgccttggatcaagtttttgggggtttctgtagaagcaagcttcatgatgatgaatcaaagggtacatctacttgggttgttgtaactgagaacaagaaagggtacatctcttgtggatcagttcaagtggagggtacatctacttggttgttcaaagagaacaagggagggtacatcccttgtagatctttgcttgtaaaggtttttacaaggttgaaaagaaatctcaaggaccgcaggtcgcttggggactggatgtag

SEQ ID NO: 17364 - DNA, 1005 bp, Glycine max
  Peptide Sequence Number=SeqID_109049
atgcaagctcaccaccctttctcctacatatcatcttgtcctggtaatagtactagtagtgccttcttggaacctcatcatcatcatcatgaagctgtagtggatgaagcttccatctccctctctcttggccctcctggccaacaacaccaacaacccaacaaccccaacaaagccgtgacttcttccattcctcaccaccattaccagcaaaaccctactactactactagctctgatgatcatcatcgtcagagaggtggtgtaactgtggcccttcacattggccttcccagtactaccccaacaacttcaccaaacagtgtcaccacaactactactactactagcaagtcgcctgatcttcatttggcctctgctgcacccaacattcagggccagtactggatcccttctcctgctcaaatcctcattggacccacccagttctcttgcactgtatgcaacaaaatgttcaaccgtttcaacaacatgcagatgcacatgtggggacacggttcgcaatacagaaaaggccctgaatcacttcggggcgcaaagccagcatcgtcgatgctgcggcttccctgctactgctgtgcggagggctgcaaaaacaatatagaacacccgagatcacggccgttgaaggacttcaggaccctccagacgcactacaagaggaagcacggggcgaagccgttcgggtgccggaagtgcgggaagccttttgcggtgagaggtgactggaggacgcacgagaagaactgcgggaagctatggttctgtatctgtgggtctgatttcaagcacaagaggtcgcttaaggaccatgttcgtgcctttggggatggacatgctcctcacactgtggagagctgtggtcgggtgggggaggatggcttgttgttgttgggggatgatgatgatgatgagttggaagtggaggaggatgatgaggaggaggattataatagtaatgatttggcttttggttttaattaa

SEQ ID NO: 17365 - DNA, 300 bp, Glycine max
  Peptide Sequence Number=SeqID_109050
atgaaggcacttatatatctctgctttgaagggaagaagatagctttggtagcttggagacaggtgtctgcctctagagatttgggaggtttggggatcaaagacattaaggctgacatagtggaacaaattcgaacaactagactcttcaaacacgtcacaaggtggttggattctgaaagttcatgttgtaatactttagcaaaccttggtgacaaagacatgttaccagcacttgctgccagtgtttgttgccaagcagcagatcttttgactgtttgtggtagccaaagcatctga

SEQ ID NO: 17366 - DNA, 504 bp, Glycine max
  Peptide Sequence Number=SeqID_109051
gctcatcttggtggtgaagctccttcttccatggcttattccctagtggatgacgcctcctctcacctcttctcctttgtcttccgctgcatctccatggtccctgaaagcctccaagtgcacgacgtgaacatgtgttgcacttttgttagtgaaaagagtgcaaccgaccaagtggaggagatacgcgcaggctgctacaacccaccgcctagcccgacacctgctctgctccgtcaacagcacgaccgcgtcggaagtaaccagcggtttgaagctatacagtgcgccagtgatgggaatgtggaaggtgctggtctccctatgccacctctcgatgaaggcgaatataagtctaggatcagtggtgattaccgaacacctgatcagtggactcaatccgatggtcgcaatcatgccttctatctcaggcgctggtctcccaaatttatctacttttctaccatgggagaccaacttcagctcgggtcgttcctaaattga

SEQ ID NO: 17367 - DNA, 474 bp, Glycine max
  Peptide Sequence Number=SeqID_109052
atggatgtggagtggtataaaagctatgtggaatattttaaagctaactatctttgggaagtgaaaaatgggagacatactaatttctcgaatcattggtggattaaggagggaatttctttgaggcagaccttgcgtgcatggcaggagcaatacttgactaatactatcatcaggaatgtgagggagttggtgagaaagcacgctccaaacatccatgaggaaagggaagacaattttgtttggcataatactgatgatggccaatataaagtcaagagagggcaagtattccacaacatattaaggtctcctagcttcaagcatattccaaggaaagtgaacctggtagttgatgcttttgttaaagatgggcttggacaagagcaaggaatgattttttatattgatgttctaatatttgttgtaaatcttttgaagaaggatctggctccttcttcagtgtgttgttag

SEQ ID NO: 17368 - DNA, 979 bp, Glycine max
  Peptide Sequence Number=SeqID_109053
atggccctaagaaagcttccatcaaagaggtccaagaaggacgccaccggagaaggctccagcgctgcccagccaactgacacagattttgacaggcatcgattttggagcgccgagcatcaacaacgctttgagaccatcaagggatattttacgccaatgcctagcctaccgaagaacgatttcgggatatgcgctcctgggaggagtcaggtctctggttttgacgaggaggccattgctcagcttttgtgcatacaggggctggatttcgcccggaccactacacggagacgggtgaggattatgcgcaccagcatgaacaccctaacccagatatggatgacgttgctgctgcttagcaacattttacccagtgaccacaactccaatcttcctttaccaaagtgtcaactagtgtatgccatcctgatacaggtcagtattcacgtggctcatttgattgctgatgccatctatcagtttgcaggaatggtgcctacgagacaccctatggacccggagaggtccaacagggccctaggattcccagctctaatcacgggcctcttccagttctacgaagtgcccgtcacccccagcaagatcattcggcctcccattactagagccttcatcgagaagtactacatcaccaggcaggcatgcgccatcgccgccacgagaggaggcaccgtctccgaggcggctaatcacagagggcggcggtggctgaatgagatgttctatcattacaatctacaccagcaaagtcaggaccccagtcctttcccttggcccactcccgagcagttcgaggccacggtggcctggcctggggacgaggccgagtttgagatgcaagcagggcccacggggacctctggaggtggggacgaagcccaggatgatcaggacttggcagacatgttggatttcctcctccgagaaggacagggactaccatattgccaaactt

SEQ ID NO: 17369 - DNA, 393 bp, Glycine max
  Peptide Sequence Number=SeqID_109054
atgaatcacaagtttggcaatctggtcgtctctgtccttcttagaggaggaagtccaacatgtctgccatgtcctgatcgtcttgggcttcgtccccacctccagaggccaccgtggcctcgaactgctcaggagtgggccaagggaaagaaccggggtcctgactttgctggtgcaagatgcgatcagagatggacctcagagacggtgcctcctcttgtggtggtgatggcgcatttgttgatcctcctcaggctactatggtgcctggccctgcgcctacctagggatgcagtacttctcgatgaaggctctggtaatgggaggtcgaatgaccttgctggtggcgatggacactctgtagaactagcagaggcccatgatcagatctag

SEQ ID NO: 17370 - DNA, 483 bp, Glycine max
  Peptide Sequence Number=SeqID_109055
atgtgggcctttcataaaggtttacaaattgattgggcacatcttgttagatatcgcatgcataaggcattgcgattgaatgctcctttgccatatcctcatctagtcacccttttccttcaacacttcaacatccctcttgattctgaaccctatgttccaatcaagagatccttccttataggcgcttcagtcatagcatcctttggttatcaaaaagagcatgatggctcttgggtgaagaagggtgctcgacatgttggtgaagaaggacatgatggagaagattcatctcttctttcaaagattttggacaggtttgatggccttcaaacctttgttggtgaaaggtttgacactttggaattacaagtggatatgcgcttcaatgagatggagtcaagaatcaccaaggttgaagaagatgtgtcttacattcgttcaagctttgatctaccaccaccgccaccaccatcatcttag

SEQ ID NO: 17371 - DNA, 270 bp, Glycine max
  Peptide Sequence Number=SeqID_109056
atgggctcaaaatctatcctaaggctcatgagaaccctaggcccttcccttggatctctagcccaatctacttggagtcttgtacccaatgcccttgcggagcgttgcctacgacctgtggtcgaccagcaggtgaccaagtccaacgccaaagataagcaaaagtactacgtccgtgaccgacaagtcatcacgcatccaactcaagacgttaaggaagtgctactaggaggcaaccttgtaccttttaaatctctgcttgttatttga

SEQ ID NO: 17372 - DNA, 384 bp, Glycine max
  Peptide Sequence Number=SeqID_109057
atgacaccggtaaaccgaaaggcaggaacaggagagcgcacgagggagccgccagggggaaacgcctggggggcggagcctatggaaaaacggctttgccgcggccctctcacttccctgttaagtatcttccggctcttccaggaaatctccgccccgttaggtaagccattccgtcgcttcattacagtcgaattccgagcccgggtggagtcagttctgagcgggaacgcggtgatattccctatacgaatggcagacaggtttcccgactgtagcggcgcagtagcgcggcatgtggtggttacgcgtcactcgaccgcttacacttgccctgatgtccggcggtgcttttgccgttacgcaccaccccggaattcgtag

SEQ ID NO: 17373 - DNA, 1074 bp, Glycine max
  Peptide Sequence Number=SeqID_109058
gatcgcggcgcctcgactgtcccggcggtcatgatctgttccgttccatcgcgtccgtgcggactcgcgtggcttctcctcctgtcgcaggggccgcgtacagtggaatctcaaccgctctccgcacgagccgacgcctacgcggccctgcacgacgagctctcccgtcgtctggagagcggcgcgaagctcgagcagcgggagacctcgggcacccgatgacgcgactcgacgccgccctcgccgcccgaggactcgcccgttcgcgcagccatgcagcaacgctgatctccgatggtctcgtgagtgtcgatggccgcccggtcgtgaaggcgtccaccgccgtcgacgatgcggctgagatcaccgtcgccggtgccgaccactacgtcggtcgcgctgcccacaagctcatcgcgggtctcgacggcttcgggatctccgcacagagacgactcgccctggacatgggcgcatccacgggtggattcacccaggtgctccgggaacgtggtgcacgcaccgtgctcgccgtcgacgtcggacacggccagctggcgccatcgatccgctccgacccgggcgtgatcgtcgtcgagggatacaacgtgcgtcacatgacgcgtgagaacctcacggaggcgacgggggaggccgacgctcccgagctgatcgtgggcgacctctccttcatctcgctcgagctcgtgctcccggccgtggcggaagtggccgcccaggcagccgacgtcgtgctgctcgtgaagccgcagttcgaagtcggccgcaccgcggtgcgcggcggcctcgtcaccgatccgaccacgcgtgccgacgccgtcgcgcgcaccgtgtggagcgcgtgggacgtcggtctcggaatgctcggcatccttccctccccgatcctcggaacgcacggcaatgccgaaatggttggacaccatcaaccgactggcaggaggacgatgaacgagcgcagcatcctggtcgtcgcccacgccggccgtgtcgacacggtcgaggcggcacgtcgtgtgatcaacgccctgcgcgacgcccggggcacgaccg

SEQ ID NO: 17374 - DNA, 336 bp, Glycine max
  Peptide Sequence Number=SeqID_109059
atggtgaaagttggaactcttacgtgccgatcaacgtctcattttcgccaaaaagttggcccagggcttcccggtatcaacagggacaccaggatttatttttttctgcgaagtgatccttccgtcacagctgtccctcctgttcagctactgacggggtggtgcgtaacgggcaaaagcacccgccggacatcagcgctggcaaagctgcgcaactgttgggaaagggcgatcggtgcgggcctcttcgctattacgccagctggcgaaagggggatgtgctgcaaggcgattaagttgggtaacgccagggttttcccagtcacgacgttgtaa

SEQ ID NO: 17375 - DNA, 388 bp, Glycine max
  Peptide Sequence Number=SeqID_109060
ttggaactcttacgtgccgatcaacgtctcattttcgccaaaagttggcccagggcttcccggtatcaacagggacaccaggatttatttattctgcgaagtgatcttccgtcacaggtatttttcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 17376 - DNA, 588 bp, Glycine max
  Peptide Sequence Number=SeqID_109061
atgggttcatatatatctgtctttagtctttgtcgggctattcgcctggcgaaacggattgacagatcgatattgaaatcgatagtcaccccttccaccggtctgccaagacagtctcaattaaaaaatgatattgtcgctttctctaaagacctgatcctaaggtactgtcctagttttctctcaactcccttgtgtcaggggtacgttgggagccaacttggaaagcgagaccttcgtggaggccgtaaagggtttcctcaatggtccccctttatccgatacccttatgaccaaaagaatgaagagagatctccatggtctacagagaccgctgagagtaccatccactctctttcgggtctagacacttcggtgagtctattgactcaggctcccctggtagactatcgcaatctaccgaggctggcgctgtctgccaccgataggtggcccctcagtctgaagactcaccttattagaactttatttggtaagtctgttggagattgtttagatgcaatcttcagcagatctatgaagtaccctttcttcgctcagttcgaggtgtcgtattctttagagtag

SEQ ID NO: 17377 - DNA, 522 bp, Glycine max
  Peptide Sequence Number=SeqID_109062
atggattatgattatgataatgaagaagaatgtggtgtgaatgaaccacatgttgattgttcaaatgcttttaatacgtctcaggtatttggtactcgagatgatgttttgcagtgggctcaaacagttgcccatgaaaatggatttgtagcagtgattatgaggaataaagatttcgttagaaaagacactgggagtaggaaatgtggttgtcctttcaggcttcgtgggaaaccagtgcatggagggaaaggttggatggatgaaaagaaaattattgctgatatgactaagtttgatggtgaaaccaaaaaacatcttgctaacgatgaagttgtggtgcgtgatctgttttggtgtctcccagatgcagtagagttatgcgatgcatgtcatctggtatttgttatagacagtacctacaaaacatacaggtacagactcccactacttgactttgttggagtgacaccaacggcgatgacattctctgctgggtttgcatatctggaggctgagcgt

SEQ ID NO: 17378 - DNA, 644 bp, Glycine max
  Peptide Sequence Number=SeqID_109063
gtgcaagagggatgaaggccgacatggaggccttgaaagaacagatggccacaatgatggaggccatgatgagcatgaagaagataatggaggtcaatgcgactgcagttgccgctattagccctgtttttggggtggacccgactcccccatctgacctcaacctaataaatcatccaaccgcggatacgggagacccccattttgtgcaagcccagaacaagcaggttttcccgccatatggttttcctccaaactatactccacctaatgagaatgtcaataacttcacttctatacccattgagagccaacaacctcaatctgatcatgcacatgtctctcaacccatgggtgagacacatgaaatgcgccaccacaatctagccgacttccagccttgcctcggatatgccactgaagggcaagcagttggtgcgggtaaaaaccctcatgctatggcaaatatgggaaagttggatcatcaagaggaaaggctcagggccattgaaggaggtgaagattatgcctttgctaacctagaagagttgttcctagtacccaatatcatcacccttcccaagttcaaggtgccagactttgacaagtacaaggggactacttgccccaagaacctccaatga

SEQ ID NO: 17379 - DNA, 300 bp, Glycine max
  Peptide Sequence Number=SeqID_109064
atggtccatgacatcttcgtcaaggtgaaactggaagtaacagggacatcgacagccctaaatgtgtttggcaggagacgaagcagcgatatggttacttccatacttcaacttgactcgatgaaccttttcgtaaaagcacgagcttggttcaaccccataacccagggaatggcaattttgatcgccaatacttcatcaacatttcatagggatgaaagactcgggaatacgcatgctatgcatggaaaatgtaattatgagtttgagatgcctgaagaaaaatcttttcttagttaa

SEQ ID NO: 17380 - DNA, 812 bp, Glycine max
  Peptide Sequence Number=SeqID_109065
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtggatagattgaagcctttactgcctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttctgcctttcggttaccggtgtcattccgctgttatggccgc

SEQ ID NO: 17381 - DNA, 52 bp, Glycine max
  Peptide Sequence Number=SeqID_109066
atttttccatctttttcttgaagatgggacaatcaaccctcagatggtccag

SEQ ID NO: 17382 - DNA, 306 bp, Glycine max
  Peptide Sequence Number=SeqID_109067
atgacgctggcgcgcctgctctatccgcagatggatgccattttgtgtaccaacgatgatctggcggtcggcgtgctgcaggagtgtcagagggcagggattgcagtgccgcaggtgctggcgattgccggattccacggactggagattggtcaggcgacaaagccgcggcgggccagtgtgattacaccgcgcttaaagatgggcaaagtggcaacggaaatagtgttgaagaagattaaccagcagcccaccattgaacaggtggatgtgcattatcagctgtcgatgggcgccaccatttga

SEQ ID NO: 17383 - DNA, 515 bp, Glycine max
  Peptide Sequence Number=SeqID_109068
ggcttcccggtatcaacagggacaccaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattcttaacgagtttctagagaccctagtcatcttggatcctagggagagagggggccccttagaagctgttgaggaaggacctcaccacactcgcacagacatggagtgtcctctactactctaa

SEQ ID NO: 17384 - DNA, 576 bp, Glycine max
  Peptide Sequence Number=SeqID_109069
atgtttgacgagttcctccaggaactcaggaggcacagatgggaccaggtgctgactcaccttccggagaagcggatcgacgtggctctggtgaaagagttatattcgaacctttatgatccagaggaccagagtcccagattctgcagggtgcgaggacaggtcgttcgttttgatgctgacaccattaacgacttcctcgacaccccggttatcttggaggacggggaggagtttccagcatacaccagatacctcagcactcaccccaatcctgacaccatcgcggccacactgtgcactccaggggggcgctttgtccttaatgctgatggtctcccctggaagctgctgaggaaggacatgacgacacttgctcagacatggagtgtcctttcttattacgatcttgcgcccacttctcacacatctgatgttaatcttgacagggcccgcttgatctacggtttgctttatatcacagcagatcagccagattgcccagtccagcacctcgaggctcgggttcccagcgttgattacagcgctgtgcgacattcagggggtggtttctga

SEQ ID NO: 17385 - DNA, 174 bp, Glycine max
  Peptide Sequence Number=SeqID_109070
atgggacactatggcaagcgagtaggaatacaaaagatggaaaatgagtttgatgctctccaaaccttagctcaggctatggggaatcaaaataggggagaagctgctagagctgctgagtatcatgatttggattgcttccagcggaacaatccacctgcttgcaatggatga

SEQ ID NO: 17386 - DNA, 245 bp, Glycine max
  Peptide Sequence Number=SeqID_109071
gagggaagataaagctaaaaacccctgaagaggcaactgaattgattgagaatatgtctcctagtgatcatgctatcctgatgctttattggcacaaaataagtttctctctgatgcaagctccattggagcttgtaggcctaggaccttcttcatcaatggattcctttgattcttggaagatgaatggcagcggaatggagaaaggaagagagagaggagacgccacttcaaggagaagatga

SEQ ID NO: 17387 - DNA, 315 bp, Glycine max
  Peptide Sequence Number=SeqID_109072
atgaatattgaggaatccattcatgttacctttgatgaatctaatgctatcttgtcaagaaagaatatgctagatgatattgcagattctttagaacaaatgcatattcatggacaagattctaaaggaaatgataaaggaaacaatgaagatcctccagaagaagctccattggagcttgtaggcctaggatcttcttcatcaatggattcgtttgctccctggaagatgaatggcagcgaaatggagaaggaagagagagaggagacgccacttcaaggagaagatgagtctagaagaagctcaccaccatag

SEQ ID NO: 17388 - DNA, 390 bp, Glycine max
  Peptide Sequence Number=SeqID_109073
atgcagagacaggtccaaggtgatgcaccacaggccgcggatgcgccgccacctcatcaggctggtccggccggatcatttaacacggagcagtatttgcggcatttggttcgccagcaggcggccaaccaccgggcacatgtacagactcatgattgtctttatcagatgagtctcagcctgcagagccagggctttacttctttttcatgccctactccggaccagttcagggcagaggtcgcatggcctggagattggcctgaggcccaggcaggagaggcaccagcaggggcaccagcagaggctcccgacaaggcagatgaggcccgcgaggatgaagagatgaccggtttacttgatttcttaggagggagcggtgccacatga

SEQ ID NO: 17389 - DNA, 634 bp, Glycine max
  Peptide Sequence Number=SeqID_109074
atgagctaccgcgtaatcgcccttgacctcgacggcaccctgctgaccccaaacaaaaccatcctgccagaatcccttgaagccttagcccgcgcgcaacaggctggcgttcaggtgctgatcgtcaccggtcgccatcactgcgccattcacccgttttatcaggcgctgcagctgacaacgcccgccatctgctgtaacggtacgtacctgtacgattaccaggcgcaacgggtgctggcggccgatccgctggagaaaagtcaggcggcgcgggtgattgagatgctcgatcaggagaatattcacggtctgctgtatgtcgatgatgcgatgctgtaccaggaagcgaccggccatgtgacgcgcaccctcaactgggcgcagtcgctgccgaaagcgcagcgcccgctgtttgtacaggtgccgagtctggcgcaggcggcacacgacgcgcagtcgatctggaaatttgccctgtcgcatccggatacccgcgcgctgcagcagtttgctgaacgcaccgaacgcgagctgggtctggcgtgtgaatggtcgtggcacgatcaggtcgatatcgctcaggccggcaacagcaaaggcaaacgcctggcgcagtgggtggcgagccagg

SEQ ID NO: 17390 - DNA, 497 bp, Glycine max
  Peptide Sequence Number=SeqID_109075
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaagctgtgtcccgatttccggtaaccttgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 17391 - DNA, 380 bp, Glycine max
  Peptide Sequence Number=SeqID_109076
ggcatctctacgtgccaacgtactcacaggtcacgacaacaaaagatggggtggtcgacaaaagcgaggcttttgctcctaattatcctcaatttgtgatgaggaactcagacctacatgctgacatctccggaaagggtgcagatgaccacattggtctctgcgtgtcaatcgggcttggggatagcaaaacgtgtgtgtggataaccatcgagtgtctccgcgtgccaccagactcacaagtcacgatagcaaaatgtggggtggtcgacaaaagtgaggcttttgctcctacgtatcctcaatttgtgatgaggaactcagacctacgtagttcttgcttttgtgagactaaaatagtctcggtgttccttcactaa

SEQ ID NO: 17392 - DNA, 447 bp, Glycine max
  Peptide Sequence Number=SeqID_109077
atggagtcaccatatcaattaggttgggatcatgagctgaagggtgataaagctgcaaagagtggtgaaatagaagcagagtcaggtgatgagcataactacacagagaatcataaaccatgcaacatgtccaaggagagtggaaattcaatcccaatcccacacaagggtcaaggaatagctgaaaaactcacattggagtttacatttcacttatggtgcctgatgggacttcatgggacttctagttcccagtgtggtgtcagaaagttggaccttcaatgtactgagaaaacacaacagcaaaccattgaaattagtgcatttggaagattttatttacaacttatcttatggcatacatacttattaatgtcaggcataggcacgctgcttgccactttagaagcagttgaaacaactttagaggcagctgaaccactttag

SEQ ID NO: 17393 - DNA, 216 bp, Glycine max
  Peptide Sequence Number=SeqID_109078
atgtaccctctcttgttctcagttacaacaacccaagtagatgtaccctctacttgtaccacgaaggatgtaccctccaatctgttaagacaaagttctcaggcggttagtcctttgaaactttgtgaaggggaaacaaaagatatctcaggcgagcaaggtttggaaaccaggaaacttagaaagcttttggcaaaggaagaagaagaagaataa

SEQ ID NO: 17394 - DNA, 414 bp, Glycine max
  Peptide Sequence Number=SeqID_109079
atggaactccaacgtcttaatcaaaatgaagaaatcgacaaaaagaaaagaagaaatgaagaagaagaatcagaagatgaagaagacttcttactctttgtgaagaagtttcaaaaatttgtcaagaaaagaagaattgagaagcgtcagaacttcaacaatggaagaagatctcaagaagactctcaaattcttagatgttacaaatgcaaccaacttggtcacatcaaagcatattgtccttcaaatgaggaatggcctgagaaaagtgataagaaaaggtatgaagaaagaaggaccaagaaggcctacattgcatgggatgacaatgactcatctgacggttcagagaagaagatcaaccttctaaccaaggactatgagagtgatgagaacatctctcaagaagattaa

SEQ ID NO: 17395 - DNA, 364 bp, Glycine max
  Peptide Sequence Number=SeqID_109080
atggggacaaatcaaaccagcaagaggttttaccaagtcaaggttaaaggcctagatgccaccagcatcaaggaattagggcggttgatggaacctctccaaatgcaagccttccgcaagacttacggaaagatcttagatttaaccatagcagaggtatccatagaagccattgcatcactcacccaatactacgaccagcctttgagatgcttcacgttcggagacttccaattggtaccgaccattgaagaatttgaggagattctgggatgtcctctcggggggagaaaaccatatcttttttccgggtttctcccctccttgagcataattgcaactgtggtcaaggattcagcaagag

SEQ ID NO: 17396 - DNA, 324 bp, Glycine max
  Peptide Sequence Number=SeqID_109081
atggctccgagaaagctttccacaaagagatctaggaaggacgccgcagccgaaggaactagtgccgctcccgagttcgatagccatcgtttcaggagcgctgaacaccagcagcgtttcgaagccatcaagggatggtccttccaccgagagagacatgtccagctcagggacgacgagtacatagatttccaggaggagatagctcgtcggcgttggatgtcgctggtcactcccatggccaagtttgatccggatatagttctggagttttatgccaatgcttggcccaaggaggagggcgtgcgggacctgcgatcatgg

SEQ ID NO: 17397 - DNA, 954 bp, Glycine max
  Peptide Sequence Number=SeqID_109082
atgcgggatatgcgatcttgggggaggggtcagtggattcctttcgatgcggatgccctcagccagttcctgggataccctttagtgctggaggagggccaggagtgcgagtatggccagaggaggaaccgggccgatgggtttgatgaggaggccatcgcccagttgctgtgcatactgggacaggattttgcccagaccgctgccgggagacgagtacggatcatgcgtaccagcatgactactctgacccagatatggatgacgttgctactcagcaacatccagcccagcgaccataattccgacctccccctgcggaagtgtcagctggtatatgccatcctgacacagatgagcgttcatgtggctcagttgatcgctgatgccatttatttgtttgcaggtatggcgcctaccaggcaccctctggacccggataagtccaacagggccctgggatttccagcattgatcacaggactctgtcagtcgttcggagtccccgttgcacctagtatggtgattcggccacccatcacccgggcttttattgagaagtattgcacgcagagacaggcccagggtgatgcaccacaggccgcaggcgcgccaccaccacctcatcaggctgacccagctgggtcatttgacacagagcagtatttgcggcactcgatgcgccagcacgcggccaaccacaggggactggggcaggtccatgagtgtctctaccagctaagcctcagcatgcagagccaaggtgtcgcaacctacccttcggcgggaggacgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 17398 - DNA, 210 bp, Glycine max
  Peptide Sequence Number=SeqID_109083
atggcatcttcatcatcatcttcatcacatgttaacattaagtctggtcccatcgatgctgataacatgtttggaatggggaagaagataggaaattacatatcagacgagctgtccccacgtatcaaggggaagaacaaattcctgagcaaatttttccttttcttctacaatctggtttcgcctggattatcaagatggggtacttaa

SEQ ID NO: 17399 - DNA, 545 bp, Glycine max
  Peptide Sequence Number=SeqID_109084
aacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatatcccaaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggag

SEQ ID NO: 17400 - DNA, 740 bp, Glycine max
  Peptide Sequence Number=SeqID_109085
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgattcgggtatggcctcgatcaaatttggcgtcgttgctggggagcagtgtccaaagtgtggtgttttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17401 - DNA, 489 bp, Glycine max
  Peptide Sequence Number=SeqID_109086
atgaccatgattacgccaagctcgaaattaaccctcactaaagggaacaaaagctggtaccgggccccccctcgagcaacgacgccaaatttgatcgaggccatacccgaatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17402 - DNA, 891 bp, Glycine max
  Peptide Sequence Number=SeqID_109087
atgtcctcgccatcagagggctgcatgtcctcacctttagagggctccacgccatcgccttcagagggctacacgtcctcgccttcagagggctacacgtcctcaattttagagggctacacgtcctcgccttcagagggctacacggcctcatcttcagagggctacgcgctctcgccctcagaagactacacgtcctctcctttagagggttacacgccctcaccttcaaggggctacatgccctcgccttatgaggactacacgtcctcgctgtcagagggctacgcgccctcgccttcagaggactacaagtcttcaccttcagaggactacacgtcctcgcctttagaggactacacgtcctcacctttagagggcaacacgccctcgccttcaaaaggctacacgccctcacctttagaggactatacgtcctcaccctcaagaggactacacgtcctcaccttcagaggactacacgtcctcgcctttagagggctacatgtcttcacctttagaggactacacgtcctcggcttcagagggctaaacgttcttatcttcagagggccacacgccctcgccttcagaggactacacgtcctcaccttcagaggactacatgtcctgccttcagagggctacacgccctcgccttttgagcactacacgtcctcgccttcagagggctggacgccctcgcctaaagagggctgcacgccctcaccttcagagggctacacgccctcgcctttagagggactacacgtcctcgccttcagaggattacacgtcctccccttcagaggactacatgtcctcgcctttaggggactacacgtccttggctttagaggactacatgtcttcaccttcagaggactacac

SEQ ID NO: 17403 - DNA, 474 bp, Glycine max
  Peptide Sequence Number=SeqID_109088
atgacccaagagctggtagcccgcggagacaccttacagttatccgcacctcgtcattcagtgaccccaagtgtgattgacgagcagaggccaatgtggtcatctgcgccctttccggagatgtcagcatcttccgacacagtcgtgtccgatgacgcacagagacgaaaattggtcattctgcaccctttgtcatctagaggcggcgggcccgatgacacgcggagacaaaatttggtcattccgcacccctttgccattcagacacagtcgtgtccaatggcgcgcagagacaaaaattggtcattctgcaccctttgtcatccggaggcggcgggcccgatgacacgcggagacaaaatttggtcattccgcacccctttgccattcagacacagtcgtgtccgatggcgcgcagagacaaaaattggtcattctgcaccctttgtcatacagaggcggcgggcccgatga

SEQ ID NO: 17404 - DNA, 462 bp, Glycine max
  Peptide Sequence Number=SeqID_109089
atgtcgaaaaagccaggcgagcgtaaaggcacatggcattacggaatcattgcatacaactcgcttaatccagattcgaccttaatttactcagctactccagccggtaaaacaggtttggatttcgagcagactcattactcagacagtgctataaaaattaattctgaaggccctaaaactggcataagtttcacgcattatgatggtggtcagatttactctaaaggtcgtgaactgttcattcagcctggtcaggagggattaacgattgccgcgcctaacggcgaacctgtgtggcgattcggtgtcggtggtagcgtgtggtttaaaggcttcaacctcatgaaggtgggcatcccagcaggtttgattctgctgattgttttcgtgttcatgcttcttcaaattatctcgctgcgtaagcaggtggctgaaattaagcgtatcgttaaaggttaa

SEQ ID NO: 17405 - DNA, 345 bp, Glycine max
  Peptide Sequence Number=SeqID_109090
atggcctctttagattttttgtctttcaaaagtattttcaggaacaagtttttccaagatcatgatgaagaccaagtcaacttgtgtctcatgacaaaatctgatgagaagaacaaagaaaactctgtaaggaagaagtggtacatagacagtggatgttccaagcacatgacgggtgatgtatccaaatttacaaccatttcccccaagaaaagtggacacgttacatatgacgactgtcataccctaatttcgtccggggaccatccgttgttgggatgcgaccctcgtttgaccacttcaaggtactttgcacccattgttaggcaattcgtgaagttctga

SEQ ID NO: 17406 - DNA, 540 bp, Glycine max
  Peptide Sequence Number=SeqID_109091
atggagatgacactagtgagggccaacattgaagaggacaccaaagcagtgcatgatggcttcaccaacaagatttctttccagcaccatgaccagaaaattattcttaaacctctatcccttagagaagaatttaaagatgtctttcccaaggagattccccatggactgccaccttcaagaggcatagaacatcaacttacaaaatcaatcccccaacatagggatgcacaggccaaagttgagtatgtgaaaagattgtatgaccaagtgaaggtgcaaattgcaaaaaagaataaaagcaatgccaagcaagccaacaagaacaggaaggaagtggtacttgaacccgatgatgatcctggacatttgagggcaaatgctttccaagaaggagggaatgatgagaatcctgaaactgaccaaacacaggataaaggcccaagtggagaaggacaaagccctcgagtggagaaggatgaaggcccagaggcagaggcactaccaagactattaattgttgctgaaggcctagattaa

SEQ ID NO: 17407 - DNA, 703 bp, Glycine max
  Peptide Sequence Number=SeqID_109092
ggctacacgccctcaccttgggtactagttaccctcaccgttgagaggactacacgtcctcgccttgagaggactacacgtcctcaccatcagagggctgcacgccctcacctccagaggactacatgtccttgccttgagagggctacacgccctcaccttggaggactacatgtcctcgctgtcaaagggtacatgtgccttcacctttgtagggctactagttaccctcaccgttcgagaggactacacgtcctcgccttgagaggactacacgtcctcaccatcagagggctgcacgcccttactccagaggactacatgtcctcccattttcaaagggagggcatcgccctcaccttgggtactaggttacccttgccaccgtcagtaggactacacgtccctcgccttcgaaaggctgacacgactataagtcctcgctttcagtgggctacagccctcaccttgggtactgggacagtagtcttccttttaacggttcctgggccaccccctgatattggaggagggccaactgtgcgagcacaaccagagagggaggctatcacacagctactatgcatactggggcaagatttcacccgtgctgctgcaaagagaagacaacattctgcccagcgaccgcaatgccaatctccccctgcggaagtatcagttggtctgtgccgtcccgacatgg

SEQ ID NO: 17408 - DNA, 240 bp, Glycine max
  Peptide Sequence Number=SeqID_109093
atgtcttttctgatggcagtggtcctagatgcagggatgaatttctccaagaacgccctcttaagatgtcgcgacgtgcccttttgcgggcgagcgagggcgaggctcacgggtgcgctttccaaaggaggaaagatgcgcggagtcgccaccaatgtttatttgtggaaaacatcggaaaaatcgaaggaaaccggtcaaaatgaaaattctaagtttgggagttgtatttacgcttga

SEQ ID NO: 17409 - DNA, 231 bp, Glycine max
  Peptide Sequence Number=SeqID_109094
atggcaggagctggtgacaatggtggtgtatatcatcaactggacgaatttcagcgcttgttactggacgcgatgacttcacaaatacaacgtttgttgaaccataataatgaagtgctctacaggcgaatagaacgactagagcaccaaatgaatccaaattctaggagaccttatggtggcaacataagggcaggagtgatccaaatgcctatgttgactgggagatga

SEQ ID NO: 17410 - DNA, 327 bp, Glycine max
  Peptide Sequence Number=SeqID_109095
atgggggataatcttcttcgtcgagagggaaacagcccggatcaccagctaaggcccctaaatgaccgctcagtgattaaggaggtttgggtgcagagacaaccaggaggggagcgttccgccttaaagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtctatggacaacaggtgaatattcctgtactaccctttgttggtcccgagggacggatgaggctaggttaa

SEQ ID NO: 17411 - DNA, 396 bp, Glycine max
  Peptide Sequence Number=SeqID_109096
atggccactccaatgagcactacttgctatttggataaagatgaaatcggtcaatcaatagacataaagaaatatagagtacgatactctcactctgattttgctggaagcaaaactgatagaaaaagtactagtggcacttgtcatttcattggttctgctctaatagaggaagcaaaagaacatcacctagatgatgatgctctgataccacgtaatgtagctccatgtagagcttgtagaccttggatcttcttcatcaatggagccctttgcttattgaagatcaatggaagcggaatggagaatgaggaaaggttttggagatgccacttcaaggagaagatgagtcaagagcaagctcaccaccataggaagccatatataagagcttga

SEQ ID NO: 17412 - DNA, 210 bp, Glycine max
  Peptide Sequence Number=SeqID_109097
atgggactaccagcggcaacgtatcatcaaaagaggaaaactttagatgagacttcattgttatcaagcaagttgaagacccagaataaccacagatcgacctccacttccaatgtctcacacaaacccaggcttttgaaagattcatttttagctaacaagaacaaaaagaggtcgttaaggtgttggaccttgaacgatctcaaatga

SEQ ID NO: 17413 - DNA, 1470 bp, Glycine max
  Peptide Sequence Number=SeqID_109098
atgaaggtaggtctgtctgccctctacaaggtcatcgcatgtgcaccaaaaagggaaaagcaaattgggaagaactcttggcagatatggattcccaaacatccccttgatgggaatgaggggttgtataattataataatcccatgttggccataagacaactaggctaccctatgagaggtgcgccatcggaggagatcatcgcgcctttcatcgcgaaagataaggagcttaagggaagtagcaatggcgtcatcgacggctatcacaagtggttgaagtcttggacgcaagggataacttggctcctaaagctaaaaggcctaagtgggaaagaagctaaagtccctgaggaaagcgaagaagtgcaagctttgaaagaggaactcgaaaaaatgagagtggtcaaggagaagctaaagatgacagtcactagggtcaggaaaaagtgtgatgagctgagagatgtcaacatgactacggttgaagcattagagtgggaaacaaaaagggcccaaaaggaagaatggagcaggaacaagttccgaggggctctatggggcagcaacaacgagctcaagcttagaagggccgagagggacgagttaaggatggaaagcatggtgttaaaggataagttaaaggcctgtcaaagggcgaagaggagtttgacggaacaactgagcaaaatggaagagaatatgttgacaattattgatcaatataaggaaaaggtgaacctagctgctagtcatgggttgttagccagagccaaggcaatggttgacaagtacttggctctcaatgaagttcatggtctttccgattactgccaacacatgcacccttaccgaacacgtgccaaagctaaaatcatgagtgaaatagaggaggtgcaagagcagatgaaggccgatatagaggccatgaaggaccaaatgacaaccatgatgagcatgagaagaatgatgaaggtcaacacggctgcagttgccactactagcgctgccgctgaggtagatccgactcacccatctggcgtgaatcaaatgagtcatccagtcccagacgtggtaggtcagggaggagaagcattgggaagtacagacggaccccatgttgtgcaaagcaagaattctttcccaccatatggcttgcctcccaactatgcaccacccaatgttgtacatgtgcccaacgagaacgtcgaccattccgctcctgttccccttgaaagccagcaaccccagttggggcatgcacattttgctcagcccattgagggggggggggggtatgtgaagaaccccgagaccatgctctggtcgacttcgagccttaccccagatatgccactgaggggccagcatttggtggcatgccctagcctaacaccatcgcccgctgcaacccttacatttctcggtgggaagactgcttctggccatggaggaaagagagaaatttga

SEQ ID NO: 17414 - DNA, 362 bp, Glycine max
  Peptide Sequence Number=SeqID_109099
tgctagacataggtgatggtaaacttgcagaaccaaatgatggttatggtgaaatcaccatcccagatgagtttcttatcaaggactttcaagatcctatccaggcaattgttgaagcaacatatccagacttattacacaattacaacaatggagatttcttgcaaaaaagagttgtccttgcctctacaaaagatgttgttgataaaataaatgactatgtcttgtctttgattcctggtgaggagaaagagtattgtagtgctgattctgttgacaaatcagatgaactacattttatagggggagtattgtattgtcatcatcaaaaagggggagattgtagatgcaattggctttga

SEQ ID NO: 17415 - DNA, 616 bp, Glycine max
  Peptide Sequence Number=SeqID_109100
aggactgcatgtcctcaccttcgtagggcatcacgccctcacctttagaggactacacgtcctcgccaacagagggctgcacgccttcaccttgagaggactacacgtcctcaccaacgtagggctacacgccctcacctttagaggactacacgtcctcgccaacagagcgacacacgccctcacctttagaggactacacgtccacgccttcagaggactccatgtcctcaccatcagagggctgcacgccctcacctccagaggactacacgtcctcgccttgagagggctacccgccctcgccttgggtacttttacctatcccctccagaggactacatgtcctcgccttgagagggctacacgccttcaccttggaggactacatgtcctcgccttgagagggctacacgccttcaccttgggtactagttaccttcaccttcagaggactacacgtcctcgccttgagaggactacatgtcctcaccatcagagggctgcacgccctcacctccagaggactacatgtcctcgccttgagagggctacccgccctcgccttgggtacttttacctatcccctccagaggactacatgtcctcgccttga

SEQ ID NO: 17416 - DNA, 84 bp, Glycine max
  Peptide Sequence Number=SeqID_109101
atggcagggaaacaacctatgggacgatttggtgtgcgcgtgtttgctgtctttggagcatgtattcagtttcataagggctag

SEQ ID NO: 17417 - DNA, 372 bp, Glycine max
  Peptide Sequence Number=SeqID_109102
atgtcaggatgtacacacgattctcctcaaatttcagccagcccatatcaattagaccttgcaccttacgcttcagagccctacaatgctcaatggaacgccccggggcttctccatgacaagcacacgttgcgttcgagtcgtattctcggagaaatggaggttgatgaaccttggctggggttatggctgccattgaattatcaagtagatatgggagcaagtggtgttcgtcattggaagtgcggtagacaggctttgggggttgatttagggatggctgttgtggataactgggtggtgggtaaggagaaggtttgttattggctgagtaatgacattgttgggttggtgggaaacttggttgtatag

SEQ ID NO: 17418 - DNA, 403 bp, Glycine max
  Peptide Sequence Number=SeqID_109103
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctccatgctggagatggagaaacttag

SEQ ID NO: 17419 - DNA, 197 bp, Glycine max
  misc_feature (170)..(170): n is a, c, g, or t
  Peptide Sequence Number=SeqID_109104
atccaaaggaggactgtgagcatgattcgatcagcccttgctcccaagataaaacacaacatgttgaagaagacaacattgaaggccttgtggtagaagctcgagaatatttatgtgtcaaagtcgctaaccaatcacctttgtttgaagatggagttgtttcaactcanaatggagatgggaggagatctccatga

SEQ ID NO: 17420 - DNA, 438 bp, Glycine max
  Peptide Sequence Number=SeqID_109105
atgtccaagtatggtggctggaatgctctgattcatgggagaaactccacagctttctctaactggtggaaggacttaaaatctattttccagcagcagcacactaataggctgtccaataatttgtgttggaagttgggtaatggggcaaaaatcaggttctggaaggataaatggagagaggatgatttaactcttcaagaaaaataccctactttgtatcaagtgagctaccagcaggattcttctatcagcctaatgggaattcttgttgataataaatgggaatggaggatgcaatggaggagaaacttctttgaccatgaaatcgatatggtagcagcctttatggatgagattgatgctgtccagatttgcccaaccagtatggactcccttatttggaaggctgatcctagtggaacctattccacatag

SEQ ID NO: 17421 - DNA, 489 bp, Glycine max
  Peptide Sequence Number=SeqID_109106
tcaacagggccatgggatttcccgcactgatcacaggactctgccagtcgtttggagtccccgtggcacctaccaaggtgattcggccgcccatcacccgggcttttattgagaagtactgcacccagagacaggctcagggggatgctccacaggccgcgggcgtgccaccaccacctcatcaggctggcccggctgggtcatttgacatggagcagtatttacgacatttggttcgccagcaggcagccaaccaccgggcacatgtgcagacccatgattgtctataccagatgagcctcagcatgcagagccagggcttcgcttctttttcatgccctactccagaccagttcagggcagaggtcgcatggcccggggattggcccgaggcccaagcaggagaggcgcccccaaaagttctcggcgatggagaggagggccacgaggacgaggagatggccgatttgcttgacttcttgggaggga

SEQ ID NO: 17422 - DNA, 114 bp, Glycine max
  Peptide Sequence Number=SeqID_109107
atgtacaatgccaaatacagtctaaaggcccaagtggagaaggacgaaggcccaagtggagaaggacaaagcccccgagtggagaaggatgaaggcccaagtggagaaggatga

SEQ ID NO: 17423 - DNA, 237 bp, Glycine max
  Peptide Sequence Number=SeqID_109108
atgacggaaagggagatgatcacaattatggtagatacgttacctacgttctactatgaaaagctgataggctacatgccagctaactttgcggatctcatcttcgccggagaaatgattgaatctggactacggaaaggcaagttcgaatatgcttccaatgtggcccccaacaacaacacacgaggaaaaatgaaggagacgcccacgcagtcaccaccgccccgacgtggatga

SEQ ID NO: 17424 - DNA, 513 bp, Glycine max
  Peptide Sequence Number=SeqID_109109
atggacgaaaaccagtggatgtgtgatagtatgatgtctgaagaagtttatatgaatgttgaaaatgaaaaagatgttggctttaaagtagaacatgttgattgctctgatgcctttaaaacttctcaattgcttgttagccatgatgaagttttacaatgggctcgatcgttggctcatgacattggatttgttgttgttataatgaggtcagacaccaatattggtgttcgaggaagagtctcatttctgttgatagcttgcgaaatgagtggtgagtataggcctaagaaacataatttggatgataatgttgtacgtgacttgttctggagtcatcctgatgaacagtttcggggtcttttcatgaaagttgatacactccccgaggttattgtcaccgacagagatttatctttgataaatgcagtgaaaactgtatttccggatgctacgaatttgctgtgttggttccacattgacaagaatgtgaaggcaaagtgcaaaaccctg

SEQ ID NO: 17425 - DNA, 600 bp, Glycine max
  Peptide Sequence Number=SeqID_109110
atgaaagataagagggatgaggaagaaaaactagaaaaacaaaataaaaagaaggatagcaaggccttgtcttcaaaggccaaggggaaggaaaaggaggaaaaggattcctccaagaagattgttaagaaggaaaatcattttgcaacaaaaggtgatattaaaagagcactccttcttaaacaatctttctaccttctcctatcaagggaaacatcccttatcaccgccatacctcttgagcatgaggttattcctcaagtaaaggagtttttggataagggtttggttcgcaagagcttaaatccttgtgctttcttggtgcccaaaataggtattattaggcaccgaatccctatgataggtggtatgatgaatgtgttgagtggtgcaacactcttttgtaaaatcactcatgcacccaacatcttcatgatttctatacatagggactcattaggtaggaataatcaacatgaaaataaagaaaaaggtgttgaggaaagaattaatgagtttcaagaacctctggatttgaggtcaaatccttttcaagggggagggaatgatgcaatcccaccccccaaggtcattggatag

SEQ ID NO: 17426 - DNA, 416 bp, Glycine max
  Peptide Sequence Number=SeqID_109111
gtatgccacccaccaggcaccctctagacccggataagtctaacagggccctgggggttcccgtcacacctagtaaggtgatccgaccaccgatcacccaggccttcattgagaagtattgcacgcctaggcaggcgcagggtgatgcaccacaggccacagacgcaccgccaccacctcatcaggttgatcctgctgggtcattaggcatggagcggtatctacaacacttggttcgcctgcaggcagccaaccaccgggggcaggtgcagatacatgagtgtctctaccagctcagcctcagtcagcagggccagggtttcgttccttttgtgtggagatcggtgcagatacatgagtgtctctatcagtttagggctgaggtcgcatggcccggagatcggcccgagacctag

SEQ ID NO: 17427 - DNA, 435 bp, Glycine max
  Peptide Sequence Number=SeqID_109112
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtccccactcgtgctaccttttgtcagcctcctttatgcacacttctacctcggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 17428 - DNA, 396 bp, Glycine max
  Peptide Sequence Number=SeqID_109113
atggcctcagcaaatttcttattcccagaaggaaattccatgataactgccattatagaatctaaaaatctatctactatgtcttttgccatattatttgaaaaattgcagaaacacgagatagaattgcaaaaacttaatcaaaatgagaaagagcaagcaaacgtatgcttaatgaccaagaatcatgaaaacaatgaggaggagcccttgaagaaaaagtggtacatagacagtggatgctctaaacacatgacaggagatgcctcaaagttcacaactatttctcctaagaaaagtgggcatgtaacctatggcgacaacaatagagatgttatagagtatcttttgattctcaaaaatgtgtcattagacatgaacatgataaggatatag

SEQ ID NO: 17429 - DNA, 369 bp, Glycine max
  Peptide Sequence Number=SeqID_109114
atgggctttacgtgggacgacaaacgcctgcgccgcgcggggctggattatcatgaatttaccgccgttattcgccaccatgattacgccgcgtttctggaagctgagcagccgcagcgcatgttcgccctgaccaccaaaggtacgccagcgcacagcgccgtaagctatcagaagggtgactatctgatgtttggcccggaaacccgcggcctgccggccacgattctggatgccctgcccgctgagcagaaaatccgtattccgatgatgccggacagccgcagcatgaacctgtcgaatgcagtgtcggtagtggtgtatgaagcatggcgccagctgggttatcctggcgctattctaaggtag

SEQ ID NO: 17430 - DNA, 399 bp, Glycine max
  Peptide Sequence Number=SeqID_109115
atgactaggggaaatccaggtgatttacaaccctttgatccagaaatagatagaacctttcatagattagttaggcatagtgtgcatcctgaccattctatacattttgagcattttgagtattttgttgctggtaattctgaatattttgattttgagcaatcaactactaattttcatattgagaatattgctcaacctccacctcatgagaggactcttagggagatggctgcacctgatttcacttatgaaagcttgtgcattcaatatcctgatgagggtgttccatatgttctcaagactggacaaatacatttgctgcccaagtttcatggtcttgcaggtgaagatcctcataagcatcttaaggagtttcatatgtttgttccaccatga

SEQ ID NO: 17431 - DNA, 219 bp, Glycine max
  Peptide Sequence Number=SeqID_109116
atggaagacgtgcaactattcgaactgcaagaacaaggaggaacccaggaagaatttgtagtaggaagtagcttttgtagtgtaatagcagcttttgttgctactgtcaattgttgttttgctgaagaatttgtaataggaagtagcttttgtagtgtaatagcagcttttgttgctactgtcaattatccatttcaattaaatataatttgtgggtga

SEQ ID NO: 17432 - DNA, 251 bp, Glycine max
  Peptide Sequence Number=SeqID_109117
gaatgagtatcaaaggtggtgccggtggagctggtggaggagatagtatctcaacctccggagaagtaggtgggtctactactggaggttgcgactcagctggccaccttgtccagaaattgttccatggatattattggcctgttgcatctggttccatggttgctgtcagaggaggtgggttggatgatgaaaggatgtcttcaactcttgctctctttcttgaggtcatctgtaagaaaagaatgtga

SEQ ID NO: 17433 - DNA, 195 bp, Glycine max
  Peptide Sequence Number=SeqID_109118
atgaggcatgcacctgacctcaactctcagatgcaatgcgtatttgtcaaggccacccaatcgtgcactgtaactccccccttccttggtgatcagcctaggctacaagagggttccctaccaggtgacacaccccctagtacaaagtacatactgccacagtttatactattttccatgtcatatgaggcatga

SEQ ID NO: 17434 - DNA, 243 bp, Glycine max
  Peptide Sequence Number=SeqID_109119
atgtcacaaccttcccttttgtgggcgagcgaggcgaggctcacgggtgcgtcttccaaaggaggaaaacgcgcggaatcgccaccaacgtttatttgtggaaaacgtcggaaaaaccgaaggaaaccgatcatgaagaatattccatattcaggagttgtatttacatttgaggaaggtcgacaaaaacggggctcttgctcctacgtaccctccatcgaagaggaaatcagacctccgtag

SEQ ID NO: 17435 - DNA, 141 bp, Glycine max
  Peptide Sequence Number=SeqID_109120
atgcaccaaacatcttcttcatcagtaattcgacatgccttattgatgcaatcctaccccgcaagggcattggatagaaaactccaagtagattgggccagagatgcaagagaaggccctagggttcttatgagccttagg

SEQ ID NO: 17436 - DNA, 273 bp, Glycine max
  Peptide Sequence Number=SeqID_109121
atggataaagttgatatctttgtccctcatcctctcgcaaacgcatctttgcttattcaactttcaccggaatgttgggtgcaagccattggtctgtttgctcaagcgacctgcgctcctgagtgttggacttccaagaccgttcaatcagagattactcgtcttgcacgttggtgggggtgccgtaaaacaacgaagagaagtgagttatcaagaataggatgttggacaaatggcctcagttaccttgagaagaagaggggattgaattaa

SEQ ID NO: 17437 - DNA, 579 bp, Glycine max
  Peptide Sequence Number=SeqID_109122
gactacatgtcctcacccttcgtagggctacatgccctcacctttagaggactacacatcctcgccttcagaggactgcacgtcctcaccttgagaggactaaacgtcctcgccttgagaggactacatgtcctcaccatcagagggctgcacgcctctcacctccagaggactacacgtcctcgccttgagaggactacatgtcctcaccatcagagggctgcacgccctcacctccagaggactacacgtcctcgccttgagagggctactcgcccttgccttggaggactacatgtcctcaccttcgtagggctacacgccctcacctttagaggaccacacgtcctcaccttcagagggctacacgccctcgccatcagaggactgcatgtcctcaccttcgtaaggctacacgccctcacctttagaggactacacgtcctcgccaacagagggctacacgccttcacctttagaggactacacgtcctcgccaacagagggctgcacgccctcaccttgaagaggactacacgccctcacctccagaggactatacatcctcgccttgagagg

SEQ ID NO: 17438 - DNA, 324 bp, Glycine max
  Peptide Sequence Number=SeqID_109123
atggaggcctgcgccgccgccaacagcagcgacatgcgcctgctggcagtgaccgtgctgacctcgatgggccgtccggacctggcccagatgggcatcgaccgtgaaccggtggacgtggtggtcgagcgcgcgctggccgcgcaggcggccggcatcgatggcgtgatcgcctcgggccaggaagccggccccatccgtgccgctaccggcgccgggttctcgatcgtctgcccgggcatccgccccggtggcccggtcggcgatgaccagaagcgtaccgttggcgtggcccaggcctttgccgatggcgccgatgccatt

SEQ ID NO: 17439 - DNA, 171 bp, Glycine max
  Peptide Sequence Number=SeqID_109124
gagggagaggccctgaaggactcttcagagtgtaggccttgggggtcacccgatttgagtgctcttttaagcctatttcgatcccacatggttggagcattctcgcaaaacactgtgaccctgactggtctccctatgatatcacctagtgagagcgacttgacttgctag

SEQ ID NO: 17440 - DNA, 96 bp, Glycine max
  Peptide Sequence Number=SeqID_109125
aggcgacgggcccgatgacaagcagagaccaagttaggtcaatctgcaccctggtatcatccagaggcggcgggcccgatgacaagcagagaccaa

SEQ ID NO: 17441 - DNA, 180 bp, Glycine max
  Peptide Sequence Number=SeqID_109126
atggcattggatagaagacttcaagaagattgggctagagatgtagaagaaggccctagggttctcatgagccttagggaccttattgaagctcaaagatccagcctccatagaagcttcataagcaagcttccaacaagtggtatcagagcacaagagcttcaagtaggtgctccttaa

SEQ ID NO: 17442 - DNA, 366 bp, Glycine max
  Peptide Sequence Number=SeqID_109127
atggtggcacgggttatgctcaagcacggatttgagcctggaatgggtctaggcaaggacgacctcgggaatgccgacatagtcgatattaggggaaatatgtacaaaaatggattggggtatgaacctgggatgccgggaaggaggaatgtgccgtcaagacttcgggcggatagggcatggcccggccgcattagccagtgtttcgccagtgccggaatgatgtccgaggaagaggtggccgcagtaggagaggagttccctcaagacccgccaaatttcgtgcaaccatgccatcccgtttcccaaggtcgattctttgaggatcctaaagacgagggtttgacgatcgatttcgaccgagat

SEQ ID NO: 17443 - DNA, 231 bp, Glycine max
  Peptide Sequence Number=SeqID_109128
atgactaggggaaatctaggtgatttacaaccctttgatcctgaaatagatagaacctttcatagattagttaggcatagtgtgcatcctggtcattctgtgcattttgagcattctaagcattttgttgaaggtgattctgaatattctgattttgagcattcgactactaattcttatactgacaacatggctcaacctccaccttatgagaggactcttagggagatg

SEQ ID NO: 17444 - DNA, 210 bp, Glycine max
  Peptide Sequence Number=SeqID_109129
atgaagcatagctccaaactcgaagttggaggacacatgaacagcgccaggcaaggacattcatggggctccgaaaaaagtgtagaatggaggattgcacttgagggtggggtgggatatcgccagtcgagaatgaccttgaatggcaatctgaagggaagagacaccaaaaatgggttttcctttgccggcagtcctttaccttgctga

SEQ ID NO: 17445 - DNA, 234 bp, Glycine max
  Peptide Sequence Number=SeqID_109130
atgggggtgcaaatagcaaccaggcccacttgggccttccagaaaattcctccagaaggcggttgcttctggaggaagcaacctagctcgcttggaaaatccaagctgaggcgcttccgtaacgtttccgtgggtcatttcgcgaagattttcaaccgttcttcgttcattcttcagtcttcaaccggtaagtccccgaaatcgaacttttcaattcattctatgtacccttag

SEQ ID NO: 17446 - DNA, 132 bp, Glycine max
  Peptide Sequence Number=SeqID_109131
atggcagaaatcaaccaagggatggaagcgaatggaggatgggatcgcaaccgaccaagcgtcaccccttcccggcgctgggccagcggagaacatcgctgcaaggcagcccagtatcctttgaattcgtag

SEQ ID NO: 17447 - DNA, 237 bp, Glycine max
  Peptide Sequence Number=SeqID_109132
atgggctatggctatggcggatcatgtccgcgtccaacatggcggcgacttgcctctcgagctcatttttctgggaataggggtaccggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 17448 - DNA, 576 bp, Glycine max
  Peptide Sequence Number=SeqID_109133
atggggtcctttttaaagtttttccgagagggggctgttatttacatgttttgcatgcatgcaccacgcaaatcgccagtggaactagcgagtttgctctccgtgaacaaatcgcaagtagcaatggtgatactgtcatgcatagggacccgccaatttgactggcgagttccactaggtaggctcaggaggtccagctttgcaggagtcaggccatgcagctttgcaggagtccgtcaggccatgcagagtggctggcgagttgtggtaatggtgatactgtcatgcatagggacccgccaatttgactggcgagttccactaggtaggctcaggaggtccagctttgcaggagtcaggccatgcagctttgcaggagtccgtcaggccatgcaggtgtgcagggttcagtggtcagcagtgcaggagggaaccaccaatagggatggcaatttgcatttgacggaaatcgttagcgtggctggcgagttgtggacagtgctttgttcttcctattacgtggtttctctcctcttcctattatgtgatttctctgttagtttagttagaatgtga

SEQ ID NO: 17449 - DNA, 486 bp, Glycine max
  Peptide Sequence Number=SeqID_109134
agggtacatctacttgggttgttgactgagaacaagagagggtacatctcttgtggatcagttctagtggagggtacgtccactaggttcaaagagaacaagggagggagcaggtcaaatctgaagtcatctcaagatcatgatgaagaccaagtcaatttgtgtctcatgacaaaatctcatgaagaaaacaaagaagattctgtaaggaagaaatggtacatagacaatggatgtttcaagcacatgacgggtgatgtatccaaattcacaactatttccctcaagaaagtggacatgttacatacggcgacaacaacaaggggaaaattattagagtctgtcgcaacctacccttcggcgggagggcgacgcgtgactcgcgggtgcgtcttccaagaaaggaatacgcgtggagttgccaccaacgtttatttgaggaaaaacaatggaaaaacaggaaaagacgtggtctacgaattttaa

SEQ ID NO: 17450 - DNA, 325 bp, Glycine max
  Peptide Sequence Number=SeqID_109135
atggaactcattgagaacatggcagctagcgatcaggctatccttcgtgaccattctcatgtcccaacaaagaaaagcctcctagagcttagtacacaagacgcaactctggcacaaaataagctaatatctagacaactagaagctattacggagacgcttagcaaattgccccaacaactgcaagcagtgaatatttctcattcccctgttttgcaagtagagggatgccccacatgtggagggacacatgagcccggacaatgcgcaatccaacatgagccctctcaagaaataaattacatgggcaatcctaatcgccaag

SEQ ID NO: 17451 - DNA, 480 bp, Glycine max
  Peptide Sequence Number=SeqID_109136
atggagaccatgatgagcatgaagaagatattggaggtcaatgcgactgtagttgccgctaccaatgccattgctgaggtggactcgactcccccatctggccttaaccaaataattcatccaacctcagatatggtaggtcagggaggcaaagaattgggaagtacgggcgccccccattttgtgcgagttcaaaacaagcatcccttcctgccatatggcttgcctcccaactatgcaccacccaatgtggcgcacgctcccgatgagaatgtcaataactattctcccatactcattgagagccaacaacctcaagctgatcattcacatgtctctcaacccatgggggagacacatgaaataccccaccacaacctagccgacttcgagcctcgcctcggatatgccactgagggacaagcagttggtcgtgtacccctaccaaacactttggagggccctcagtttcgcccataa

SEQ ID NO: 17452 - DNA, 373 bp, Glycine max
  misc_feature (368)..(368): n is a, c, g, or t
  Peptide Sequence Number=SeqID_109137
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcanaggcg

SEQ ID NO: 17453 - DNA, 132 bp, Glycine max
  Peptide Sequence Number=SeqID_109138
atgtatatatatgtggaaatggccctgaggaagcttgcctcaaagagatctaggaaggacaccgcggccgcagggactagtgccactcccgagttcgatagccatcgtttcaggagcactgagcaccagtag

SEQ ID NO: 17454 - DNA, 705 bp, Glycine max
  Peptide Sequence Number=SeqID_109139
cgccctcgccttaagagggatacacgtcctggctttcagaggactacacgccctcgccttaagagggctacacgtcctcgccttcagaggactacacgtcctcgccttcagagcactacacgtcctcgccttcagagggctacacgtcctcgcctacagaggactacacgactacacgtcctcgccttcagagggctacacgccctcaccttaacagaacgacacttcctcaccttcagaggactacacttcctcaccttcagagggccgcatatcctcgccttcagaggactacacgtcctccccttcataggactagacgtcctcgccttcagaggactacacgtcctcgccttcagaggactacacgtcctccccttcataggactacacgatctcgccttcagaggactacacgtcctcgactatagaggactacacgtcctcaccttcagaggactacacgtccctgccttcatagggttacacattctcgccctcagaggactacatgttctcgccatccgagggctacacgtcgtcgccttcagaggactacacgtcctcgccttccagggactacacgtaatcgccttcatagggctacacgtcctggccttcatagggctacacgtcctcgccttcagaggactacacatcctcgccgtcataggagtacacgtcctcgccttcagaggactacac

SEQ ID NO: 17455 - DNA, 279 bp, Glycine max
  Peptide Sequence Number=SeqID_109140
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtgtctgattttgataaggtcttcaatcttatctttcaagacactccactctttggaggagtgtcttcaattgcaatgcataacgaggttctcaaggtggttgatcccttcgtccctcgtcttaccaaa

SEQ ID NO: 17456 - DNA, 257 bp, Glycine max
  Peptide Sequence Number=SeqID_109141
ctgataccgctcgccgcagccgaacgaccgagcgcagcgagtcagtgagcgaggaagcggaagagcgcccaatacgcaaaccgcctctccccgcgcgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17457 - DNA, 280 bp, Glycine max
  Peptide Sequence Number=SeqID_109142
atggagaaatctgaaaagaaaaattttagtgaaaagaaggcgaagaaggcctacatcacatgggatgacaatgatatggaatcatttgaggattcaggaaatgaagtaataaacttgagtctaatggctaaaagttatgaaagtgatgaagaggtatctttgaagaagagatggtacatagatagcggatgctcaaaacatatgacgggagatgcatcaaaattcacacatatctctcccaagaaaagcggacatgtgacttatggcgacaacaataaag

SEQ ID NO: 17458 - DNA, 609 bp, Glycine max
  Peptide Sequence Number=SeqID_109143
atgcgaatccgactgttcgagctcgtgtactggtcgtgggcgctcgaggtcgcgaacgagtggcgatcgctgctcggactcggccaggagcagcgctgggatcgcgtcgcacgcaacatggctccgcccgcgcgtctcggcgatgggacgtatgccgcgctgagcacgcccccctacctcgtgcgtaaagaccacccgtcgatgctcatggcgctcgggtggctcccgccgaccgacgccgtcgaccccgacatcatgcgttcgacgctcgaggcggtctgggcgcggtgggatctgcagtcgagctgggggtgggactatccggtgatggccatgaccgcggcatccctcggagacctcggccgcgctttcgacgccctgctgctgccgtcgcccaagaatcagttcctcccgaacggccatactccgcagatcccgggcttcctgtcgttgtacctcccggccaacggtgggctgctcgccgcgatcgcccatatcgtccaggcgatcgaaggcggcgcatccgagccgcacgggtggcgcgtgacctacgacgcgcccgacacggcatccactgggaagcctcgcgccgcctcccgcgtctcctga

SEQ ID NO: 17459 - DNA, 414 bp, Glycine max
  Peptide Sequence Number=SeqID_109144
atggcttctccacctgcctcccctcctcctcctcctcctccttctcttcctcctcctcctcctccttctactcctttggacgcattggcttcgttgtctgccgtgaagcagacacgcaaagcctcacgtctacgatcattgtctactagaccacctggtgctgagagaccagtggtccatgtagatcctgctaccggcaaggtcgacggtccccacaggaagaaattaagaacatatttggggattgtggcacgtgataaggtggacgtcacctacgagaactggaaggaggtccctactgctcaaaaggacctgatttgggaggatattcatgcggaatttgaaattccaaaggcttctgatagtaggacgaaaaggaagttacttcagaccgtgggggagagatggaggtag

SEQ ID NO: 17460 - DNA, 279 bp, Glycine max
  Peptide Sequence Number=SeqID_109145
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctcagtgatgcctggactgggatggaatttttaccccaagcagaacagcgtggtggtacatcctggccaagtgactactgtgatgtttga

SEQ ID NO: 17461 - DNA, 714 bp, Glycine max
  Peptide Sequence Number=SeqID_109146
gccttcagaggactacacgtcctccatttcagaggactacacgtcctccccattagaggaccacacatccccgccttaagagggctacacgccctcgccttcaaaggactacatgccctcgtcttcagaggactacacgtcctcaccttcagacgactgcacgccctcgccttaaaaggactgcaagttttgaccttcagaggactacacaacctcgccttccgagggctacacgtcctcgccttcagaggagtacacatcctccccttgagagggctacacgcccttaccttcaaaagagtacacgtcctcaccttcagaggactatacgtcgtcgccattagagggctacacgtccttgccttcagaaggctacacgtcctcccctttagaggactacacgcccataacttcagaggactacacgtcctcgcctttagagggctacacgtcctccccttcagaggacaacatgacctcccctttagaggaatgcaagccctcgccttaacaggactgcatgttctcacatttagaggactacacaacctcgccttccgagggctagacgccctcgccttcagaggagtacacatcctccccctgagagggctatacgccctcgccttcgtagggttagacacccttaccttcaaaggagtacacgtactcaacatcagaggactatacatcgtcgccatcagagggctacag

SEQ ID NO: 17462 - DNA, 312 bp, Glycine max
  Peptide Sequence Number=SeqID_109147
atgtccttgtctttgtgcttcttaggactcaacgtcctttgttcctatgttatagtgcaaagcaagaaatcattcagtgtttcaatcaggaatgcgaaagataccaaaaggtggggcaaaagggtattttcattgaatatcctggaccctagctcacccaggctagcctctggcttgcctcggccaccaaaagacttccatcttaagaaactagctcgcctgggcgagctcgttgcttcatggctaagtctcagcttgtcaaggtgtgaagggaggctgagagatgggttccaaagtccagcattgagataa

SEQ ID NO: 17463 - DNA, 855 bp, Glycine max
  Peptide Sequence Number=SeqID_109148
atgtcgatggaagctctctttggaaaattacgtgcatatgaacatgagttaattcaacaatctcatgcagaagaaagagaaaagaaaagaaaaggaattgcactcaagaagtttggaaaatttctcaaaagatccagcaacaaaaaattctctaaaccttcaaagaagatagaaagcaccaacaacaccttcacatgctttgaatgtgggaagcaagaatggaaagaaggacaaaaaacagaaaaagcctacatagcttgggaagacaatgcatccacctcctctaactcttctagtgaagaagataatgtaaatgtactcttgatagcagatacaatgaatgactcttcaaccattgaagaaactaagataaattctgaatttgaagaagttttaaaagcatttaatgcaatgcatgatgaagcgcaaaggcttgctgtttcaaataataagctgagaagcgatctaaaactgcatatcactaaattggcttcaacacaaagtgtgcctgtcgcaacctacccttcagcggggacgcgaaaaggacaaaatggatcagacgagacgtttgtctctgagggagaaaatgagcagagtctccaccaacgtttatttaaggaaaatgtcagaaaaaccgaaaagacgatggtcaaaggtctgcgtattttgaaaatgaggcgcgtatccatcgctaagcgtggcttcagcatgcttagcgtgaaaaaggaatatggaagagcacctgaatcgaagcagcgcgctaagcacgagatcagctcgctaagagacttgtctgtctcttgccaggctcagtgcaacattggtgccaagtccaaatccacttactcgcgctaa

SEQ ID NO: 17464 - DNA, 159 bp, Glycine max
  misc_feature (27)..(27): n is a, c, g, or t
  Peptide Sequence Number=SeqID_109149
atggggtgtactccattggagcttgtnttcctaggatcttcttcatcaatggattcctttgcttcttggaagatgaatgccagcggaatggagaaggaagagagagagaagacgccacttcaagtagaagatgagtctagaagaagctcaccaccatag

SEQ ID NO: 17465 - DNA, 162 bp, Glycine max
  Peptide Sequence Number=SeqID_109150
atggaggttgaggaaccttggctggggcttctttgctggaaaattccttccctggttggtgttttggcgggctttgttgctgatttaggggtggcctttgtggatgattgggtgttcttggctgatagggtggtgggtaatggaaaggctgatattagctaa

SEQ ID NO: 17466 - DNA, 306 bp, Glycine max
  Peptide Sequence Number=SeqID_109151
atggaggacacatgtacaccggtaggcaatgacattcaagggtctccgcataaaagtggagaatggagaattggcggacaacgctatgccataacttcgcgcgggtctagactcgaaggtggaggacacatgaacagcgctaggcaattacattcatggcgctacgcaataacttcgcggggctctaggctcgaaggtggaggacacatgaacagcactaggcaattacattcatgggtctccggaaaaaagtggagaatggagaattggcaaacagcgctacgcaataacttcgcggggctctag

SEQ ID NO: 17467 - DNA, 706 bp, Glycine max
  Peptide Sequence Number=SeqID_109152
atgagtcttcattctttgtctagtgttaatggaaggcatagggcacatcctagacctcactcccattggagagaaaaggaaagaaagcctcaagaggctaacattaacctcctatacttccatgggaaggacaataaagaccaatgtcaaggcatcttaggggtgacaccttctaagcctaaagatgataaggggaagacaatagaaaaacaaccccttaaggctagtatgcaagagaagactagctccataaagtgctttaaatgtcttggaagagggtacattacttctcaatgccccaccaagaaaaccatgattatgaggggccaagacatttatagtagccaagatgaggctactacttcaccttcctctagtgaaagtgaagaagcaaaaggggaagaatctagtaaggagatctacccccaagaagaaggacaatctttaatggttaaagagaagtgtaaggaggtaagtgtctcctccaagaggttagctaagaaggaaagatattttgaaataaagacaaatattaaaggaatttcccctcttagacaacctccacattttctcctttgtaaaaagacacttgttagcattgccacacctcttaggtttgagtttattcctcaagtaaaggagttgttggatgagggtttggttcgcaagagcttaaatccttatgctttgttggtgcccaaaatag

SEQ ID NO: 17468 - DNA, 227 bp, Glycine max
  Peptide Sequence Number=SeqID_109153
acttatcttccttcattggaagtggcgtctacccagacttatcttccttaaccggaagtggcgtctacccagacttatcttccttcattggaagtggcgtctacccagacttatcttccttcaccggaagtggcgtctacccagacttatcttccttcactggaagtggcgtctaccctgacttatcttccttcacctggaagtggcgtcatccaaaacctccgtag

SEQ ID NO: 17469 - DNA, 348 bp, Glycine max
  Peptide Sequence Number=SeqID_109154
atggtgggttacacaccttcaagttttacagatttggtcttcgccagcgaaaggatcgaagtgggtctgaaaagaggcaaatttaatcatcctgcttggacgactgagaaaagtggggcaaatgaagagggtgagaatgaaggagaaacccatgctgcgactgccattcctacatggccaaacttcccaccagcccaacaatgtcgttactcagccaataacaacccttctccttacccaccacccagttatccacaaaggccatccatgaatcaaccacaaaatccacctaccacccaaccaatgcataacaccacctttagcacaaaccaaaacaccaaccaataa

SEQ ID NO: 17470 - DNA, 861 bp, Glycine max
  Peptide Sequence Number=SeqID_109155
ggtcagcatctgtcgctgccgctgcatgtcgccgacgccttccgtgcagtattactggataccgactgcgatccggccctgacggcgctgatcctgaccctgccgtcggaaaatgagattgccgagctgttcgataccatcgatccgcaggcgattgcgctggtgcgtgacgctctgcaacgcacgctggcccgcgaactggccgatgagttttttgccatctacaacgccaatcagcagcctgaataccgcgtggagcatgatgcgattggtcagcgcagcctgaaaaatacctgcctgacctatcttgcctttagcgatgcgcagctggcagacaagctggtacagacgcagtaccaccaggcgaccaacatgacggatgcgctggcggcgctttccgcggctgtggcggctcagttgccgtgccgtgatgcgctgctggcggcctacgatgagcgctggcatcaggatggtctggtgatggacaaatggtttgttctgcaggccaccagtccggctgccaacgtgatgcgtaatgtgcgtcagcttctgactcatcgctcctttaccatgagtaacccgaaccgcgttcgctcgctggtgggggcctttgcctcggctaacccggccgcgttccatgcgaaagatggcagcggttataagttcctggtggagatgcttaccgacctgaacacccgtaatccgcaggtcgcggcgcgaatggtagaaccgctgattcgtctgaaacgttatgacgaagaccgtcaggcgatgatgcgccaggcgcttgagcagttgctgcagctggataagctctctggcgatctttacgagaaaattacccgggcactgaacgcctga

SEQ ID NO: 17471 - DNA, 306 bp, Glycine max
  Peptide Sequence Number=SeqID_109156
atggtctctggtaatcgattaccaagggagtgtaatcgattaccaggcttgaaaacgaggcttagaaatgggactggaggattatggaggcctctgaggaataggccactggtaatcgattaccagctgtgtaattcgagtttggcctctggtaatcgattaccaaggctgtgtaatcgattaccagagatgaaaagccttgagataccccttttacttgcatgtagtggttacgagacgcaattgtgttgcggcgtagttagatatcgcgtgaaagagtctacccctttcttttatttcttgtag

SEQ ID NO: 17472 - DNA, 537 bp, Glycine max
  Peptide Sequence Number=SeqID_109157
atgaccgaaaggcttctgccggttcattggcttttgaaagtcgcatccttcattatctcattgtgctatcttgcttccaagatctacaaaccttgcacagtccgatatcgcatgcataaggcattgcgattaaatgctccattgccatatccacacttagttactctcttccttcaacactttagcatccctcttgattctaaaccttatgttccaatcaagagatccttcttaattggtgccgctgtgattgcatcatttggttaccgaaaagagcatgatggctcttgggtgaaaaagggtgctcaacccaatgatggagaagggcatttacaaggtggagaagattcctctcttcttcaaaagattttggacaggttcgatggtcttgaaacctttgttggtgataggtttgatgctttggagttacaagtggacatgagatttgatgagatggattcaaggattaccaaggtcgaagaagatgcctcttacattcgaacaagctttgatttaccaccgccaccatcatcttag

SEQ ID NO: 17473 - DNA, 409 bp, Glycine max
  Peptide Sequence Number=SeqID_109158
atggctccgaagaaactctccacgaagagatctagaagagacgccacaggagaagggtctagtgccacccccaagtttggtagtcatcgtttccggagtgccgagcaccaacagcgcttcgaggccatcagaggatggtcattccacagggaaaggcatgttcagctcagggaggatgagtatacggactttcaggaggagacagctcgcagacgttggacgccgctggtgactcctatggccaagtttgaccctgagatagtcctagagttctatgttaatgcttggcccacagaggaaggagtgcaagacatgcgttcgtgggtgaggggtcagtggattccctttgacgcagatgcccttatccagttccttggtgactcgctagttttggaggaaggccagcagt

SEQ ID NO: 17474 - DNA, 786 bp, Glycine max
  Peptide Sequence Number=SeqID_109159
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatcacacggaggcgcataatatatcgagacgactcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17475 - DNA, 764 bp, Glycine max
  Peptide Sequence Number=SeqID_109160
gaaggtagaaatataccatacggagttagatgagttcaaggctgaattggagaggcgtaacttccataagcgcctcaccaatttagctgatagtagcatcgacctagccttggtaaaggagttttatgccaacctctacagtcccgaggggccttcaccaaaacaagtcagaatccgaggccgagtgataagaattgatgcagacagcctcaacaccttcttggagacacctgtggtactcgctgagggagaatccttacccgcttacttcagatactgcaggatgcccactgatataagagagattgaggctgctttgtgtatacccaaccgagggtctgttttaaatgctgaaggccatcctgggaagatcctcaggaaagatctaacaactcttgctcaggtttggagtgttctctcatactccagcctggctccgacttcccacacctcagatttgattgtagatagagctaggttaatctttggccttgtttctcagttggacatgaatgtaggagctttcatccatggccagatcacaggggttgcttctgacagcccgatcttcgaacgcttgagcccgatcattaacttggcctatattaggaagaactgttggaaccatgctgatctgacagttactattagaggggctaggagagcgagggcaaggccagctgaggctccttccacatctgcagctcctcctccagcacgtacctcagcagcttcttctaccccatcttctgcagactttcaac

SEQ ID NO: 17476 - DNA, 117 bp, Glycine max
  misc_feature (81)..(81): n is a, c, g, or t
  Peptide Sequence Number=SeqID_109161
atggctggagcaggtggtggtggtgataagtatcatcagttggaggaagctcaacgtctgttactggatgcgatgaatgcnaaaatgcaacgtttgctggaccgtaccaatgaggag

SEQ ID NO: 17477 - DNA, 126 bp, Glycine max
  Peptide Sequence Number=SeqID_109162
atgcaagcggggaattttgatctgtatggattcctcgagccacagtccattcagagtgctttaaaaggtcttgatgatgctccacagcctaaatcaaaggctgctgctaggtggattgtcgtcaag

SEQ ID NO: 17478 - DNA, 339 bp, Glycine max
  Peptide Sequence Number=SeqID_109163
atgtcaaatcataaaagcagtgagtcaacactaaagaaccttgaggtccaggtgggacaactggccaagcagatagctgacaagtcatccaacaattttgtggctaatacagaacagaatcccaaggaggaatgcaaagctgtgatgacaaggagtaaaaggtttgtggaggctgaggatgaggatagtgttgtgcataagaagaaaactgctaacaagaaaaatgaggtgagaggtgaaagtaatcaagaaaaagaggaacaaataatggtcatgaataaagaattaaaggacaaagaaaaagaagtagaaaaagaaatagaaaatgaaaaaaactga

SEQ ID NO: 17479 - DNA, 969 bp, Glycine max
  Peptide Sequence Number=SeqID_109164
atggcgataaacctagaaaatattccatccggtgttgttggtagagcaaccattggatctctgatcatccttgctcgtgcagtcactttagcattaagtcacttacattcacagcagggatttcctgaagctcttcttgtgcaactcctaaaagtaatgttgcattcagatgtggaggctcgtgtcggagcacaccttatattttccattcttctttttccaagttccttccatacgaatgagatttcctctctgcggtccagatatgtaggtcaacacaacaaaaggcattctcatgctccatctgtgtctgcatctgcttcaattacagctttacttgaaaagctccgcagaaacagaaacaccaaggcagaaaatcatgtgaatattgttcatgatcaagaaagggatattgtggcagaagactggaagcagggctgtggcttaaagaattctcctaacttttacaaactcacttctatcattgataaggctacaggatcaccaagtttgactgacacagattttccctcaaattcagcaggtgaagatgacacaatcagtgaagcatctgtctctgacctttctcgatttattccaaagatgcctctatcaccttcggcacctcatgttatcagcattggacaacttatggaatcggcattagaggtagctggtcaagtggcaggaacagctatctccacttcgccccttccgtacaacaccatggctagccagtgtgaatcactcggtacatgtgcaaggaaaaagctttcaaattggctggcctttgagaatcattacagccaagcacttgatgataaatcgtttttggcaattgctgatattaggaactcagcacctgagaaggtgacaaatggtggtgggcatgcccaattgccaagggaccccatgaagctgcctcctgctagcccctttgacaatttcctcaaggctgctgggtgttag

SEQ ID NO: 17480 - DNA, 132 bp, Glycine max
  Peptide Sequence Number=SeqID_109165
atggtgggaatagatgtgattcgggaacctaccagccaaggatatactcgtgaagatgctgatgagttcattttttgtagctacaatggacacaactgggtattttccaaggtagaatggtttcatgagtaa

SEQ ID NO: 17481 - DNA, 241 bp, Glycine max
  Peptide Sequence Number=SeqID_109166
atcgcgtcttttccggtttttccgacgttttcctcaaataaacgttggtggcgactccgcgcgtattcctttcatggaacacgcatcccgcgagtcatgcgtcgccctcccgccgaagggtaggttgcgacacccggagattggcccgaggcccaagcaggagaggcgcccccagaagctcccgacgatggagaagaggcccacgaggacgaggagatggccgatttgcttgacttcttag

SEQ ID NO: 17482 - DNA, 449 bp, Glycine max
  Peptide Sequence Number=SeqID_109167
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggtacatctacttgggttgttgtaactgagaacaagagaggatacatctcttgtggatcagttcaagtggagggtacatccacttggttgttcaaagagaacaagggagggtacatcccttgtggatctttgcttgtaaaggcttttacaaggttgaaaagaaatctcaaggaccgcaggtcgcttggggactggat

SEQ ID NO: 17483 - DNA, 468 bp, Glycine max
  Peptide Sequence Number=SeqID_109168
atgtcgccgatggcatattttgcggtatattccgcaacggccttttccagcgcgaaacggctttccagcgggcgtgactgcttggatgcccaggcgccgatgcggctgccgcgcgggcgtgaagcaagacgaacccctgttcgtcgaaatccttcaacagcaccatgcgcacattggccagtctgcaaaaagtttgaacggctgggaggattcggtgaagtcgtcgcttgcgtttgtcattttggatatttcaaaagcctgtcggaatttgcggatcatcctgcaagggaatccccgccaagaaaccccaatggggcgggtcaggagggagcttcttccataaccggcattttgtccatggtcttgccgggatgtgtcgtcgcagggttcgacatggctttacttagcgggcaacttcttgtatggcgccggtcaaggtgggggctatgccaaaactcgatttcttga

SEQ ID NO: 17484 - DNA, 603 bp, Glycine max
  Peptide Sequence Number=SeqID_109169
atggttccgagaaagctttccacaaagagatctaggaaggacgccgtggctgaagggaccagtaccgcccccgagtttgacagccatcgtttcaggagtgctgagcaccagcagcgtttcgaggccatcaaaggatggtcgttccaccgagagagacgcgtccagctcagggacgatgagtataccaactttcaggaagagatagctcgccggcattggacgtcgctggtcacccccatggctaagtttgacccagagatagtcttggaatcttatgccaatgcttggcccacggaggagggcgtgcgggacatgcggtcatgggtaaggggccggtggattccttttgatgcagacgccctcagccagttcttgggagacccgttagtgttagaggagggccaggagtgcgagtatagtcagagaaggaaccggctgatggatttgacgaggaggccattgctcagctgtatacataccgggtcaggattttgcccggaccgctgtcgggagacgggtgcggatcatgcgcaccagcatgactaccttgacccagacgtggatgacgttgctgctcaggaacatcctacccagagatcataa

SEQ ID NO: 17485 - DNA, 583 bp, Glycine max
  Peptide Sequence Number=SeqID_109170
atgggtggcgtgagcattgaaaaggccgttcccgattcttccacgatcaccggatcggtgaaacagccgcagccggttgagaccgatactggcaagctttccgaccaatccgcgatcaggaacgttgtttcagcgctcaatttcacggaatggggcaagaagcccgtaccgtgggccaatcccgatacgggcagccagggcacgatcactaccattgccgagtacagcaagaacaaccagctttgccgcgaattcgaaacctcgcgtgaagcttttgacggtgtttccatctatcgcggcgaaacctgcatgcagcgtggtggtcaatggacggtgacttcgaactatatgcgcgatccctatagcgtgctgggcgtcgccaaaacggcgaagcccgaggaaataaaatcggcttttcgcaaactggccaaaaagcaccatccggatcagaacaaggatgatccgaaagcgcaggagcgctttgcagaactgaaccaggcctatgaaattgtgggcgacaaggacaagcgtggtcagtttgaccggggcgagatagatgccgaaggcaagcctgcctttcagg

SEQ ID NO: 17486 - DNA, 270 bp, Glycine max
  Peptide Sequence Number=SeqID_109171
ttttaccgagacagttttgggtttctgcgggaaaataaaaagctacaatgcgaagggttttcctctaagctcagacatgattttgcaattcccaacggtgagaatgctcgaaattgggttgcgaacgtggtgctcaaatttcacgacgatccaacggtgaatgattccgagatcatcgtttttctgagacaggttttgtgggctgcgggaaaaagaaagggttttgagaggaaaaagggaaaaacgaaaatgagaggcagaggaggctga

SEQ ID NO: 17487 - DNA, 54 bp, Glycine max
  Peptide Sequence Number=SeqID_109172
atggatttttacaaagatagtggaagtctcaagtgggttgctagagtactggac

SEQ ID NO: 17488 - DNA, 882 bp, Glycine max
  misc_feature (834)..(834): n is a, c, g, or t
  Peptide Sequence Number=SeqID_109173
atggagagaagtatgatagatgctgccagtggtggagcccttggagacatgacccctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtacctgttgcaaggacctttgcccttccatgcagcaacctggagcaattgagcaacctgaagcttatgctgcaaatatttacaatagacctcctctacctcagcagcaaaatcaaccacagcagagcaattatgacctttccagcaacagatacaaccctggatggaggaatcaccctaacctcagatggtccagccctcagcaacaacagtagcagccctgctccttccttccaaaatgctgctggcccaagcagaccatacattcctccaccaatccaacaacagcaacaaccccataaacatccaacagttgaggcccctccacaatcttccctcgaagaacttgtgaggcaaatgactatgcagaacatgcagtttcagcaagagaccagagcctccattcagagcttaaccaatcagatgagacaattagctacccaattgaatcaacaacagtcccagaattctgacaagctgccttctcaagctgtccaaaatcccaaaaatgtcagtgccatttcattgaggtcgggaaagcagtgtccaggacctcaacccgtaacaccttcctcatctacnaatgaacctgccaaacttcactctattccagaaaaaggtgatgactaa

SEQ ID NO: 17489 - DNA, 534 bp, Glycine max
  Peptide Sequence Number=SeqID_109174
atggacgtcgtaccttcagagggctacacgccctcaccttcagaggactatatatcctcgccttcagaagggttgcacgcctttgcgtttagaggactacccgtcctcaccttcagagggctacaaacactcaacttcagaggactacacgtcctccccttaagaggactacacgtcctcgcctttagaggactggacgtcctttcctacagagggctacacgccctcaccttcagaggactctacgccctccctttcagagggctacacgccctcgcctttagagggccacatgccctcattttcagaggactacacgtcctcaccttcatagggctactctccctcaccttcagagggctacacgtcctcaccatcagagggttgcatgccttcaccatcagaggactacacgtcctcgccatcagaggacaacacgttcttgcctttagaggactacgcatcctcaccttcagaggattacaagtcctcgccttcagaagacttcatgtcctcgccttcagaggactatag

SEQ ID NO: 17490 - DNA, 264 bp, Glycine max
  Peptide Sequence Number=SeqID_109175
atggtcatagaccagtcccttctctttaaactaactcaattatcctgtgacggtgtaccgtttgagggtacacttgatgatgagtggaagttcgatttctctgtttctgatgcctgccagatggtttgcaccaaccaagcggatatgaccagaaggcttcttgccgtcaagagatctttctctatcggtgcgaatgtggtctcttcttttggataccgcaaagagaaggatggttcttgggtgaagaaagacgcaccagcatag

SEQ ID NO: 17491 - DNA, 435 bp, Glycine max
  Peptide Sequence Number=SeqID_109176
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatgcaccaatatgaaaaggtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 17492 - DNA, 282 bp, Glycine max
  Peptide Sequence Number=SeqID_109177
atggcaattgatatgaaaacaaagtttgataaatattggagtgattataacaatgtgctttcctttgggtgcattctagatccacgctctaaaataaaaaatttgaagtattttaattcaaaacttggtcttgctccattggagcttgtagccctaggatcttcgtcgtcaatagattcctttgcttcttggaagatgagtggcagcggaatggagaagggagagagagacgagatgccacttcaaggagaagatgagtctagaagaagctcaccaccataa

SEQ ID NO: 17493 - DNA, 630 bp, Glycine max
  Peptide Sequence Number=SeqID_109178
atgtacctaagcaggcgagctcctggcagtcaacagataaaaggaacaaagaccacaaagcaaggaggcttgtgtggtggctggccagctgtgaactttgattcatatgtgggttatggcctctggcttgaaaatgaggtcaggaagctaggagagcttctgaggaatgggtcactggtaatcgattaccagatcatgatggcggcgcagctaatccatgatcgagtggagatggagtgcctagagggagcttgggagaccctcgaaggcaatacgaggtgccgattttggggcacgattcgatttacgactaattcattggtgcatccagatgaacccgtgcgcacgcttcagcatactgtggagtggatactacccatgcctacaccatactgtctagtggagccagcccaagtgatcgagctaacgtcatctgaggaagacccagaggaggatctcgaggagctacctcccgagcctgctgtggatgctcttgactttctagggggtgatgaggatccacttcctgaggtggattctcccgaggaagtcatgtcggcatctgaggcagactctacggaggatagtggcccgggagagatggcgatcagtggcagctcttcatcatag

SEQ ID NO: 17494 - DNA, 192 bp, Glycine max
  Peptide Sequence Number=SeqID_109179
atggagaagagacacaacatcgtccagcgtgatcaaaacctcccctacaagaagatggaaactagaagtctcctagtgccacctctcgacaaaggaggatataagtccccgatcgccgatgaacaggcctgcccaatttatgcaccttctttccatgggaggatacttcaactcaggacgttcctgaattaa

SEQ ID NO: 17495 - DNA, 186 bp, Glycine max
  Peptide Sequence Number=SeqID_109180
atggaagaagatcacaagaagactctcaagttcttagatgttacaaatgcaagcaacttggtcacatcaaagctaattgtccttcaaatgaagaatgacctaagaaaagtgataagaaaagagaaggagatcaaccttctaaccaaggattatgagagtgatgagaacatttctcaagaagattaa

SEQ ID NO: 17496 - DNA, 529 bp, Glycine max
  Peptide Sequence Number=SeqID_109181
cgtgagctatgagaaaagcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgaatcctcttgtttgaaacttacataagtttgatcgaggaagtccaaattttcatccaagatgcatggagagactgtgacaagcgtgtcctctactgggcaacgcgagattgctgcaaacacggcaagcaatag

SEQ ID NO: 17497 - DNA, 1161 bp, Glycine max
  Peptide Sequence Number=SeqID_109182
atggagcgtaatggctctgtcgattgggaagccgtcgatgacgtcattttcggctcagccaatcaggccggggaagacaaccgcaatgtcgcgcgtatgtcacttctgctggcgggattgccagttggggtgtcaggaaccacgatcaatcgtctctgcgggtcagggatggatgctgtcataacggccgcacgcgcaatcaaagccggcgaagcagaacttgtcatcgccggaggcgtggaaagcatgagccgcgcgcctttcgtcatgccgaaagccgacagcgcattttcacgcaaggcggaaatcttcgatacgaccatcggctggcggttcgtcaatcctttgatgaagaagcagtacggtgtggattccatgccggagacgggcgagaacgtagcggaagatttcaatgtttcgaggcaggatcaggacatatttgcgcttcgcagtcaggaaaaggcggcagttgcgcaagagaatggacgccttgccagggaaatcgtgcccgtcacaataccgcggcgcaaaggtgagccgatcattgtggacagggacgaacacccccgtgtgacgagcctggaagcattggcaaagctgggcacgcccttccgcgagggcggcactgtgacggcaggcaacgcttcaggtgtaaatgacggagctgcagcgctcatcatcgcgtcagaggaggccattaaaaaatatggcctcacgcccatagcgcgcattgttggtggtgctacggcaggtgttcctccccgcatcatgggtattggtcctgctccggcgacaaggaggctctgcgcgcgtaccggtatcgcgactgatgccttcgacgtcatcgaactgaacgaggcatttgcatcgcagggcctggcagtgttgcgcgatctcggaatctccgacgacgacgagcgtgtcaacccgaacggcggcgcgattgctcttggacatccactcggtatgtccggtgcgcgcattgcaggcacggcggcgctcgaactttcgctcaatcgcggcaggggatcgcccttgcgcttgaacgcgtttgaagcgcgcgcgaatgagaaatccggacgtttcgcccggattctccacctcgtgaaacgggataatacttttgcattgtcgggcgactacaatattgcccgcgactaa

SEQ ID NO: 17498 - DNA, 236 bp, Glycine max
  Peptide Sequence Number=SeqID_109183
atgtcgatacgacatgcttctcccagacaacaaaaaagcccggcgaaccgggcttgtacgtgcattgcacacgcgcttgcagttaagactggcgacgggcagcaatcaggccaatcagacccaggccggccagaatcaggccagattgtgtcggctctggtaccgccgcggcataggccagactacctgtgccagacaaacctaatgcggtgtcgtaagcacaaactgcgtcggag

SEQ ID NO: 17499 - DNA, 443 bp, Glycine max
  Peptide Sequence Number=SeqID_109184
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggacacggtccagactcctacgggaggcagcagtggggaattttccgcaatgggcgaaagcctgacggagcaatgccgcgtgaaggtagaaggcctacgggtcatgaacttcttttcccggagaagaagcaatga

SEQ ID NO: 17500 - DNA, 701 bp, Glycine max
  Peptide Sequence Number=SeqID_109185
atcccgggtcttttccgcgacgctgtagccggtcacatcgttccagacatcgtccgcagtgagataaccgcggaacttgacctggccgcgttggcctgcatccagcgtgtcccagtagcgctgcagcgccgggcgcatgaaccgggtgaagactgccaggttgcgcgtgtacggcgcataggcgctgtcagtgggcgtcaatacgccgtcgaacatcgccgggggaatccgtggcagctcggtccagtcccagtagggcatggcgaactgcggatcaccgctgagcgtgcggatcgggcgttgcggaaccagttgcgtggtccgaaccggaatgccacgggcatcgcggtcggccggctcggcaccctgcgccaacaggccccagaggctgcgactcatgagactgccaccatgaagcgcattgcgagtggtggcaagaaaatcacgacgtgtgtagcgcatagccttccccctggtttcgccggcggcagcgtggcagcagccggcccgacggggacatccagccccgccgcttccaccggcaggtgcaacgatggccggggtggaagcggcgaccacagtcgcaggcgcgtacacatgtgcccggctgaagctgttcaccgtcgtcgttgcggcgtcgccgatcagccaggcatggcctgtcgttacgggtcgggcttcaccctgaccacccgtttccg

SEQ ID NO: 17501 - DNA, 384 bp, Glycine max
  Peptide Sequence Number=SeqID_109186
atggcaacatgccctcgccttcagaggactacacgtcctggctttcagaggactgcacgtcctcgccttcagaggactacatgtcctcgccttcagaggactacatgtcctcgccttcagagggctacacaccctcaccttagaggactacgtgccctcaccttcagaggactgcatatcctcgccttcataggacagcacgtccttactttccgaggactacacgtcctcgccttaagaggactgcacgtcctcgccttcagaggactacacgtcctcgcctttagaggactgcacgtcctcatcttcagatggctgcatgccctcacctttagaggactacaagtcctcgcctttagagggctgcatgccctcgccctttga

SEQ ID NO: 17502 - DNA, 387 bp, Glycine max
  Peptide Sequence Number=SeqID_109187
atggaggctatcatacagcaactatgcataccggggcaagatttcacccgtgccactacaaagagacgacaacgttccgtccagcgaccacaatgtcgatctccctctacggaagcatcagttggtctgtgccatcgtgacataggggttgcgcccacaagacacccagtggacctggaggagctcaatagggccctagggtttccagctctggttacgggcctttgtcattcccgcaaggtgcccgtccccccccccccccctcagcaagggatcgcgcccgcaagacacccagtggacccggagaagcccaacagggtcttggggtttcaagctctgattacgggcctctgtcagttctacggagtgcctgtcgcccccagcaag

SEQ ID NO: 17503 - DNA, 785 bp, Glycine max
  Peptide Sequence Number=SeqID_109188
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccacttactttttttgatcctactacactccagccaattccttattcgtctggttcgattcgatcttcaaaaacttgggttaatcctaattccaagcctgttgctcacccaaccaatcaacctagtgctatgcttacaaactcgtcctctcatgacaatggtcaagcttgttcaacctggattccagattctggagctagcttccatgtgactggtgaaccacagcatatcaaacagtttgcacgctttgatggaccagaccaaatctttataggaaatggtgaaggtttgagtatctctagtgttggttcctcctcttttgtgtctcctaatgactcaggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 17504 - DNA, 240 bp, Glycine max
  Peptide Sequence Number=SeqID_109189
atggtagccataacccctgctaggttccctcaaacccccattttttctgaggatatgactcgaacgcaacatgtgcatatcgtgggggagccctggggcattccattgagcactgattttcaagtgcaagccattggtcagtttgctcaagcgacctgtgctcctgagtttggacttccaagaccgttcaatcagagattactcgtcttgcacgttggtggggttgccgtaaaacaatga

SEQ ID NO: 17505 - DNA, 439 bp, Glycine max
  Peptide Sequence Number=SeqID_109190
gtttcacatagacaagaatgtgaaggcaaagtgcaaatcactaattggtcagaagaatgtttgggactacgtaatggatagctggggtaacctagtagattgtccttcgaaacaggagtttcttgagcaccttcaaaggtttcaagtagtgtgttccccgtggccaatgttcgttgactacaatagcgttggagacctctatagtgtttgggatgcaatgaacaacatgatgacgctgcagcacactgaaattggagcatcattcgaaacaagtacgcatgtcgttggtcatgtttttaagaaaaccttgtacaagagccttctgggaatggtgtcaaggtacgctttaaatgaaatttcggttgagtttgagcgcgtacgtcatttcaaaaacatgctaaatagcggccctggacagtctcaagcggctcccacataa

SEQ ID NO: 17506 - DNA, 516 bp, Glycine max
  Peptide Sequence Number=SeqID_109191
atgatcccatataaatctgtaacacgtttaggtctttacttccagaatatcattgaggtaccctctgtttatcataaacaatgggctccagattacccgaattatgtggtgttcgactacaatggaaagaagcaccatataagagttagaaaatttagtaatcgagtctacattgttgatggtctcaaacacttcaggagggatatgagaatatatgaaggtgtgatgatcacatttgttgcgccggacaagaattggaagtttgatatccacttctcactaccactgcatgcacagacatgtggcaggcctgtccattctgccagagaatatgtgtttattgtggatgtcgacaatcgcatgattgctagactttatccattggtactgccactcgatgctgtgggttatgttaatgtaggagacgagtatgttacagtccttggtgttcgtaggcgtcgtcacttttggaagttgagtatgtataatgggcttcaatgttttgttgagccatga

SEQ ID NO: 17507 - DNA, 325 bp, Glycine max
  Peptide Sequence Number=SeqID_109192
atggcagaagaccacccacagaggatgacgctagaggactactctagctttgctacacctcagtacttgaccagcatagccagactagatgtgcaagcggccaacatttcatatccacattccctcatccagctaattcaagggaatatatttcatggagtaccagaagacgccattcacctcaacctattttcttcctctttggcaagtgaagcgaaaagatggcttcactcattcaaggggaatagcctgtggacgtgggaagcgatggtggagaagttcctgaagaagtacttccccgaagtccaagaccgcttaggggaag

SEQ ID NO: 17508 - DNA, 408 bp, Glycine max
  Peptide Sequence Number=SeqID_109193
atgggtgaagtggaggaggtgcaagagcagatgaaggccgacatggaggccatgaaagagcatatggccacaatgatggaggccatgatgagcatgaagaagataatggaagccaatacgattgcaattcccgctaccagcgctgttgctaaggtgaacccgatgcccccatctgatctcaaccaaatgaatcatccaatctcaaatatggtaggcaaagatttgggatgtacagacggccccatgatgtgcaaattcaaaacgagcacgccttcccgccacatggcttgcctcccaactatacgccacccaatgtggtgtacactcccaatgagaatgtcaataactccactcctatactcattgagagccaacaacctcaaatctgatcatgcacatgtctcttga

SEQ ID NO: 17509 - DNA, 2062 bp, Glycine max
  Peptide Sequence Number=SeqID_109194
gagcgctgactcaggtaataatacacagagtcagcaagcgattcttgttgccgctgaggaggcgcgcgctaaaacggtaccgacggtgctgacgggtatcggtgagctggaggcgactcgtcaggtaatggtgacgtcagaaagcggcggattggttaccgccattctctttaacgccggcgctcgcgtgcatgcgggacaaacgctggtgcaactcaacgatgcgccagaacaggggcaattgattaagttaaaagccgagagcgtaaatgccaaagcacaattggcgcgtacgcgtacgctctttcgccaacaagctgccacgcaagaacagcttgatcaggttcaggccaattggcagcaactccaaggtgaaattgttagagttcaagccttaatcgatcagaagcgcattaaggctcctttcagcggtgtgttgggggtgcgtaaagtgaacaccgggcaatttatacaagcaggcgacgggatggtctctttaaccgatgccggcgagatatatgcaaacatcacgttaccggaacacgcattacctgtgattaaaacagggttgaagatgaatatcacggtagatgcttacccaaatcaaacgtttagcggcaccatcagcacaattgaacccatgattgatagaggcacaagaaccctgctggttcaggccacactcgctaattccgataatcgcttgtctcctggcgtgttagtgaaaggcagcatttctttgcccgatccgcagaagatcgtgagcgtaccggaaacggccatcaactataacgcctaccgggattttatctacgtaattgataaaaatgatgaaaataaactcattgcccgccaggtttatgtcaaaaccggggggcgcgatggcagctacgtcgctattgtcgaaggcatcaaggccggagtacgcgttatcacgtccggacaactccgtatcaacaacggggcacctgtcgaaattgcatcggtggatactctagccactgaagatcaaagcgcgcatagcgtggctcacacattgatctttttaatggggctgttagcgcttaataacttgcccgtacggcaatatcccttaaccgaaagttcgacgcttaccatcaccacacagtaccctggtgcgtcaccacagctgatgcaaggttttgtcacccagacgatcgcgcaggctgtcgctaccgtcgaagatgtcgactatatgacgtcaacatcgacacagggtcgcagcgttattatggtgcgtatgaagctcaatgccgattctaataaggcaatgacccagattatggccaaggtaagcgaggtgaaataccgcttgcccgcagaagcttacgatcctgtaatcgtgaagtcatcgggagatgctactgcggttgcttatgtcggtttttcaagcccgacgatgagtacggcggcgctttctgactacgtttcccgcattgtacagcctcagctctcttctatcgaaggtgttgggagtctggatttgaacggcgggcaaagaatggcgatgcgagtttggttgaacgccgagcaaatggcggcgcgcggcatcgcggctggagacgtttcacgggcgttgctggagaacaatgtacaggccgctccgggccaggcgaaggggctttatgttgtttccgatattcaggtaaatacggatcttgtcagtgtcgatgagttccgcaatatggttgttaaaagaacgataaacggtgttgtgtatcttcgtgatatcgctaccgttgaactgggcgcggcgtcaaccaacaccagcgcattaatggatggcgtcaatgccgtttattttgggctgaatgccgcgccaaatgccaacccattggttatcgtaaaaaaacttaatgaaatactgccggagattaaaaagaacctgccccctgatgtaacggttgcggtgccttttgaactggcacgttttatcagcgcctccatcgatgaagtcgttcatacgttaattgaagccatcgttattgttattttcgtcattttcctcagtttgggctctgcgcgagcggtcattattccg

SEQ ID NO: 17510 - DNA, 207 bp, Glycine max
  Peptide Sequence Number=SeqID_109195
atggagggctgttgtcctttgggacaaacgtgggaggtgctaataccttcctcaaacgtaaatacaactcccgaatcttggaatattcttcatgaccggtttccttcagtttttctgacgttttccacaaataaacgttggtggcgactcagcgcattttcctccattggaagacacacccgtgagcctcgcctcgctcgctcgtaa

SEQ ID NO: 17511 - DNA, 259 bp, Glycine max
  Peptide Sequence Number=SeqID_109196
gtggccaaccaccgggggcaagtgcagatacatgagtgtctctaccagctcagcctcagtcagcagggccagggttttgctccttttgcatgccctactccagatcagtttagggctgaggtcgcatggctcagagattggcccgagggaccagacgaaggaggcacctgcaggagctcccgacgatgcagaggatgcctgcatggatgaggagatgacagacttgctcggcttcttgggaggaagcggagccatgtga

SEQ ID NO: 17512 - DNA, 189 bp, Glycine max
  Peptide Sequence Number=SeqID_109197
atgacggtgaaaacctctgacacatgcagctcccggagacggtcacagcttgtctatgcggtaaggagaaataccgcatcaggcgccattcgccattcaggctgcgcaactgttgggaagggcgatcggtgcgggcctcttcgctattacgccagctggcgaaagggggatgtgctgcaaggcgattaa

SEQ ID NO: 17513 - DNA, 249 bp, Glycine max
  Peptide Sequence Number=SeqID_109198
atggcagcaaaatggagaaggaagagagagaggagacgccacttcaaggagaagatgagtctagaagatgctcaccaccataggaggccatggataagagcttggaggaagaaggagatgaatgaagggagaggaagagaagagcacggaattattgaatttcagatatggttcaacccactaatccaagatcaagtacaagattctccactaagtgtgcttaggtgtcatgaggcatgtaaagcatga

SEQ ID NO: 17514 - DNA, 199 bp, Glycine max
  Peptide Sequence Number=SeqID_109199
atggaggtggacaatacagacgatcacccaactggacctcctcttgaattagttgcctgtaataatgctgcacctgcaggaagtgtggacaatacggttgaaaatgattttcaggatcatcaattgatggctgacttattaagtgataatggtgaactgaagactgagcaaatttctatgcaagaatctgtattccatg

SEQ ID NO: 17515 - DNA, 216 bp, Glycine max
  Peptide Sequence Number=SeqID_109200
atgggaaagaagcctcctcctggagaatgcaacaaagagaatgattcagattgttgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17516 - DNA, 174 bp, Glycine max
  Peptide Sequence Number=SeqID_109201
atgctaagttaccgtgtctgcaaagttggcttagctggcaaggagcccgtaaagcctaagggccgctcagctcagcaaatgccgcaaggaattgtgcttggctcaggaatgctcggcttagcgcgtggctatcaccaaaacaattggttaagttacctgggcttagcgatttag

SEQ ID NO: 17517 - DNA, 561 bp, Glycine max
  Peptide Sequence Number=SeqID_109202
atgggtgatcaagaggagacgcaggaacagatgaaagccgacatgtcggctctgaaagaacaaatggcctctatgatggaggccatgttaagtatgaagcagctcatagagaagaacgcggccaccgctgccgctgtcagttcggctgccgaagcagacccggctctcttggcaactacgcaccatcctccctcaaacatagtaggacggggaagggacacactggggcacgatggcagcccttacctgggatacaaccgagcgacttacccttatggattgccgcccaactattcaccacccgtcttgcaagaagatgcgggccacactgcttctcccgtccatgaaagagagcctcctcagcagcccgatgaagtccacaaagaccctcaagattatgctcgaagggatgtcgagttctatcccccgatccccgaagggccggcaccaggcacgttgcctcaacccaacatcgcagcatcaccaatagtttgtccacggaagggccgcccccagcaactgaagaaaggaggaagctcgatctccttgaggaaagattga

SEQ ID NO: 17518 - DNA, 387 bp, Glycine max
  Peptide Sequence Number=SeqID_109203
atggtgcgctgtttcttcttctgcctcatttccatgttatctgtagaaggcaccattactattactccaaagaagtcaatccaaggaaccaagtccctggtttctgcagctggaacatttgaagcaggattcttcaactttggaaactcacaaggccaatactttggtatatggtacaagaacatatcaccaaggactattgtgtgggttgccaacagagatgcccctgtgaaaaactcaacagcatttctcacactaactcatcaaggaaatcctgttattcttgatggctcaaagggtatcgtgtggttctccaactcatcaagaattgctgagaaaccaatcatgcagcttttagactcaggaaatcttgttgtgaaagattga

SEQ ID NO: 17519 - DNA, 420 bp, Glycine max
  Peptide Sequence Number=SeqID_109204
atggagcgtggtcatggaatgtattacacgccagcaacattttccgaatatccttcacagatgtatcagtatccttttgcaggtcatcatactgatacttttgagacctcacattcgttcggtggtgttgcggaaacacagcctcatttttcatggcccactatgactccttcacagcagcacgatgcccccatggcaacacctaacgccccatttgctccgcaatggaatgtacccggagcaatacctgatatgggcgagttattaggtgttgatttgcgtcaggagttttctgcagaggctgaggaagcagaagcggggagacaacgcggcggcagaagaaatcctgatcgtcaagcgcgaagatgggatcgaccatgtggcacatcttcacgacatcacggacaccataatgactga

SEQ ID NO: 17520 - DNA, 201 bp, Glycine max
  Peptide Sequence Number=SeqID_109205
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagagaagaggacatggtatatcaacttgctacttcaagaaaaattacagtaa

SEQ ID NO: 17521 - DNA, 111 bp, Glycine max
  Peptide Sequence Number=SeqID_109206
atggctgggacgccactatgcgcagccaaggcttctcctcgtgcctcctccatccctaaatcttcaaaccttcgtatcttactcaaatcttcaccaaaacacgtcccgtaa

SEQ ID NO: 17522 - DNA, 420 bp, Glycine max
  Peptide Sequence Number=SeqID_109207
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgaagggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 17523 - DNA, 648 bp, Glycine max
  Peptide Sequence Number=SeqID_109208
atggaccgtatgtacgcctacaatgggtacgtgatatctacgagcaccgatgccaggcaggcccttcgtgacctcagtcagaccgagaggtatgcctggggagtagctgcgctggtgcatatgtatgaccacttgaacgatgcctctatcaacagcagccgacaacttggcggttacatcacactgctgcaagtggattgccatgaagaagatcgtgaagaacatacgtacaccggggtacagggagcgcctggaccgactctggattctggatgtctgttggatcccatatggggagcaccgaccggtccaggacatccatatgatttcatgttattccggtctcctatgctgggggcccgttgcgtgtattaccgaccagagagggtcatgcggcagtttggatacacccaaaccattcctgctccgcctgttgattcatgggtgtcgtatgatgatatacacgataggtggatgcactattcggatcataaggttccagcaggtgaggccagcatcagatcctctgccagatggtcatgctccgcagccctgagtcgtccctcaggccccagagacagatatccctcacgtgccggagctaggagcaccatcgacatctgtgaggcccgctatggaggagcctag

SEQ ID NO: 17524 - DNA, 327 bp, Glycine max
  Peptide Sequence Number=SeqID_109209
atggacataattggaggcgactacagcagccagtgcttaatgaatagaatagtcgctatgaaagacggtttcaagaaacgccaccacaaggtgtcaaatttggacgatttggtgtcgtgccttgataagatgactcttttagctgaggaagaggatagaattattgaggcacgtgaagaagctcctcctttggttccacaatttgaacgtcaacagtttgatatgtcgggtaggagtgtggagacccaaggtttaaggcgacatagggaaagtgtggatgccgaagcacatgttattcctatgatgccagagcgccaacatgggatt

SEQ ID NO: 17525 - DNA, 222 bp, Glycine max
  Peptide Sequence Number=SeqID_109210
atgttgtggaagcttgggaggattgatggggacccggtgttgagagaaacgaggatatgggctacgtgggagtacgtgagctcagatggaggtgggcaacagggggatggagtggtacctggagatatgtctcgggggtcaggagaccttgcggtgacgtcaggtggggtgctattgtccaataatccaagcttgaccaatcccgacccagtccgggcatag

SEQ ID NO: 17526 - DNA, 145 bp, Glycine max
  Peptide Sequence Number=SeqID_109211
atgggtaccgagctcgaattcgtaatcatggtcatagctgtttcctgcggtttgcgtattgggcgctcttccgcttcctcgctcactgacttcgctgcgctcggtcgttcggctgcggcgagcggtatcagctcactcaaaggcg

SEQ ID NO: 17527 - DNA, 297 bp, Glycine max
  Peptide Sequence Number=SeqID_109212
atgttaggattcacaagcgattctcctcaaattttagccagcccgcatcaattagactttgcaccttatgcttcagggccctacaacgctcaatggaatgccccggggctcctccatgataagcacacgttgcattcgagtcgtatcctcggaggaatggaggttgaggaatcttggctttttttctgcaaaatccatttcttggttggtgtttcgatttgtgctaaaggtggtgttcgtcattggaagtgcggtaggaatgacatttttgggctagggggaagtttggccatgtag

SEQ ID NO: 17528 - DNA, 237 bp, Glycine max
  Peptide Sequence Number=SeqID_109213
atgagggatggcaagaagacttcgtacgtcattgggatcgaggtgaattccggagtgggcctcgggggaaagttccttatcgcattggaatcggcgccaaagtgggcgttgctggccgggcgagtcggggttggagccggagcttggggggcctccctctggatgggcgcgggcgctctaggttgtacgggtgctgagttggaagagtcctcggcgcgagctgagaagctcgggtga

SEQ ID NO: 17529 - DNA, 276 bp, Glycine max
  Peptide Sequence Number=SeqID_109214
atggaagaagaaaaagtagtgccgaactacgacgagctgacttgtaagggcgagacaactgcgtggttcaagcaaggtctcggcttttcctcttcagcaccaaaggatgatgttccaaaaccctcctcctccttcctctccaaattcgtaaaagcctccttcgagtcgacgaaacaagcgcagctccaatccatccacgacaatctcaagaaaaagccttctttcgagtctagggtttcgagcagggatagggatagtgatagaagtagaagatga

SEQ ID NO: 17530 - DNA, 218 bp, Glycine max
  Peptide Sequence Number=SeqID_109215
atgtggactcttcaacttactcaggaaatgctggatcatcctgaacccctgagcttgctgcaaccacaagacagtcttaaggcggcatggcccccactgcaatggaaagttgaaacgctgaatcctgctattggtgaaaaaggtgttgtccaaccatggtatgactttcttgaagacatgaattttgatgatggagatgaaatctctatttattatag

SEQ ID NO: 17531 - DNA, 246 bp, Glycine max
  Peptide Sequence Number=SeqID_109216
atgatgaaagccctcacaagctcttgttctaaggccagggtcgagactctaggacccttctctcccagagttcccctttgtgtttctgatagacccgaattctgcttcacccttcgttccaaaaatgagaaaaagggatggaatttattgctcctgaaactggttcgaaacaatgatctttaccctgttcatgcagtgccaccaaaggaccaggaggatatgagccaaatgaaagacaaaacttag

SEQ ID NO: 17532 - DNA, 165 bp, Glycine max
  Peptide Sequence Number=SeqID_109217
atggcagaaatcaaccaaggtacatgggaacggatgcaaatggggatggggtcacgaccgaccaatcgttgccctttcccggcgctaaacgagcagagaacgtcgctgcaaggcagcccagtatcttttatgtttgcagtttcttttactatttgtcagtattaa

SEQ ID NO: 17533 - DNA, 84 bp, Glycine max
  Peptide Sequence Number=SeqID_109218
atggagcctcataggggggcacatcagagaatggagttcttgctcatagtaatgctaccacgaataagaatccaaggaatgtaa

SEQ ID NO: 17534 - DNA, 750 bp, Glycine max
  Peptide Sequence Number=SeqID_109219
atggggaattttgaccaggacaggtggaggtggaacttcaagtggcgaaggaatctgtttgattatgagagtgatcaagctgtgaattttatggaggagatcaattccatacacattcagagatatgttaaagatgtcatgttatggaaagctgaccctaaggaggtggggcatctatttttcaattgcaagaagatagtagggctatggtgggagtccatgagctggattcaggctatgggacctctcctagcttctccagtggaccattttcttcagttttgtgatggttttggagcagagaaaaatcatagtacttgttgtggatggtgggttgctttgacaagtactatatggaagcataggaactttctcattttccaggacaaacctttcgagccgcagaaggtcatggaagatgctatgttctcaatttggtcttggttaaaggctagacaaaaaggctacaacatcagttttaaccattggtcttccaacatctcgaaatcctttgaaaggcggataaaggtagagttatgctacaagcctagaacaacagatgaacagaaaggcagtgccatatggaaggtacaattgttgccacggttcagtggctgtaactgtcaagaaaatctgtggcacattctagcattattggagttctatactttcgtcattgtgatgctaattccttacaactacagtactatttctgatgagccatatgacagtgcaacttccacttcctag

SEQ ID NO: 17535 - DNA, 396 bp, Glycine max
  Peptide Sequence Number=SeqID_109220
atgacgctgaccgacataaccagtgtgatacaatcatcaattacagatgccaatgtttcttccacaattaattcaatttggtatcattgtcttatacatgaaattaatggacatgttgagtatacgacatgtccaattattgatgaagaagatgtttggtgcatgtttaatacattcgcaaacatgcgaagtgtaatatctcatgggcccgaaatctaccctaaggctcatgagaaccctagggtcttctcttgcatctttgacccaatcttcttggagtcttctatccaatgcccttcgggggtaggattgtatcattccctcccccttgaaaaggatttgacctcaaatccagaggttcttgaaactatgggcttcttccctcaacacctgtaa

SEQ ID NO: 17536 - DNA, 224 bp, Glycine max
  Peptide Sequence Number=SeqID_109221
atggctcaattgatttctgatgtcatctattgtttgcatggatcgcgcccacaagacgcccagtggacccgaagaagtccaacaagaccctggggtttccagctctggttacgggcctctatcagtcctacagggtgcccgtcccccccagcgagggatcgcgctcgtaagacacccagtggacaaaaaggagtcccatatggtgcccgtttccccccagcaag

SEQ ID NO: 17537 - DNA, 230 bp, Glycine max
  Peptide Sequence Number=SeqID_109222
tggagccagtccaagtgatcgaggtagcgtcgtctgaggaagaccctgaggaggatcttgaggagctacctcctgagcctgctgtggatgctcttgactttctagagggtgatgaggattcccttcctgaggtggatgctcccgaggaagtcacgtcggcatctgaggcagactctacggaggatagtggcccgggagagatggcgatcagtggaggctcttcatcatag

SEQ ID NO: 17538 - DNA, 474 bp, Glycine max
  Peptide Sequence Number=SeqID_109223
ggatttccgggtggtgccgagcgacccatctgtgttgaccaggcaatgcggatccacgttgcttgcagcgtatggacgggagaggtagtgctgaatttgagcctttccctctgggaggaaggctccaccgtgattaggatcgacgaggcttctgcccgccgcctggaccgatccggattcggatgctattggtcccgttatgtgggagcatcaggaggtggcaccgggacttccacgtcagatcatgctattctggtctcttgcactggtgggcctgttgctgtttattaccgaccggagagggtcgtgcggcagtttggttacacgcagaccatttctgctcctcctatcgattcatgggtctcgtatgatgatatacacgacaggtttggatgcacgtacgaggatcatatcgtacctgcaggtgaggtgtgcattgtgccaggggcgtgtccagtgactacatcgacgtga

SEQ ID NO: 17539 - DNA, 792 bp, Glycine max
  Peptide Sequence Number=SeqID_109224
atgtcaccagcctcaaggaattgggacgggaagattctagatttgaccgtagcggaggtatttacgggagccgtcgtatccctcgcccaatactatgaccagccgttgaggtgcttcacgtttggggacttccaaatggtaccgactattgaagagtttgaggaaatactaggatgccctcttcggggaagaaaaccgtatcatttctctaggtttcttccctccttgagcaagattgcagctgtggtcggggattcggcaaaagagttggatcgcatgaagcaaactcgcagcggcgtagtaggcctgccacggaaatatttggaaggcaaggcaagggatatagcgagccaagagaagtggggcccgtttgcggatatattagctttgttgatttttggggttgtcctctttccgaacgtggacggtttggtggacttagccgccattgatgccttcctcgcatatcaccatagcaaggagagtccagtggtggctatcttggcagatttgtttgacacctttgaccgaaggtgtgagaaaaacagtgcacggattgtctgttgtttacccgctctttgtgtgtggttggtttcacacctattccaacaagacacaatacacccgtgtccgcttcaaagttatcgctcatgcgccgaaaaaggaggagtcgattgggaccaacatttggctgggataggaggcagcgcaatcaattggtttcctcgttggaaggaaaggcaaggaaaggagttcttttatcgtgtggggactacactaatgttccattga

SEQ ID NO: 17540 - DNA, 570 bp, Glycine max
  Peptide Sequence Number=SeqID_109225
atgcgatccgacaaggttcagctcgcgttgaatgcgccggatctgctcgcgcaggtgtttgcggatgcgcgcgtccagcgccgacagcggttcatcgagcagcagcagccgcgggcgagtgaccagcgatcgcgccagcgccacgcgctgacactggccgcccgacagctgatgcggatagcgcttcgccagatcgctcagctccaccagcgccagcacctcctgcacccgctggccgatctgcccggccgccagcttctgcattttcagcccgaaggccacgttgccttccaccgtcatattgggaaacagcgcatagctttggaacaccatgccgatgccgcgcttttgcggcgccagcggcaccagatcctgaccctgcaacaagatttgcccgctgtcgaccggggtcaggccggccagacagcgcagcagcgtcgatttgccgcagccgctcggccccagcagggtgacgaactccccctcttcggcggtgaaatcgatatcctgaaacacttgggtctggccatagtgtttgttcaggcgggtgacgttgagataagccatcgg

SEQ ID NO: 17541 - DNA, 219 bp, Glycine max
  Peptide Sequence Number=SeqID_109226
atgggtctctgtgagttctacggagtgcctgtcgcccccagcaaggtcatcaggccccctactaatcgagctttcatcaagaagtactgtgtccccaggcaggcgcaggccaaaacaccacagcagcctggggatgcccgacagcaggcaacagacgcaccgccatcacctctagagttcacctcagctcatccacaaaaaggtagaaagataccctga

SEQ ID NO: 17542 - DNA, 243 bp, Glycine max
  Peptide Sequence Number=SeqID_109227
atgacggactcttcggagtgtaggccatgggggtcacccggtttgagtgctcctttaagcctgtgtcgatcccacgtggttggagcattctcgcaaaacattgtgaccctgactagtctccctatgatcttacctagatttagtgggtaccgagctcgaattcgtaatcatggtcatagctgtttcctgtgtgaaattgttatccgctcacaattccacacaacatacgagccggaagcataa

SEQ ID NO: 17543 - DNA, 521 bp, Glycine max
  Peptide Sequence Number=SeqID_109228
tcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgggtagcagaaggagtagcagctcatccagatgctgactttgtagagtctttagagataataataataataggtgaagatgcgggagctgcttcgagctcggaagaagatggatccgccactagagatggtggatcagttggcactggttcgacctgtgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17544 - DNA, 369 bp, Glycine max
  Peptide Sequence Number=SeqID_109229
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgagacatattgaaagcctccggtggcaccacctacattagaacgaagatagtggttaatgttgtcaaactgaaatga

SEQ ID NO: 17545 - DNA, 99 bp, Glycine max
  Peptide Sequence Number=SeqID_109230
atggaagttggaagttggaagtggaagttggaagttggaaatgaaagttattggaagttgaaagttgaaaatgcagtgtacttgtttttgcttgattaa

SEQ ID NO: 17546 - DNA, 345 bp, Glycine max
  Peptide Sequence Number=SeqID_109231
atgactgtggttatgaacatattcctcgtgatagcacaacaacttagtctcgtactatcaaggactttagaatcagaccagtttccactgttgaatgaccctaacaaagcatgcatctacgtgatcaagtccggaaacctcctttacaacaaagagaagaacaagatgaaagactgcaaaaacacaagtggtgaggatgtctccttcacctctaggatctcacaatcactcacaaactcatctcaagctctcagaacagcttccgcttcaaactcgcatctcggcagatcttcacacagcaaaatctctcagaactctctggaacttggacctttctctctctag

SEQ ID NO: 17547 - DNA, 247 bp, Glycine max
  Peptide Sequence Number=SeqID_109232
agatcgtgcccgcaagacacccagtggacccgaagaagtccaacagggtcttgaattctacggagtgcctgtcgcccccagcaagatcatcaggccccctactaatcgagctttcatcaagaagtactgcgtccccaggcaggcgcagggcgaaacaccacagcagcctggggatggccgacagcgggcaacagacacaccgccatcacctttagagttcacctcagctcatccacaaaaaggttag

SEQ ID NO: 17548 - DNA, 594 bp, Glycine max
  Peptide Sequence Number=SeqID_109233
atggccgaccctctcaatgagtcaatctcgtgctgtctcttaagggtgggccctggagggctgcacgcccttgcctttagagggctacacgccctcaccttcagagggctacatttcctcacattcagaggactacacgcccttgcctttagaggactacatgtcctcaccttcagagggctacacgccctcactttcagaggactacacgtcctcgccatcagagggctgcacgtcctcgccttcataggactacacgtcctccccttcagaggactacacgtcctcgccatcagagggctacgcaccctcgcctttagagaactacacgtcctcgtcttcagaggactacaagtcctcgccttcagaggactacacgtcctcgccttcagaggactacacatcctcacatacagaggactacacatcctcgccttcagagggctgcacgccctagccttcagagggctacacgccctcatcttcagagggttgctcgcctcaccttcagagggctacatgccctcgcctttagagggctgcatgccctcgcctttagaagactacatgtcctcgccttcagaggggctacat

SEQ ID NO: 17549 - DNA, 459 bp, Glycine max
  Peptide Sequence Number=SeqID_109234
atggcaagagtagcaagagtggttaagatctcagcacaagagttagaccgagtgaagcaaaacaggaatggggtggtagggataccaaagcagcgcttggaggaaagggctgaagctttggtagatcaaggagagtggacttcatccaaatgtagacgggctagtggatttagcagcgatcgatgcttttcttgcttatcaccacagcaaggaaagcccggtatggtaggagcgcttgttagttggttcccccgatggaaggaaggaggggccggagttttgtgctcgtgtgaaggactctcaaacgtcccctcgatggaaacaaggggttgtattaattataatcccatattggccataagacaactaggctaccctatgagagaggcaccatcagaagagatcatcacgcctttcgtcgcacgaggttttagtgaaggcaatgcaaaaatgctttag

SEQ ID NO: 17550 - DNA, 168 bp, Glycine max
  Peptide Sequence Number=SeqID_109235
atgagaatagaagatcttcgagcatgttacaacatccatctgatgggaatgtgcgactcaatttatgcacatatggatttaacccatatattcaagcatcctcttcaccttattattgttggccaatcattgttaccccatacaatcttcctccagaaatatggatga

SEQ ID NO: 17551 - DNA, 228 bp, Glycine max
  Peptide Sequence Number=SeqID_109236
atggctccgaagaagcattccacaaagaggtccaggagggatgcccagggggaaagctccagcgtctccgtggagttcgacagtcactgggagaggcgcgtccagctcatggaggatgagtactcacacatccaggaggagatagcacacaggcattggacacctctagtgactcccatggccaagttcgaccctgagatagtcctagagttctacgctaatgcctag

SEQ ID NO: 17552 - DNA, 206 bp, Glycine max
  Peptide Sequence Number=SeqID_109237
ggaaagtattctacctcgttggaccgtattcgctactaaaacgtagccctcctccgccttcgtttgaggaagcaggctgtgaggcaactatggaatccgccttccctgattccgatgctgttgagcggcggctggtagtgaaaggaactgacgatcttggcttagatggctttgctcctggggaacatcatttatcgatagtcaag

SEQ ID NO: 17553 - DNA, 3363 bp, Glycine max
  Peptide Sequence Number=SeqID_109238
atggaaaaacttgcctctcttgaagaggtccttttgaatggtggctctagtgtaaacaacagttctgatcccagtaagaccataggaaatgaaaatttaacttgctattcaaatgcgggatttttcagcattcttactttttcatggatcagtccactattaagtcttggcaatgagaagactttagatcatgaggacctcccactgcttgccgccgatgacagtgcctatggggcttttacaacttttagaaacaatctcgagtcagagtgtggtagtgaccttaggagagtgaccactcttaagctggtgaaagtgttaatcttctcaacatggaaagggatcgttttatccggtttgttagaattcttatgcacctgtgcttcttttgttggaccctatcttattgaaagccttgttcaatacttcaaccaggaacacaagtttaaaaatgaaggctatatgttggctatagcatttgttgcagcaaagcttgttgagtgtcttccagataggcacggcagatttaacttggagcaggttggagtaaggatgcaatcaatgttggtggcaatgatctatgctaaaggtctgactctttcctgtcaatcaaaggaaggatacagcagtggggaaatcatcaacttaatgactgtggatgcggaaagggtcgatgaactttgttggcacatgcatgctccatggatatgtgttctgaaagttgcgttggccatgttaattctctacaaaagtgtcggggttgcttcaatagctgcttttgctgccactgtaattgtgatgttgctaaaccttcctgtggcatcattgcaagaaaagttccaaggtaagataatggagttcaaagataaaagaatgaaggtgacgtctgagattctaaagaatatgaagattctaaaactgcaagcatgggagatgaagttcttatcaaagatttttcatcttaggaagactgaggagacattgctaaagaaatttctagttagctcagctactatgacatgtctcttgtttaatgccccaacttttattgctgttgtcactttcagtgcttgctttcttataggcatcccacttgaatcagggaaaatcttatctgcacttgcaacattcgaaattcttcaaatgcccatatacagtcttcctgacacaatttcaatgattgcacaaactaaggtttcttttgataggattacatcatttcttagtctagatgacttgcagactgatgtagtggagaaacttccacggggtagttctgacatagcaattgaattagtaaatggaaatttctcttggaatttatcttcccttaacacaacattgaaaaacataaatctcacagtttttcatggtatgagggttgctgtttgtggtactgttgcatcaggcaaatctagcttactttcttgtataataggtgaaatacctaagatatctgggaccctaaaggtgtgtggatcaaaggcttatgtttctcaatcaccatgggtagaaagtggcaagatagaagagaacatattatttggcaaggagatggacagggaaaagtatgagaaggtgctagaagcatgttccttgacaaaagacctggaggttctaccatttggtgatcaaaccatcattggagagaagggaatcaatttgagtggtggacagaagcaaagagtacaaatagcccgtgctctttaccaagatgctgacatttatttgtttgatgatcccttcagttctgtggatgctcatacaggatctcatctctttagggagtgtctgcttggccttctaaaaacaaaaactgtgatatacataactcatcaagtagagttcttacctgatgctgatctaatattggtcatgagagaaggaaggataactcaatcaggaaaatacaatgacattctcaggtcagacactgattttatggaacttgtaggtgcacatagagaagctttgtcttcagttatgtcctcagagagaattcccacacttgaaacagtgaatatctccacaaaggactcagattcattaagatattttgaacttgagcaagaagagaaaaacatagatgatcatcatgataagtcagatgacacagttaagccaaaaggccaactgattcaagaggaagaacgggaaaagggtagagttcggtttaaggtctactggaaatacatcacaacagcttatggaggagcttttgtaccctttatattgctctcacagacacttaccacggtttttcagattggaagcaactattggatgactttagaaactcctatttctgcaactgcagaaactggtattgaaagctttacccttatggttgtctatgttgctttggcgattggaagttcatttttcaaccttgtcatatcagttcttagagagatagctggatacaagacagccactatactctttaataaaatgcatttttgctttttccgagcaccaatgtcattttttgatgccaccccaagtgggagaatccttaatagagcttcaacagatcaaaacacaatagacataagcatttcatatttggtatgggtatttaccttcattttgattcacctcttgggaactattgctgtgatgtctcaagctgcatggcaggttcgatatgcgcctcatttgcctctaattttacgtggtcttacttgcactttcgctgctggagcaaaaactggcattgtgggaagaacaggaagtggaaaatcaactctagtgctaacactttttcgacttcttgaacctgttgctggacagatattgatagatagtgttgacatatctttgattggaattcatgatttgaggtccagactgagcattattccacaggatccaacaatgtttgaagggactgttcgaagcaacttggaccccctggaagaatacacagatgaacagatttgggaggctctagatatgtgccaacttggagatgaagtaaggaagaaagaagggaaacttgactcctcagttactgagaatggagaaaattggagtatgggccaaaggcaattggtgtgcctcggccgcgttctactaaagaaaagcaagatattggtgcttgatgaagctactgcctcagttgatacagccacagataatattattcagcaaacagtgaagcaacatttttcagaatgtacagtcattaccattgctcatagaataacttcaatcctggatagtgacatggttctgtttctaaatcaagggctcattgaggaatatgattcaccaaagaaactacttaagaacaattcttcatctcttgctcaactagttgcagaatacacaaggagatcaaactgtggttttggaacttaa

SEQ ID NO: 17554 - DNA, 1428 bp, Glycine max
  Peptide Sequence Number=SeqID_109239
atgactaacacgacaccaagtggactttgcgctcagagtgttgaagataacacgaaacgaaactcatcatttagttgccatccatcttcttttttttttttcttccaccatttcccaccgatgtacactcccaacgccgattccggcacggcgccgcatccgcgccccaccatcacgctccctccgcgtccctccgccgaggccttcttctctgccgccggcggcgccagccccggccccatgaccctcgtctccagcttcttcggctccgatgccgctgccgactgccgctccttctcgcagctcctcgccggcgctatggcctccccaatggccttctccgccgccgcagcatccgccgccgacaactccggcaaggacgacgatgggccccacaaggggttcaagcagagcagacccatgaatttggtcattgctcgttcccctgtcttcactgtcccacctgggttgagcccttctgggtttcttaactcccctggcttcttttcccctcagagcccctttgggatgtcccaccaacaggctttagcacaggttacagctcaagctgtcctagctcaatctcatatgcatatgcaagctgattaccagatgccttcagtaacagctcccactgaaccacctgtacagcagctgtcttttgctctaaatgaagcttcagagcagcaagtggtatcatgtgtatcagaacctagaaatgctcaacttgaagcaccggaactctcacaggctgataagaaatatcaaccatcttcccaggccattgacaaacctgcagatgatggctacaactggcgtaagtatgggcagaagcaggttaagggtagtgagtatccacgaagctattacaagtgcacacatctgaattgcgtcgtgaagaaaaaagttgagcgtgctcctgatggtcacataactgaaattatctataaaggccagcataatcatgaaaagcctcaggcaaataggcgtgccaaagataatagtgattcaaatggaaatgtaactgttcagcccaaatctgagtcaaactcacaaggttgggttggacaattaaacaagttaagtgaaaacattcctaattcttcagttcctgaaagtgaccagacctccaatcaaggggctcctaggcaacttctacctgggtcaaatgagagtgaggaagtgggtattgtagataatagggaagaggcagatgatggcgagccaaaccctaagagaaggcaagctaaatttctgcttttcaggaatactgatgttggagtttctgaagtacctctgtctcagaagactgtcacagaacccaaaatcattgtgcaaacaagaagtgaagttgatcttttggatgatggctacaggtggcgaaagtatggccagaaagtggtgaagggaaaccctcatccaaggtga

SEQ ID NO: 17555 - DNA, 447 bp, Glycine max
  Peptide Sequence Number=SeqID_109240
atggctagcattgtgaattcaatgcagttcgagctgaaatccggtcaatccaagtgcatttccgaggatttgaagagtaacgtcatcaccgtcggtaattactacgttcttaatcccaacaacgatggattccccattcctgattctcacaagatcactgtgagggtgcgttcaccttatgggaacgattttcactatggggatagtgtgcattccggtaattttgcatttactgcagctgaggctggtgattacactgcttgtttttcggtgccatccaatctcaaccttgcggtaactgttctcgttgattttgtttggaaaaatgggtttgctgcgaaggactggtctaaggttgtcaagaaggggcatattgaagaatgcatatacaaagaattgcttcatcttggtttgaagaagcggagaggagtcactatgaactattaa

SEQ ID NO: 17556 - DNA, 804 bp, Glycine max
  Peptide Sequence Number=SeqID_109241
atggctcacacgctgagcgctcctcacccgttgatacagcagaggatacgaagcacgcgcttggcgggctctgccgcgccaagcgcgctcatctattgggaagcacgcgctaagcgcgctcttatgacttcccgcaagcgccgtgccgtgcccacaccaggggaagcgtccaactgggacacttcccgcttcacatctgagattgcctggcacaggtaccatgacaacatccagcttcggaacatccttccggagaggaatgttgaactgggacccgggatgtttgacgagttcctccaggaactcaggaggcgcagatgggatcaggtgccgactcaccttccggagaagcggattgacgtggctctggtaaaagagttctattcgaacctttatgatccagaggaccacagtcccaggttctgcagggtgcgaggacaggtcgttcgttttgatgctgacaccattaacgacttcctcgacaccccagttatcttggaggacggggaggagtatccagcatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttactacgatcttgcgcccacttctcacacttctgatgttaatcttgacagggcccgcttgatctacggtttgctttatatcacagcagatcagccagattgcccagtccagcacctcgaggctcgg

SEQ ID NO: 17557 - DNA, 424 bp, Glycine max
  Peptide Sequence Number=SeqID_109242
tgggagtcttctcagtttagaggaggcagtgggagcaatgacattagaagaggggaaggtgaagatcgagaagttcgatgacaaagatttcagctttttgaagatgcaaatagagaattatctatatcaaaagaagttgtatcaacccttatcaggggttaagccatatgacatgaagcaagaagaatggaacttcctagatcaacagactattggcgtgatcagattgacattagccaagaacgtcacgtataccgctcgaatctccccaacaattggtatcagagctgatggttcgacttgcggcgatgcaagtatcgcaagtggcaagaatggctatactaatggatgtgtgaggtctccttatgtgctggctcgtggtccacaggtgtactcctcagataaaattggatcaaccgattga

SEQ ID NO: 17558 - DNA, 1356 bp, Glycine max
  Peptide Sequence Number=SeqID_109243
atgaagattaacgtcaagactctcaaggggactcactttgtccttcaagtgaaccctcaagacacggttgctgttgtgaagaagaatatagagacagcgcaaggtgctgatgtttaccctgctgcgcaacaaatgcttattcatcaggggaaggtgcttaacgatgccacaacccttgaggaaaataaagttgttgagaataattttgtggtgatcatgttaagcaagaataaggtatcaagtggagcctcatctgcgccctcaaacctgggaacccaacctcaaagttctttgcctcctacttcatcaacatctcaacctcctgcatcggctgtaggacagggagaatccaattctgagcagagtccagttataactcctcccactattgctgtgcccagtatctatgatcatgcagcatcaaatcttatggcaggaagtaatttagaaacaactattcaacaaattctagaaatggggggaggaaattgggaccgggatactgttaccggtgctcttcatgctgcatttaacaatcctgaaagagctattgaatatctctattctctgttaattggtactttgttatctgttggattagagactcctgttgctgctcacgtcatttttaaattgactggcttaatgctgcaaagaattaagccctcaaaacttgtgcttttagtcaactatgctatcttgtgccagtacagttttaaacttatgggaattcctgaacgagctgatgtaccagcagctgtcagatccctgattactgggcaagcagaaaactcatcaatccagtctacccaaccagctgtacctactggtggaccgaacaccaacccactcaacctgtttccccagggccttcccaatatgagtgcaattgataatagaggagacttggattccttgcgaaacagagaagagttccaagcattaagagagacgatgcgagaaaacccccaaattttgcagcctatgattcaggaactgggacaacaaaatcctcagctaatgcagatcatccaagatcatcaagaggacatacttgaccttatgaatgaacctgaaggggacgagaatttacagagtcagttggattccatgatttctgggactgtcactatcacccctgaagagaatgaggccattcaacggaccaaggttaaaaaaaagtttatgtcaagtatcaagtatgtaaggccaagcgtaaggcttagccttgctggatccattcccatccatattcatgatagaggatatatagagatagatttcttcaagcatttttttttctcatcccaagggctggctactaatgtttatacttttgacatgtcctgcttttaa

SEQ ID NO: 17559 - DNA, 1356 bp, Glycine max
  Peptide Sequence Number=SeqID_109244
atgggcctacttggaaaaagcttcacttcaaaattcaaaagcatcaccttgcttgctgtttctaggattgtcatcttgaagaaccagcacaaagctcgagcctcttatgctcgctctgatgttgctcaactcttgaaccttggttaccatgaccgtgctttacttcgtgtggagcaatggataatagaacaaaacatgttggaagtgtttgctatgatagaaagttattgtaatttcctgagagaaagagctgaggctcttgaaagaaacaaggagtgccttgttgagctcaaggaagcaacctctagccttgtctttgcatcttcaaggtgtggagaatttccagagctgcacaagataagagagatgttcacaacaaagtttgggaaagaatttgcagaccatgctgttgagttgcacaaaaataatagagtgaactccaaggtgctgattggttattacaaacatcttatgatacaaaagctttcacccagacgcccaaacatggaaatcaaaatgaaagcgctgaagcaaattgcttcagaaattggagttaatttgcgtttggagcaggaccctatattgatcaatgaggacaaattgagtgttgaccgaaagcaagatgaacctgaaaccagaaaaagtagggttgatggtcctagccataaagaaaatatccaaaataatccggcaaatacaatccaggatgaaaatttatctgataagaatgaagaaaggaagagatacatggatacagatgctagtgttgcagaaaaagccatagaatcaaaaccttcagggattgaagtcagtaaacaatcagatcatagagttgctcttggcaagatgcatgcgcatcctatagcaagctctagttctaaacaagagggtgaagtagcaccaaaaaacaaccatgctattgaactcaaaggattggaaaggagggaaattaaaaaacaatttgcatgggaagaatctcatttgagtcagaatccaagagatgatgtgataacatcaaggattgcggagttcatttccaaggaacacgtggaggaagaaaatagagagggccgcatggttggtgagttaggctcagccaagagcttccaaatggataacaatgatcacaatagtctgtctgagtctgatgcagctacagaaaatgaacacttcagtgaagaaagagtccacccttcttcccatgctacaagatggaattcacagaggtctcaatctgattccactctaaatcctatggcaagaaggcatgtgatggaaactagggatccaacacattttcagaagcagatacatacacgtgtggactggaaggtgatgtcagcgaggactagataa

SEQ ID NO: 17560 - DNA, 1812 bp, Glycine max
  Peptide Sequence Number=SeqID_109245
atgggaagcaatttacagtttgagcttgattctttgcatgggcaagctactgtcttggcagctttagtctctatttccccaaaattacctcttggttatccagcaaggcttcccggattagtgtttggggtttcaaagaaaatgctgacagaacatagtcgcaatccagtggcagccacagttgaaaaagaagctggatggttgcttttatcatcattatttgcttctttaccgaaggaggagcttgaagaggatgtctttgatattcttgccttatgggctagcctatttactgggaatccagaaaatgaaattacgaaaactgatgatctaaagtcaaggatattcgtatggtctgcagctgttcatgcactgacagcatttataaaatgtttcatatctcctaatgttgcaaatgatggagttctacttcaaccagttcttgtataccttagtagtgcattatcgtacatatcagcattaagagccaagggactgccacatgtaaagcctgcagtggatgtattcgttatcaaaactttaatagcttaccaatctcttcctgatcctgtgtcttttaaaaatgaccatcctcagattattcaactatgtacatttccgttcagacatgcttcagaatgcgaagaaagttcatgcttgaggttgctcttagacaagagagatgcatggttgggtccttggattcctggaagggattggtttgaagatgagcttcgagcttttcaaggaggaaaagatggccttatgccctgcgtatgggagaatgaaatttctagctttcctcagccggagacaataagcaagactttggtgaaccagatgcttctgttttttgggatcatatttgcttctcaggatagtggtggcatgctctcccttctgggcattattgagcagtgtctgaaagctgggaaaaaacaacattggcacaaagctagtcttaccaatatttgtgtgggcttacttgctgggtttaaggctttgctctcatttcgaccacaaacattaggacaagagattttgggtttggcacaatctatttttctgggtattttggcggagggagacatttgtgcatcgcagcgcagagcatcatctgaaagtcttggatatttagctcgatttggaaatgatatcttcactgctagaatggcatgttccttcaatctgactagatcactacttggtgacctaaatggtgcaactgatcccaactatgctggatcaattgctttggcacttggctgcattcatcgcagtgctggagggattgctttgtcaactttagtgcctgcaacagtgagctctatctcctcactggctaaaagttcggtagctaatctgcagatttggtctatgcatgggcttcttttaactattgaagctgctggcttgtcctttgtctctcatgtccaggcaaccctatctcttgctatggacattcttttatctgatgagaatggtttagtagacattcagcagggagttggccgccttataaatgctatagttactgttcttggtcctgagcttgccccaggaagcatctttttctcacgctccaagtctgccattgcggagattagcagctggcaagaaacttcaactatgctcgagagcgcacgcttcacacaacaacttgttctttttgctccccaagctgtttctgtacactcccatgtgcagactcttctgtctactttgtcatcaagacagccaactttacggcatcttgctgtgtctactctaaggcatctaattgagaaagatccagttggttccccatcttga

SEQ ID NO: 17561 - DNA, 1236 bp, Glycine max
  Peptide Sequence Number=SeqID_109246
atgaagctgatgatacttgttgatgatgctggcggactcattcctgcgctcaaccattccccatggaatggtttaacactagctgattatgtcatgccatttttcctatttattgttggtgtttcgcttgcactctcatacaagaaactgtcttgtggagttgatgcatctagaaaagcaagtttacgggctctaaaacttcttgcgttaggccttttccttcaaggtggaggttatttccatcgcgtgaatgatctgacatttggagtggatataaaacagataagatggatgggaatactacagagaattgcagtagcatatttggttgtcgcactgtgtgaaatttggctcaagagtgatgatactgttaattcaggaccatccctattaaggaagtatcgataccagtgggctgtggctttgattctttctttcctttatctttgcttgctatatggattgtacgttccagattgggtgtatcaaattcaaacagaaccttctgcagagccaaagacattttcagttaaatgtggagtaaggggtaacactggtccagcctgcaatgtggttggaatgattgatcgaatgatattgggtatacaacacctgtacaagagaccaatatatgcgcggatgcctgaatgcagtattaattctcccaactatggaccattacctcctgatgctcctgcttggtgtcaggccccttttgatcctgaaggactcctaagttcagtgatggctattgtcacctgcttgattgggttgcactatggacatattattgtccattttaaggaccacagagtgagaatcatatactggatgatcccaacctcttgtcttttagtttttggccttgcgttggacttatttgatattgacatggttcttcttgtaggaatgcatataaataaggttctctactcgctcagttacacatgtgtcactgctggtgctgcaggcgtcctctttgtcggaatatacttgatggttgatgtctgtggatgtcgtcgcatgactttggttatggaatggatgggcatgcatgcattaatgatttatatccttgctgcttgcaatgttttcccaattttccttcaaggattttattggggaagtcctcacaataacattgtaatttctttgtccctctcctactttgatatcataattttctattatgactttgaaagattatattctccacatgctgataatgtaatctga

SEQ ID NO: 17562 - DNA, 1878 bp, Glycine max
  Peptide Sequence Number=SeqID_109247
atgtcggattcttctcgggaggagaatgtttacatggcgaaattggcggagcaggccgagcgttacgaggagatggttgagttcatggagaaggtagcaaagactgtggaggttgaggagttgacggtggaggagagaaatcttctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattttgaacctccttgagtccaacctcatcccatccgccgcatctcccgagagtaaagtgttttaccttaaaatgaagggtgattaccacaggtaccttgccgagttcaagactggggcagagaggaaagaggcagcagagagtactttgcttgcttacaaatctgctcaggatattgctcttgctgacttggcccccactcaccccattaggctgggacttgctctcaacttttctgtcttctattatgaaatccttaactcgccagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacgatgctggagatgagatcaaggaaacatctaagcaacaaccagagcttggtgccaggattaaggaacctccatcggtccctggcttcatgaagcctcagactgcgcagggcattttagtcaatttcaaggatttgtattattacaatgctaacaagcttccttttgctgctgcacagattggacaggcggggacacgtagaactgcacccgtcaggggagcagctgtcactacggtggaggtgctcgccgacacggaggacctagagttcacattggcggagagtgagcactttgttgaccctcaagataagtctcatcccaaggaggagcaaatgtcgggtcagtctgccaagaggattcctcttcgtgatgctgtttccaagaatgtatcatgtctttgtatagacaagtaccgactgaggtttaggcaacatcttgctaatgagatggtcactatgctgctgactgttgggatgcagagattgagtgctcctttggataaaagtggtgttctacaagtggctcgtgaaaaattttcagaacctaaggaagtggaggggaatccgaggatggtggttgaagcacatgaggtggagtttcaagtgtgtacacttgggaaagttgtgactattaagaagaatatggtgaccattcaaaagaagaaaaatatagagcacgagcgagtttttacacggtctgtgattgaatcatcatttggaattggaaggataatttattgcctctttgagcacacattctacacgaggcaaagtaaagctggggatcaacagttaaatgtatttcgcttctcttcacttgtagctcctatcaaatgtacagttttcccgctggttcagaatcagaagtatgaagaggttgcgaaactcacttccaagtcattgactgctgctggaatttcgcacaagattgacacttcaactataacagatgaacttgacgtgccctttgctatcactgtagattcaacatcatcagtgactattcgggagagggacagcaagggtcaagtgcgtgttgatgtggataaagctgcctctgttgttagggaggtgactgaaggccagaggacatgggaagatgtgtggtcaacttctcctcatcattcctctacatctgcatctgcagatgattga

SEQ ID NO: 17563 - DNA, 138 bp, Glycine max
  Peptide Sequence Number=SeqID_109248
atgcagcttgagtggaatctggtgttccaacacacattcagagaagctaatcagattgcagattaccttgctgggaaattaatggctcgtctgaagatcttcagtttggcagttgaagtacatggccgctactggtaa

SEQ ID NO: 17564 - DNA, 477 bp, Glycine max
  Peptide Sequence Number=SeqID_109249
atggatttgccatggatatcaactggtgtagatcctgctgtgtacccacgaccaaaggccatccttctatcctcagactcaatgaagtatatggctagcttctttctacgcagtgaatttcctggtgtcccctgttgggagccttctgctggtgacttgatttcggagctatccatcactcttaacacacaaccactagctactggttttcctcaatctctatcttcagttcagattaacaactctcaaaacatggaaagggaaggttcaactaccacgttgaaacaagccatgtacaataaatggcagtacaacactacacaacatcattggaagccattgaagagagtgcatttatggtcacctgcagtggaggctggcaccattgctgtcattgattggtgcctgcatcatgaaaatgtggatgcacataattttccatctgaattggaaggtggggattggacagttgcttga

SEQ ID NO: 17565 - DNA, 630 bp, Glycine max
  Peptide Sequence Number=SeqID_109250
atgaaagtagcagtttacgaaaaatccttacctgggggactgggaggatcacgaatgcgtcgaaccagaatcccttcaacgatcgcagccacacgtgcaagaggtgcacggcgtccacgcacgtgcgcgccaccgtcaccatcgccgccagccctccgtccatgtacaagcacggcgacccctcccttcctatcgacagcgagtagaagaacagcgggtctatcgccagcgccaccccacgcgccaggagcagcgcgcggttccacctctgcacgcgcttgcttctcggatccagaacccgcccgaacggcccccgacttgatccggacacggtccgaaagccgaggaccttgttgggtcggctctggatgggaaccagagacgacccagccgaagcctcccactgcaactggtggaaggcactgtcgcagctgtgcattagatgagataacgtaccgaaggagagaggagaaggtgttgtgcatggttggagatatcggagagaaaccattagcatggggaagaagggtggggattggagcttacggttacgcaacgttgagggaagggtggtggggttgctactctctactcaaccctgctgtttgctctttgccgttttctgtataa

SEQ ID NO: 17566 - DNA, 1443 bp, Glycine max
  Peptide Sequence Number=SeqID_109251
atggccgccgtagcatcatcgccaacgccacttgggtctcgatccaaggctcaacaagaaccatccaaaaacatcgagaatttcgaccccaacaaacaacaacaaagcccggtttcgaaaccctcttgttcctctccttcttcttcgcctctcgtgaaatcaaagaatcctaataaagtcgactatttctcccctaagaacaagatccggcagagaaagttcttggtggcaaagaagaagaaagagaaaaaggcagaagaagagggttcaggtgctgctgctgactcttgcaagtgcaaagcaagtggtgcaaatgcaaacgagaacaacaagtgtgtgtgtgtggcttacaacaacctaaggaagtcccaggaagagtttttcaagaacaatgatgatggtgttgttgatgatggtgaagaagagggttttgagagtgtggttgttgaagaagaaaaaggagaatcgttattggggaatggtgaagtgagtggtttggttgtgaagcgtaggagggagaggttgatggaagaggcgaggaagagtgttcttcctcaaagtgggtctgggaaagttatgcatttggtgaaggcatttgagaagcttctctctattcccaaaaccaaggaggaagaagatgaggagggatctcaagatcaagagagggtagggaaatgggcactgccagggttgcagcagcaacaagtttctgagatttcattttgcccaccaaactgtgtcctcacatcgcaaaaccttggcttggatccgggggcatcggtttcctcttcctgggatagcagccgtgcaagcgtctctagcaggacttctactgggggtcgaagaagcaggaaaaatagcctggaatcatcaagtacttttgggagaagaaggttgaaaaagaagcagcagaaagtcactagccaaaagccattcaagctaagaactgagcaacggggcaagttaaaagaagaagaatttgtaaagaagatacaagagatggcagcagtagaagagaagcaaaggatacctgttgcacagggtcttccttggacaacagatgaaccagagtgcttggttaaacctccagtgaaagaaatcacaaggcctgttgacctgaagcttcacagtgatgtgcgggcattagatcgcgctgagtttgaccatcaggtgcaagaaaagttgagcttaatagagcaatacaaactggaaagggagagacaacagaagttggcagaagaagaagaactaagaaggttgaggaaggaactcgtaccaaaagcacaacccatgccatattttgatagaccttttattccaaggaggtcaatgaagagtccaactatacctagagaacccaagttttataatcataagaagatcaagtgcagcttatcatcatggaacgatataagcccctactcctcctcctgccttaattaa

SEQ ID NO: 17567 - DNA, 1125 bp, Glycine max
  Peptide Sequence Number=SeqID_109252
atgagttacccacactttcttgttatgccttatccaattctaggacacatgaatccacttctgcagttctctcaggttttggccaaccatggctgcaaaataacctttttgatcactgagttcaaccaaaagagaatgaagagtgaaattgaccacttgggagcacagataaagtttgtgacactcccagatggtttggatccagaagatgacagaagtgaccaaccgaaggtgattttgtcactcagaaacaccatgcctactaagcttcacaggctcatacaagacatcaataataataataatgctttggatggtgacaacaacaagatcacttgtctggttgtttctaagaacataggatgggccttggaagttgcacacaaattgggaatcaaaggggctcttctgtggcctgcttccgctacttcgctggcctcttttgagtccataccaaggctcattgatgaaggaattatagactctgaaactggacttcctaccagaaaacaggagattcagcttttaccaaattcgcctatgatggacacggcaaatctaccatggtgtagccttggtaagaactttttccttcacatggtagaagatactcaaagtttgaagttaggagaatggtggctttgcaacaccacttgtgatcttgagccaggagcacttgccatgtggccaaggttcctttcaattggcccattgatgcaaagtgacaccaacaaaagctcattctggagagaagacacaacttgcctacattggttggatcaacatccaccccaatctgttgtgtatgtttcttttggaagtttggcaatagtggaaccaaaccaattcaatgaattagctattgggcttgatctccttaacaagccttttctttgggttgtacgtccaagtaatgagaataacaaggttggactgggattagaccaggatgagaatggattaataatgaagggagagataaggaagaaggtggagcaactgcttgggaacgaagatataaaagcaagatcagtgaagctgaaggaattgaccgtgaataactttgacgaaggtggtcaatcttcacagaatatcgaaaagtttatcaattgggccaaggattaa

SEQ ID NO: 17568 - DNA, 2007 bp, Glycine max
  Peptide Sequence Number=SeqID_109253
atgacagaggatagcatcgttagggtttcttcttccaacgaaacctccgcggccaacgaggcttcgcagacgcggcagagaaagaagagaaagtgggatcaaccggcggagtcattgatgccagttgggatgacagtccctggagcactccctttgagcaatgccgtgactcttggaggggttgcatttcccgccatggctccggtgatctccggcactcttttgacaaatcctctggcagcttctgctcagcttccgcaacatgcagctgcagctgctgttgccgcgcaaaagttgaatcaacataagatccaagatgaattaataattgctcgagaaattgtcataaatgatgcagagtcttctgttcgctacaagttgacaaaacgccaaacacaagaggagatccagaggtgcactggtgccatagttataactaggggaaagtatcggctgcctaatgcaccacatgatggagagaagccactgtaccttcacatctctgcaggagctcatataaaagagacagcagaacggattttagctgttgatcgtgctgctgcaatgattgaagaaattctcaaacaggtgcaaaattcacagtcaatttcttccgtcacaccttccgctttggttaatggagtgaagatgctgagtacatgcgtgtttttgggctttgatgctgatccttcattgaacattgttgctcgtatacgtggaccaaatgatcagtatataaatcacattatgaatgaaacaggagcgacagttgtactgagaggacgtggttcaggaaacaatgaatgcttgaatggagaagatggacagcagcccctgcatctgtttttgtctagtaacaatgcgaaaagtcttgaagatgctaagcttttggctgaaaatcttttggatacaatctgtacggagtgtggtgcttcaagtgctgttccacctccacagcaggcatacactgctgttccacctccccagcaggtatatagcgctgttccaccaccccagcaggtttatagtggcccttctttgttgaagcagattcctgctgccatttcacccccacaagtttatagtgctgttccacccccacagcagttgttgactggagttcagagttctggaattgacctagaggcaggtgccagcctaatcactagttcaatgtcagcagctggggtcttgacaccggttcctccagcttccttggttggagtgactggtgtcactggtgccctcactttggggactacaccccaatctataagacatttaagctctgggcctcaagcaaacatgactggttatactcctccccctttagtatcaggtggtactagctatattggatatggcggattatatcctcaagctacccctttgcaacaagttgcccttgccttgagacactcacctcctgttgcatcaacagttgctcccacaacatcagcatcaaacagaggatccaagtcaaccttaagctctgatcttgaaaaggagaaacggccgcctcagagacgaaagtttcaagaattgccagttggttcaaaagacacaacaaaactcaatcaggtttgtggtatggttaatgtctccaaattgactgatttgatagcaatgaatctccccactggtgggatggaaagattgcaacctctaaaaactaatgaacaatctgatggtccggttgtgaggaatatatcaacaatgcctgcccctaagaagttggttcagccatcatccaatggaatgccaccacctctactaagaaccatgcccccaccaccacctccacctaaattttgtggtccatctgaagttaaagtacaggccaagaacaagactttgcttaagacaaaatctgatgcagttcctgatactttggtcaagctaatggaatatggagaggaggatgatgatgatattgattctagtgaggaatcacttcctcatgacgccggagcaactggggttcaaaagcctttctgggctttatga

SEQ ID NO: 17569 - DNA, 1080 bp, Glycine max
  Peptide Sequence Number=SeqID_109254
atggcttcaaataatggccgtaaagcaagtgagatctttcaaggtcaacttctcttatacagacacatgtatgctcatgtagattctatgtttcttaaatgtatcgttgagcttggaataccaaacataatccacaaccatggtcaacccattactcttccaaaattggtgtcaattctacaagttccaccaaataaagttagtggcttgcagagtctcatgcgttatctagcacacaatggattctttgagatagtcacaatccatgacaacttggaagaaaaggaagcatatgctctcactgctgcatcagagcttcttgtcaaaggcagtgacctttgtttagcaccaatagttgagtgttttcttgacccaactttttcaagttcatggcatcaaatgaagaagtggatttgtgaggatgatctcacactctttggtatctcattagggtcacacttgtgggactttctcaataaaagccctacacataacaaatcattcaatgaggcaatggctagtgattctcagatgatgaacttggcgttgagagattgcaattgggtctttgaaggactggagaccattgtggatgttggtggtggaactggaatcacagccaagattatctgtgaggcatttcctaagttgaaatgcatagtgttggaacgtccacatgttgtagatcagaacttgtcaggatgcaacaatttgaaatatgtagttggggacatgtttaaatctattcccaaggctgatgcagttctacttaagtggatcttacataattggaatgacaacgattgcagaaagatattagaaaattgtaaagaagctattatttcgagtaaatgcaaaagaggaaaagtaattgtcatagatgttgtgataaacgaaaatcaagatgagcatgaagttactagactaaagctccttatgaatgtacacatggcgtgtcttattaatggaaaagagagaagtgaagaagaatggaagaaacttttcgtggaagcaggattccagggctacaaaatatctcctttgacaggacatttgtctcttattgagatctatccttaa

SEQ ID NO: 17570 - DNA, 936 bp, Glycine max
  Peptide Sequence Number=SeqID_109255
atggagcacgcgacacgtggcacagcgcggcgcacgaggcagcagcagggtagcgcccctgacacgggcgcgtctggtagcgccctgccgctgggcgcgactgatagtgccctgccgctgggcgcgactggggcactaccagtcgcgcccacgcgctggacactaccagtcgcgcccagcagcagggcgctaccagacgcgcccgcgtcaggggcgctaccctgctgctgtctcgtgcgccgcgctgtgccacgtgtcgcgtgctccatggaagcgccttcctggggggcgctttgtaataaaaaaacagaccccccagtcttcaacgttgtaccaacttccgaatcagaagagtttcagttaccaactcaaacatcgctttccctcaccttcttcgacatcctatggttaaggttaccacctgttcaacgcgtcttcttctatgaattccctcacccaacccatctcttctttgatacccttcttcccaaactcaaacactctctttctcttgcacttgcccactttttccctcttgcgggccacctcacttggccacttcactcccaaaaacccatcatcaattacaaatctggtgacactgttcccctcacagttgctgtatctgaagctgatttcaaccacctagcaggcacagatctttatgaagccaaagaaattccccatcttttaccccacttgaccatatcccacgaaaaagccacgcttttggccctgcaagctaccctctttccaaactctggattttccattggaataacctcacaccatgctgttctagatggcaagacttcaacatcgtttatcaaatcctgggcttatctttgtagagaatcacaatcacccacttctttaccacctgaactgattcctttttatgacagggaagtaatcaaagaccctaaccatttaggg

SEQ ID NO: 17571 - DNA, 861 bp, Glycine max
  Peptide Sequence Number=SeqID_109256
atgaaggtggtagaagtttttagtgtagcaccaacttcggaatctcaagaagaatcacaatcacagtcactcccttttttgccacctgaactgtgtcctttctatgaaaggaaattagtcaaagaccccaatcaagtaggggcaaaattcgtcaacgattggttaaaggaaggaggaaccaacaacagaagcctcatggtttgtgatctgaaacccccagaagatgcaaccagaggctcatttcaattgtctcgttcagatgttgaaaagctgaagcaaagtgtggtgttcaagaagaaagggagcaccaaccttcacttgtcaacgtttgtgttatctcttgcctgtgcatgggtttgcagggtgagagcagaggaaattaccaacaaaagtgttgcgttggctctaactgttgattgcaggggtcgtttggagccacctcttccttcaacatattttgggaactgtgttggattcagacttccaattgctgaaacgagagatttgttgggggaagaaggactagttgtggctgtggaagcagtgagtgatgcattggaaactctgaaggatggagcagtgagtggagcagaaaattggtcatcgtggttgctttatggtgtgggagctgaagctgatgtgaagacaattggtgttgctgggtcaccgaggtttgaggtttatggtagtgactttggttggggaagaccaaagaaggtggagatggtgtctattgaaaaaactgcagtctttggtctttcagatagcagaaatggagatggaattgagataggttttgtgtccaagaaaaaaacaatggagacctttgcttctctttttgtcaatggccttcaatcttga

SEQ ID NO: 17572 - DNA, 423 bp, Glycine max
  Peptide Sequence Number=SeqID_109257
atggcatttctttttctggaacagtttcttactccattttcaaaaagctttcttctcgttttccactttttcctgtggcattgtctctggttcgtgggggtagcaaggttgagtgcagcggtaaaggtgaagttgggatcctctagacgacctgcaggcgtgaagctttcggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 17573 - DNA, 153 bp, Glycine max
  Peptide Sequence Number=SeqID_109258
atggcgtttgtgcgtcgcggacgtacggatggcttccggatcaagttgatccgtaagctttttacggatcaacttgatccgtgtttgagtgccgagaggatgttttgcggtgggctcgatccttggctcatgaaaacggatttgtggtggtga

SEQ ID NO: 17574 - DNA, 456 bp, Glycine max
  Peptide Sequence Number=SeqID_109259
atgttatttatagtcccgttgaactcttcagcatcaactgtggctctaacagtagcttgtccactcactcgtttctctcactcccaactcacttactctttccctgtctccactggcccaaagtttcttcgcctcttcttctactcaacttcctaccaaaacttccatcgctccaaagcctatttctcagtcaaagcaggcccatacaccctccttcaggatttcaacgcttccctccatgctgacgctggtaacgaccctggcgactacttgttcagggagtattgcaccaacctcaaagatggcgatcggctcaacataaccttcattgcaagcaaaacatctcagaatccagattcgtacgctttcatcaatggaatagagattgtttcaatgcccccttttactacaccaatcctgacgacgtcgacatcactggattgcctcaactcgttg

SEQ ID NO: 17575 - DNA, 312 bp, Glycine max
  Peptide Sequence Number=SeqID_109260
atgaacgacgacgttagggtgctggagtttgttctgcagcttcaggatagtgttgttagcggagtggttgcggagagtggtgggaataattctgaagatagtgatgacatgtttagcattagccaaacattagccaaagtagtgaacatgtttctgattatagtaagagcactggatatattgagcatgacaagcgatggagatcggagcttgttttctctgagattaacgatccaaaggggagatgaggttggaagactatgctctttaaaagttcagcctgagtttgttgagaaaaagtgtgctctttaa

SEQ ID NO: 17576 - DNA, 555 bp, Glycine max
  Peptide Sequence Number=SeqID_109261
atgttgtcattgttcacgagcccaaaggcaaacccgagttcaagaggcatgttagttagtcttagccgagctcattatattgatgttgtcaaagtagcaatacgaggagaagtagtggaagatccggtcgaagagcttcacaaaggtgaaacagagctcggtttgctaaaaaaatcccaagttttatggcagaagaagcagatagcagctcagtgtttgaaaaaatatggtgaggttgcgctgagttgtttgcatgaggatgggactcagaggcctcccatgaacgacgtcgttagggtgctggagtttgttctgcagcttcaggatagtgttgttagtggagtggctgtggagagtggcgggaataattatgaagatataagagcactagatatattgagcatgacaagcgatggagatcgtagctttgtgagtaaggaatctgacaagttggtccctgaagagcttgttttctctgagattaacgatccaaaggggagatgtgaggttggaagactatgctctttaaaagttcagcctgagtttgttgagtaa

SEQ ID NO: 17577 - DNA, 702 bp, Glycine max
  Peptide Sequence Number=SeqID_109262
atgagaagccttctagagctcactactcaagatgccactttggcacaaaacaagttgttgtcccaacaaatagaagccctaacagagaccctcaacaagctccctcaacaactacaagtagtaagtccttcttactcttcaatcgtgcaagtagggggatgccacatctgtggtggtactcatgagtcaggctcatgcatggtccaagacgacgcatccaatgaagttaactacatggatcgtcataatcatcaaggattccaccaaggaggaccaccaggattctatcaaagagatgattttttgcaggaccactattggatatcttatccaggaaataacttccaccaaggggattcaccttatcagcctcctagccaagagccaaatcatcaagagaaacctactaaactggaagagttgctaatacagatcatgcaaaagaccgaatcacatatgaaaagcactgatgcaacaatcagaaatctggaggtacaactagctaagctagtttctgaaaagcccactgaaacctttggggtcaatactgagatgaagtccaaagaagagtgcaaagtaattttcactgggagagtagagaaggacaataaaatcgaggaggatgtgcatgatgaggaaggagaaaaggaggaagagaaagaaaaaagtgaagagaaagcacaacaatgggagaagtactaa

SEQ ID NO: 17578 - DNA, 1437 bp, Glycine max
  Peptide Sequence Number=SeqID_109263
atggacacaactggcacccatattgcttcaggggccatcttcttccttctgttgctgtgcctctctaatctttccatagcagatgttatttatagtcccgttgaactcttcagcatcaactgtggctctaacagtagcttgtccactcgcgatggtcgcaattggactgcagacatcaaattcctctcagaaaacaaggactcagttgctgctcctgcactcacaccatctatcctagagggtccttacaccgatgctcgtttctctcactcccaattcacttactccttccctgtttccacaggcccaaagtttcttcgcctcttcttctactcaacttcctaccaaaacttccatcgctccaaagcctatttctcagtcaaagcaggcccatacaccctccttcaatacttcaatgcttccctcaatgctgatgctgatgatgacccggacaacttcttattcagagagtattgcatcaacctccgagatggtgagaggctcaacataagcttcattccaagcaccgaagattcgtacgctttcatcaatggaatagagattgtttcaatgcccccttttctctattacaccaatcctgatgacgacttgcctcaactcgttggcctcaatatgaacccgttccccattgaaaacaactatgctatggagacaaagtatcggttaagagttggagaccaagaaatcccggcctcacaggacacgggtatgctcaggagctgggatgtggataacaaatatgtaacaactcaaaatgtactatctctagatattgactctggaattaagctgagattcacaaagactcctaactacacggcaccagacacagtgtaccgatccctaaggaatatgggaagtaatggcaccgtcaacatggggttcaacctcacatggcaacttcccgttgattcaggcttcacctacttgctaagattacacttttgccagcttgacccgaatattagccatcctggtgaccagagcttcttcatctacgttcaggatcagttggttgaaaagtgggcaggcattctcggttggagcgataaacagaagggtgtcccagtggttaaacagtatgtagttttaatcccagggaatgagcaggaaacgcttaatctttcactgaaaatgcatcctaaccctcaaagcttggccaaggacgctcaaataaacgcaattgaactcttcaagatcaacgacccaacaggtaatctcgctggacctaatccagaccctcttccacaatctccaaagcgggttccacttgaaagctcaaataagaaaagccatggcaccaccatgagaactcttgctgccattgcaggggatcatactcttgtatttggagtgccaaatgaaataaaatcttcttcttcttccgacaaagtggtatcagagcttgagttctag

SEQ ID NO: 17579 - DNA, 684 bp, Glycine max
  Peptide Sequence Number=SeqID_109264
atgcctgaaatggtgaactatttatgtatgaggttgtcattgggattaccagtgaattgtaacattgaaaggtgtcatattggtcacttttactatgattctatcatagtaacattgaaaggtatcatattggtaaacaactggtcctggaaacataccattaattgtgacaatgttgaagctgatattgtgaaaagagctcttagttaccctttgaaattaattgctaagaatgctcgtgtcaatgatagtgttgtcagtgagaaggtattgtccagtgacaatccaggatatggatataatgctgccactggtaaatatgaagatctgatgtctgctgggatcattgatccaacaaaggtgagagcaactgttgcagagcttcaaaatgttgttcgtgtatttagtcagttgtgtgctgcttccaacctacatattcacgggtttcatcaaaagaatgttggatactgcaattcgataatcatattggcatccatttcagctccacctgcacataaaggttattcaacatttaatattggtgcggtcgtaagcaccgatgttaaaacatgcatttctacatcgatggtcaacatagcacatagcattgatgtaaaaaattcaacattcaacaacgggcatgcattagcaacgttgtcgttggcacattttctaagtcgttga

SEQ ID NO: 17580 - DNA, 535 bp, Glycine max
  Peptide Sequence Number=SeqID_109265
cggtaggaagcacacaagttcatctcagagaaagtatccaagagtaatagaagagttatgccatccattttctctcgccgatctaaggaaaatgaccaacaactttaatcaaaacagagtagttgtagatgcattctctgaagaactatacaaaggttgtctccaacatagtgatgcttctgaatacacagtcacagtgagcactgtcatggaagaaaaggttagagatttgcatagaagaagcgtggactacactaccctcacgctggagccaagcgcgccatcattcgccgtcacatctgtcttacaaacattgattcttttattttgtgagatgcctgttgaggagaatattcatcccagaatcaaaggaaagattgcaccagagtgttgggaagtctttataaatatcacccaaagatgcatgatgtatgaaccagatgaaagaccaacaatgggtgaagtagagcatgttccttcatttcaccaagaagatatcacagaagacagtgacttagaaaacgtgcttccttag

SEQ ID NO: 17581 - DNA, 975 bp, Glycine max
  Peptide Sequence Number=SeqID_109266
atggctgacacagtgacagtgaaagtgatagaacagtgtgaagtgagccctccaccagatacggttccttcaacctttttccctctcactttcttcgatcttccatggctatgttgccctccactcaaacgtattttcttctaccacttcccttattcctcccaacacttcctccaaacttttcttccaactctcaaacactctctttccctcactctccaacacttcttccctttctcttccaaccttgtcttccttccaaagccaaacccccctcacatcctcttcacacaaacagattctaattctatctccttcaccgtagcagaatccactgcagatttcaccacacttgtctctgactccacctcacacgtggctgtggatggaagagcttttcatcacttcatgaaattctgggcatctatttgcaagttcaaaggagaattgggtttggtttcccttgaaggctctcttcctctgccgttgtacaatagggacatcattcaagacccaaaaggccttaagctctccaagggggaaatacgtgatgttgctagtgacacggtgcgtcgcacgtttgttttgagtcatgaccatgttgagaaactcaagaaatgggtgaaatcagaagaggctgaagttggtaccatagttcccactaatgagagtcctacatcttggcctttattcaagaggagcaagcttgttggagaaaatggtgttgtggaggcagccattgctattggtagtgaaggctcaccgaagcttcaagtgtatgaaacagactttgggtggggaaaacccaagaggagtgaagtagttcatgtggataattcaggaacaatctccctttctgactgtagagacaaagaaggtcgaattgaagttgggatagcacttcaaaagactcaaatgaatagatttattaccattttggaagagcaccttacaaaaattgcagttcttgactga

SEQ ID NO: 17582 - DNA, 627 bp, Glycine max
  Peptide Sequence Number=SeqID_109267
atggggagccttattttcatttttcagaataatagtgtcaaatatctgcctggccatggtcctgttgttcctcaagaatgcaattattgtgggaagaaattcaatatgggtggacctatatggtctgctcctatccaggatcaagaatgggtgacttctatactagcagacgtgaaatctatgaaagaaagttgttctgatattttcttttcaggaattgccacactgtttctgagtctgcataatctctgtgcaacacttaaatgcacttctccatcagcaataattttccgttcggccgtgattaatgcaggctatcatatatctggaactcatgttaatccacaaggactgaaatcagatgcacccatggatgttatttgggatataatgcgctgctgggtaaaagatcatcctgtgaaagctcaaccagcagatcaaccaggaagtgttatatttgcaaaggaacctgttcttcgggctaattttgctcgagctgtatcgactcttagcaaggcacaagctaagaaggttgcacgctttcttccaaatcctgaaaggtactggggtcctaaacttagggcaggacgtcaaattaatagcaagcgtgtctctgtattgggttaa

SEQ ID NO: 17583 - DNA, 1290 bp, Glycine max
  Peptide Sequence Number=SeqID_109268
atgtcagaaaaactttcgtacttgaatgagcctttgctacacgagtgggagcatcgtgagttcgggcatgccacagatgaggagaaagtcatagcctcacatccttctacggaaaatactgcatccttctttggcacctgccttaatggactcaatgcaatatcaggtgttggcatactctcagttccatatgctcttgcatctgggggctggttaagcttggttcttctgtttgctattgccactacagcgttttacacaggcatgttgattaaaagatgcatggataagtattcgaacattagaacctaccctgatataggtgaacttgcatttggaaagacaggaaggttaatagtatcagtgtccatgtacaccgagctctacttagtttcaatagggttcttgattcttgaaggagataacttgagtaacttattccccattggagaggttcagatagctggcttagcaattggtgggaagcaattctttgtgatattggtttctcttatcatcttgcccacagtttggttggataacttaagtctactttcttatgtatccgcaagtggagtgtttgcttctgctttcatcatcctctctatttcatggactgcaacattcgatggagttggttttcatcaaaagggaacttctgttaattggaatggaatccccacagctgttagcttatatgccttttgttattgtgcacatcctgtctttcctaccttgtacaattccatgacaaacaaacaccagttctctaatgtcctacttctatgctttctcttaaccactgtgggttatgcatccatggctataattggttatctaatgtttggtgctgacgttgaatcacaaataacattaaacctgccactgaacaaagtaagctcaaaattagcaatatatattaccttggtcaatcccatatccaagtatgctttgatggcaactccaattaccaatgctttgaaagacttgcttccaagtacatacaagaatagagtgaccaacatcttagtgagcactgtcatggtaattggtactaccattgttgcccttgttgttcctttctatggctatctcatgtccctggttggagcgtttctaagtgtcacggcctctattttgcttccatgcttctgctacttgaagatttcaggcagttacaggagatttgagtgtgagacagtaatcatagtaataataataataccagctatagtaatgggaatatcagggagctacaactctgtcatggaaatagtccaccaattgtaa

SEQ ID NO: 17584 - DNA, 759 bp, Glycine max
  Peptide Sequence Number=SeqID_109269
atggcttatttccatagctcaatctccctctgcaactcctccgttgaccaatacatggcgaattccctcgatttcgagccgaaatcgaggcacaggaaaacccccaattccctccagtctccgccgtgtcggcgatcccggtcggcggtggttgacgttgtgatttttgcagcagttatcgcggcttttgggttcttgttgttcccctatgctcaaattttggctagtgagagtgtcaaatttggaattttgattgtgaatttggtcaaagaggaggtttcttttaccccttggatttatatgttcataggtgttagtgttacctttgcagcattgactacttgggttcttgtggcttgcacaataaggaagtgtgggaaccccaattgcaagggtctcaggaaggctgcaacgtttgacattcagttggagactgaggattgtgtgaagaattcaccttcattaactaaggatggtggagttaagaagggactgtttaaggttttttgtgatcatcaccgcgaactcgaggccgagcttaagaagatggcaccccccaatggaagggctgttcttgtcctcagaggaaggtgtggctgttctgttgttttcagtttttgtgataagtgggcgcccatgattaaagttaccaatcttttggtagagtacaggctggctctgctagaagaggttgcctgtgatgtgaaccatggagtggattgctcaattaccaaaaatcttttacacagttgtctgtaa

SEQ ID NO: 17585 - DNA, 2025 bp, Glycine max
  Peptide Sequence Number=SeqID_109270
atgcagactcgttccaaatctcactttctcacattcttcactatgaagaatagtagccttcattctcttcctccttctttattcaccacaattgttgttgccaatggagattgcactttcccttcacaaatcccaaacccctcttctgggctgaaacccaaaccaaagaaagttgagtatagtgaaagacaagtggcagttttggatgatacccagatcaggcaaacttcctcttctgggctctgtattcagatagagaagttggttgtgtgtaataggtatagggaggcaatgaagttgtttgaaatattggaacttgaacatgatggttttgatgttggtggtagcacttatgatgctttggtgagtgcttgtgttggtttgagatcgattagaggtgtcaagagggtgttcaattacatgattagtagtgggtttgagcctgatttgtatttgatgaacagggtcttgtttatgcatgtgaaatgtggcctcatgcttgatgcgcgcaagctgtttgatgagatgccggacttagttcaggtgggaaggcaaattcattcttgtgctttgaaaagaggggtcggcgatgatactttcgtgtcttgtgcgctgattgacatgtacagcaagtgtggtagcatcgaagatgctcattgtgtctctgatcaaatgtcagaaaagaccaccgtgggatggaattccattattgctagctatgcacttcatggttatagtgaggaagctcttagtttatattatgaaatgcgtgatagtggtgcagcaatagatcattttactatttcgatagtgataaggatttgtgcaagattggcatcattagaatatgcaaaacaagctcacgctgctttagttagtcatggatatggccaatgctcttcgttatgcgaaggtatgggggagggatgttgtacgcagccttacccttgcatatgcaaagaggctgtttccggattcaaacccatgaccaacaagtcaccaaggcacaactttaccgctgcaccagggctcgccctcaaacatttcaataatataataaacaaatggggtaggatggaagatgcccggcatgttttcaactgggtgcgctgcaagaatgttatatcttggagtgcattgattgccggatatggtaatcacggtcaaggagaagaggctgtagaaatgtttgagcagatgcttcaagaagggatgattcctaaccatgtcactttccttgctgtcttatctgcttgcagctattcaggattatcagaacgaggcttattagatgaggcttatgaaccgattagaagtgctcctttcaaaccaacaacaaacatgtcggcagcattgctgacagcgtgcagaatgcattataatttggagctgggaaaggtagcagctgaaaatctttacggaatggagcctgaaaagctgtgtaattatatagtgcttctgaatctatacaacagttctggcaaattgaaggaagctgctggtgttttacagaccttaaagaggaagggtttaagaatgcttccagcgtgtacctggattgaagtcaagaaacagccacatgccttcctatgtggagataaatctcactcccaaagaaaggagatatatgaaaaagtggacaacctgatggttgagatatctaggcatggttatgttgaggagaatgaaactttgcttcctgatgtcgatgaagaggaacagcgcattctcaaataccatagtgaaaaattggatatagcttttggacttatcaacactccacattggacacctttgcaaattactcagggccatcgtgtgtgtggtgattgccatagtgcaattaagcttatagcaatggttacaagacgggaaattgttgtaagagatgctagtaaatttcaccattttagaaacggtagttgttcttgtagcgattattggtgtgacaaagtgtcattcaagttgcagtcctttatactgagtagcttgttgttaactcaccttagcctcacatttgattag

SEQ ID NO: 17586 - DNA, 624 bp, Glycine max
  Peptide Sequence Number=SeqID_109271
atgagcatgcgagataaaaacaaaaaagataataggaaagaaaacacctgctgttataaaaaggaaaagaagatatgcataggagccgcgcgcggactacactaccttcacgctggagccaagcgcaccatcattcatcctcacatcaaacccagcaacattcttttggatgataacatggagccaaaactcgcaggtttcgaccttagcatacagggagcacattttatgtcaaagccaaaactaattcaagtgcctgctgcgggtacttatggctacttagctatggaggtttggacagataataccgtcacagaagttgtgtgtggaaggaagtacttaatggagccaattgaaacggaatttctggaaaaacctcttgaggagaaaattgatgaaattatcaaaggaagtatcggaccagagtgttggcaagtctttgtagatatcaccctcagatgtgtgaagttggaaccagatgagcgaccaacaatgggtgaagtagaggtggaacttgagtttgctctgtccttgcaaaaacaagcagatagagcaagatattccttattttccaccaccattattcccccccctttctccttattccggcttcctgggacctga

SEQ ID NO: 17587 - DNA, 609 bp, Glycine max
  Peptide Sequence Number=SeqID_109272
atgactgttcttcctttctttgtctaccttcaaatcagcatgctcaaaacacttgaaaggtaccagaaatgcagctatggtgctgtggaagttagcaaacctgccaaagagctcgagcagagcagctaccgtgaatacttgaagctgaaagcaagatttgaatcacttcaaaggacccaaagaaaccttttaggggaagacttaggcccactgaatatcaaagaacttgagcatcttgaacggcaattggattcatctctaaagcaagtgaggtccacaaagacacaattcatgctggaccagttatctgatcttcaaaccaaggagcagatgttagtagaagcaaacagatccttgacagtgaagctggaagaaatcaattcaagaaaccactacaggcaatcatgggaagctggtgatcaaagtatgccatatggtggtggtggtccagagaattctcactctcattctcactctcagggcttcttccaaccattggaatgcaaccctacactacatattgggtacaatgctgtagcttcagatcagataactgccacaactcaacctcaacaagtgagtggctttattccagggtggatgctttga

SEQ ID NO: 17588 - DNA, 1482 bp, Glycine max
  Peptide Sequence Number=SeqID_109273
atggacccaacggtccttagccacctccactttgttttcatccctttaatggccccaggtcatcttctccctatggtagacatggccaaattgttggcacgacacaaagtgaaagtgagcatagtgaccacacccctcaattgcatccaattccaagctagcatagacagagagattcaatctggctcacccatccaaattctacatgttcaatttccttgcgcggaggctggactaccagagggatgtgagagcctagacactctgccttcaatggatctgctaaacaacttcaacatggctttagacttgttgcagcagccactagaagagctacttgaaaagcaaagaccctacccaagttgcataattgccgacaaatatatcatgtgtgtgactgatgttgccaacaagttgaatgtcccgagaataatattcgacgggactaattgtttctttctactatgcaaccacaatttacaaaaggataaggtctatgaagctgtgtctggtgaagagaaatttcttgtccccggaatgccccacagaattgaattgcgaagatctcaactccccggattattcaatcctggcgcagacctcaagctgaatgcttaccgtgagaaggtaatggaagctgcagaaaaagcacatgggatagttgttaatagttttgaagagttggaagcagaatatgttgaagagtgtcaaagatttacggaccatagggtatggtgtgttgggcctgtgtcgctgtcaaataaggatgacaaggacaaggctatgagaagtaagagaaactcaagtgatcttgagagtgagtatgtgaagtggcttgattcatggcctccgaggtcagtgatttatgtttgccttggtagcctaaaccgtgcaacgccagagcagttgatagagctcgggttaggattggaagcgacaaaaaggccattcatttgggtgcttagaggtgcatatggaagagaggagatggagaagtggctgttggaagatgggtttgaagagagggtgaaagggagagggcttttgatcaagggttgggtgccacaagtgttgatcttatcacatagagcaataggagcgttcatgacacattgcggatggaattccacactcgaagggatttgtgctggcgtgccgttggtaacttttcctctgtttgctgagcagttcatcaatgagaaacttgtacaagtggtgaagattggcgtgagtgtgggagctgaatctgttgttcacttgggtgaagaagataagtctcgggttcaggtgaccagagaaaatgttctggattctattgagaaggtaatgggagatggccaagaaaaagaagagataagggaaagggctagaaagtatgcggacatggcaaggaaagcaatagaacaaggtggctcttcttacctcaacatgtccctactaattgatcacatcatacatctgaaagggttagaccaaagctaa

SEQ ID NO: 17589 - DNA, 1179 bp, Glycine max
  Peptide Sequence Number=SeqID_109274
atggcccaagacaaaaaggagcgtaaaaggagcatgaagaagaagcagaaccaatctctgacaactctgcctcaggaattgatcagagaaattcttctgagattaccggtgaaatctcttctgcgtttcaagtgcgtctgtaagtcgtttctgtctctgatttcggatccccaatttgtgatttcccattatgccctagctgcctcgcccacccatagattaattcttagatcacatgatttttatgctcaatccatcgccacggaatcagtgttcaaaacctgtagccgagacgtggtttatttccctctccctcttccatcaattccatgccttcgccttgacgattttggcattcgacccaagattttgggttcatgcagaggccttgtacttctatactatgacgacagcgcaaatctcattctgtggaatccgtcccttggccgtcacaaacgattgccaaactacagggatgacataacttcattcccatatggttttggctatgacgaatcaaaagatgagtacttgctgattctaattggattgcccaagtttggacctgaaactggagctgacatctactccttcaaaaccgagtcttggaaaacagacactattgtttatgatccattagttaggtataaggctgaggatagaatagccagagcagggtcgctcctcaatggggctcttcattggtttgttttctcggagagcaaagaggatcatgtgattatcgcctttgatctcgtggaaaggactctatcggagattcctcttcctctcgctgatcgttctactgtgcaaaaagatgcagtttatggtctgagaataatgggagggtgtctcagtgtgtgttgctccagctgtggaatgactgagatatgggtgatgaaggaatataaagtgcggtcatcttggactatgacctttcttatccatacttctaatcggatttccccaatatgcacaatcaaagatggtgagattttaggatcaaattgcgcgggaactggaagattagagaaacgcaatgacaaaggagagctgcttgagcatttcatggacaccaaaggtcaacggttcagctgtgccaatctacaggctgctatgtatacagagagtctactgccactcccaacgtcattttgggaaacaagtgaagaggactaa

SEQ ID NO: 17590 - DNA, 90 bp, Glycine max
  Peptide Sequence Number=SeqID_109275
atgaaggatactgagaaggtaaagtccttaacgatggtcgaagtctctggtagtaagacttgtggcactttggctctttctggaggttga

SEQ ID NO: 17591 - DNA, 1209 bp, Glycine max
  Peptide Sequence Number=SeqID_109276
atggcggccaagttcgccttcttcccccccaatccgccgtcgtacggtgtcggcttggatgacgtcacggggaagctgaagatgacgggggtggccaccagggaaaacgtcgacgtattgaagctttgcacgaggcgaggaaacagcgtcgtggccatgtacattagaaacccttcggcatcgttgaccatgctctattcgcacggcaacgccgccgatctgggtcagatgtacgagttgttctccgaactcagtctccacctccgagtcaacctcctatgttatgactattctgggtatggccagtcttctgggaagcctagtgagcataacacgtatgcagatatagaagctgcttataaatgcctggtagaaatgtatggggcgaaagaggaagatattattctgtatggccaatctgtcggcagtggaccaactacagatttggctactcgtttaccaaaccttagggctgtcattctccacagtcccatcttatctggtcttcgagtcatgtatcctgtcaagaggacatactggtttgacatttataagggaacagatgatgatgtagtagattactcccacgggaagcaactttgggaacattgcaaacaaaagtatgaacccctatggattaaaggaggaaaccattgtaacctggagctttaccctcaatacataaagcacctcaagaaatttatcacggctattgagacgtcatcgcttcaaaaaactggatctggacctgttcctgatcaactggacaggccaaggagtagcacagattttagagagaaacctagactcagcatggatctaagggagaatttgagacgaagtatcgacttcaaagaaaagcctagaacaagcacaaaccataaagaaacgtcaagagctggcccagataagaaagataaatcaagaaagagtgtagatcgctctgagaaagcatacattggagcagaaatccctgagaaagctagaaatagcattgaccggtcagttacaaaccatgtccgtctgtccaatgaaattgacttctccattgtcatttttcgtgttatccctccaaaacgacgtcattttgaaagtttttgttttcaaaacgacgtcgttttagaggaacaacacggggccagcacgaaaaaggacagcaaagaagccaggtccatgtccaatgtgctcatgtcagttgtgctgtgctaa

SEQ ID NO: 17592 - DNA, 867 bp, Glycine max
  Peptide Sequence Number=SeqID_109277
atggagccacaacatgtgactgatcagaatatagaaactcaaaaatcatcaacaaaaaggctagctgataaggtggcagttataactggtggtgcaagaggaattggtgcagctgcagctaaactgtttgctgaaaatggagcacatgtggtcattgctgatgtgcttgatgaactaggcaccaccgtggccaagtccatcggcggccactacatacactgcgatgtgtcgaaggaagatgatgttgaatcagccataaaccttgcactatcatggaagggccatctagacatcatgctcagcaatgctggaattggaggccctgagggaagaagcatcacaacccttgaaatggaccgagtgaggcacttgttctccatcaatctttatggaacaatacatggaatcaagcatgctgcaagggcaatgatcaaaggtaacaacaaaggaggatccatcatatgtacttcaagtgctgcatccatcatgggtggattggccttgcatggatataccatgacaaaagcagcaattgatgggttggtgagaagtgctgcttgtgagttgggagagcatttgattcgtgttaactgcatttccccacatggagtcccctctgagatgcttctcagtgcttgtagaagatttggacatgatgatattacccctcaaggggtgaaggaaatgattgggagcagggcaagtttgcttaaggggaaaggtgcaaccattgaagatgtggcacatgctgctttgttcttggctagtgatgagtctggcttcattacagcacacaatcttcttattgatgggggacacacatctgctgatagcagaatgagttacatgtaccaagacccaaaatga

SEQ ID NO: 17593 - DNA, 1035 bp, Glycine max
  Peptide Sequence Number=SeqID_109278
atgtttttttttcttcttctgttgtctgtttttttgtttgtttgttcttgggtttttgcatctagccagccctgtggccacgtacatggaataggaatgaaaaatctagtgagctttgtgatcgtgaaaatcactgcaatatgtcccatgagcctgcttgaaagaatgagtgacctgcttagatggcagcacaaggacccttctttcagtttgccatggaagcaagattgcttccccatattctccgagtcaagccctttgtaccacacaagcaagagacccgagcccctcacccgagaggaagagagtgaccttcaacttgccatgcaaagattccttgagctttgtcaaaagtgtgtgcaagccaacattcctttgctggttgatgcagaacacacttctgttcagcctgctattgactacttcacatactcctctgccatcttgcacaacaaaggtgataaccccattgtgtttgggaccattcagacctatctcaaggatgccaaggagagactggtgctggcagcagaggctgcagacaacatgggaatcccaatggggttcaaacttgtgaggggtgcttatatgtcaagtgaaacaaaattggctgagtctttggggtattcgtccccaattcacaacaccattgaggacactcacaagtgcttcaatgactgctcttctttcatgcttgagaaggttgctaatggccctggtggagttgttcttgcaactcataatgttgagtcagggaaactggctgctgcaaaagcacatgaactaggggttggaaaggtgaaccacaagcttgaatttgcacagcttcatggaatgtcagaggcactttcctttggattgagcaatgcagggtttcaggtgagcaagtatatgccatttggacctgtggagactgttatgccatatcttttgagaagggctgaggagaatagaggaatgttggctgcctcgggctttgacaggcaactgatgaggaaggagttgggaaggagactaaaagctgctttcttttaa

SEQ ID NO: 17594 - DNA, 231 bp, Glycine max
  Peptide Sequence Number=SeqID_109279
atggtgatgctgggtttgggaaggcttgtagtgactctaaaatccaaaataaggtctttgaaactgaagaaaccttacgataagatggagaagagtgacagcatgagagtggagataagaagcaggaaggccagaaagcttattgaagagaccctcaaaattgctgattcacctaagttcttagcctttccatcaatcttatgcacccaccacataccaagtcagtgctaa

SEQ ID NO: 17595 - DNA, 692 bp, Glycine max
  Peptide Sequence Number=SeqID_109280
acggtatcggtgatcttggaagcatttggagtgggtttgaggagtttattttagaagcatcaggaagtgagtttgagatgatcttggaagcatctgaaagtgtgtctgagggattgatcttaggtgcacctgagagtgggtttgaagagataatctctgaagcatctgaaagtgagtctaaggggttgatgctggatgcacctgagagtggatctgagatgttattggagacatctgagacgatattggagacgtctgagagagtgtttgagactatattagaagtgtttgaagtgatggttttggcaacatctgagacagtgtcagtgatctttgaagcaacttggagtgggtttgaggagttgattatggaagcatctgggagtactgagtctggggagatgatcttggaagcatcagaaagtgggtttgaggagatgatcttagaagcatcagaaagtgattctgagggattgattatgttggaagcacctgagagtgggtctgagatgatgtttgcagtatcagaaagagtgtttgagatgatatcagaagtgtttgagaatattattgccaatggtgggtgtagtgttgattactggaatggagggttgaactgcactggtgacaccttttgtgaggttcttcaacatcttcgcgaagtagtgttactgatgaatgatgagaaatga

SEQ ID NO: 17596 - DNA, 216 bp, Glycine max
  Peptide Sequence Number=SeqID_109281
atggagatatggttccttatattggaaaccgcaagagacgaatgtaaagaactcttattgtctgtcatgacggtgagaagaagaagaaataagagatggagggaaggtaagaaaaagaaaggggctgaaggtgctagggcctgtgtgcaaaagtcaaaggaaggcgttagggctctcacattatccattctaagatggtatcagaacaagttctga

SEQ ID NO: 17597 - DNA, 510 bp, Glycine max
  Peptide Sequence Number=SeqID_109282
atggtatacatccaagatgctaacaatggcaatgtgggatatgcattcatcaacatgatcaatcctggcttgattatactattctatcaggtgttcaatgggaagaaatgggagaaattcaacagtgagaaagtggcatcactagcatatgctcgcatacaagggaaagcagctctcattgctcacttccaaaattcaagcttgatgaatgaggataagcactgcaagcctatatcctcttcaacgccgatggccctaatgccagtgatcagaatcttggcaagccatttgaaatttgcacttctctttttaccaagagatgaagctacaaaatgggtactaactttgctagcaacacaggttcctttcccagttggcattaacattcgcaacaaagttggaagagtgagaaacaatactcaggaggataacctgcaaggaaatctgccaaattttgcaaactgtaagctctcatctgatggagatagtcattcattggactcagactaa

SEQ ID NO: 17598 - DNA, 231 bp, Glycine max
  Peptide Sequence Number=SeqID_109283
atggggtggaagagagagtttgagggtattgaaaagatcgaaaagcgtcagattctgaaggcagcaataattttcggaaccgactatgagttaggctcagatccaacgatccttctgagttacggaagtgtgcttctttggttagttagttacacttactgtgtgctttttctatggaattggacaagacagctttatcctatcaagctcataatcataatacaaatctaa

SEQ ID NO: 17599 - DNA, 291 bp, Glycine max
  Peptide Sequence Number=SeqID_109284
atgggtcacccatcactttttctcgtgcagcttcttgttacctctctcctctttctctcttttgattatggattcggtagggtggaactgacggagactcatcagaattgcgctttggtagagtatgtctgctctctaccaaaattgaaacaaaaggattttcccattcgcacgattgtaaagtatgacattgcggattattctgatccacagccaaataccaatccaaagaatgggtatgttttgagtcctccttcatctccaactccaattcatcctccaagtccttaa

SEQ ID NO: 17600 - DNA, 1281 bp, Glycine max
  Peptide Sequence Number=SeqID_109285
atggttcgtggtaaaactgtttacattcagtattctaatagacatgaaattgtcaacaacaaaagccctggagatattcctggaaatgtcttgctggtaactattgaaggtgtggaagctggggatgtgagcattgatgttatccatttggtgttttctgcttttggctttgttcacaaaattgctacattcgaaaagactgcaggtttccaggctctgattcagttcactgatgctgagaccgcttcttcagctagggatgcactggatggaagaagtataccaaggcaagtagtgccttttgtattatttcccttattcttcaaccccatctataattctagttatagcttgattcgtcctaaatttgctgaatcacttgtggtttggcatgtagatacctgcttccagcccatggactacacaaatcccatgcttcctgttaattatactgctattgagggggcagtacagactgctgtaggccctgatgggaagaggaaagaacctgacagcaatgtgcttttggcttccattgaaaatatgcagtatgctgttactgttgatgtcctccacacggtgttctctgcatttggtactgtccagaaaattgctatatttgaaaagaacggtcaaactcaggcactgattcagtaccctgatatcataacggcatcagctgctagagaagctctagaggggcattgcatatatgatggtggctattgtaagcttcatctatcatactctcgtcatactgatctcaatgtaaaggctttcagtgacaaaagtagagactatacagtgccagatcctagtctgctagcagcacaaggtcctgcaacagcttggcaaaatcctcaggctgcacctatgtaccctggcagtgcccctgcttatcatactcaagttcctggcggacaagtgccagcatgggatccaaacctgcaggcagttagaccgagttatgtatcagcacctggtacttttcatgttcaatctggtgcagctcctccaatgccagcctatgcgccagccgcagctatgcctgctgcttcctcacctcatgcacaaagcagccccatggctcataatgcaaatccaatgggaatcgcccagcccagggttccacccaatgcaaatttacagtccagtggtgcttcactttcagctcctggttcctcacctctcatgcaaaccagccaagctgctcaaggattggttcagccaaatgcaagacctggtggtgcttcacctccaggtcaacattattatggttag

SEQ ID NO: 17601 - DNA, 1025 bp, Glycine max
  Peptide Sequence Number=SeqID_109286
atggatctttcgagtctcgctgttatactccaggccgctctcagtcccaatccggacgagcggaaagcagctgagcagggcttgaatcagtttcagtatgcgcctcagcatctggtgaggctgttacaaatcattgtagacaacaacgttgacatgggtgtacgacaagtggctagtattcatttcaagaactttattgccaaaaattggtctcctcttgatgatacccaacagaagatctctcagagtgataaagatgtggtgagggatcacattctcgtgtttgtaacccaggttcctcctttgttgagggtacagcttggtgaatgccttaaaacagttatacattctgattatcctgagcagtggcctcatcttcttgactgggtgaagcataacttacaggatcaacaagtccatggtgccttgtatgtgctgcggattctttctagaaaatatgagttcaagtcagacgaggaaagggtaccagtttatcgcgttgttgatgagacatttcctcacctgctcaatatatttaacaggcttgtccagattgttaatccatcacttgaagtagctgatttaatcaagcttatctgtaaaatattctgcatgtattcctttttaaccctaggtgatcagatcaaggttgtcaaatttgagagattggagattcctaagctgttgtttgatcaaaatatcttcaatgcttggatgatgctatttttaaatatattggagaggcctgtcccctctgaaggtcagcctgttgatcctgatcttagaaaatcatggggttggtggaaggtcaagaaatggacagttcacattctcaataggctctacactcgttttggagacttgaagctgcaaaaccccgaaaacagagcctttgctcaaatgtttcagaagcattatgcggggaaaattttagagtgccacttaaatctgttaaatgtcattcgtgtaggtggctatttacctgacagagttatcaacctaattcttcaatatctaagcaacag

SEQ ID NO: 17602 - DNA, 795 bp, Glycine max
  Peptide Sequence Number=SeqID_109287
atggccgaagagcccgaaaacaatccaccgccaccggaacctccaatcccctccgcaccggatgccgcggaggaaactgcagctccggctccggcaacgacgtcgcaaccaagtgccgagatcgtcgctcctctggcgctagctccgaagcggcagcgccgtccgagtgttcgcctgggggagatcggcgaccaacgcgcctcctccgcgcacggccacgactcgcacacgcgccgcccgagcatgccgccatggagctggcggactccgaaggaatcttccagaacctcgaaggcgcgcaccgtaacgaacctcgcgaacggcggcgaagagttcggaaacagcaacagccgaagaggaaaagcaaaacgaggaccagcgacgaagcgattgagaacaaattgggctcctagagcgacaatcgacgaaaatggtgacgaagaaggttttagggatttcgaacacgaacacgaacagagtccagtacactcgatggaggagaacggagtggattattggcacgtggatcggaacgaggatcctagggttagggtttcggaaaacgacggcgttgaatcggagtcgcaggaacggaggaagagcgatggagttcggtcttggctttacgagttagggctgagtaggtatgcgcctatgtttgagatccatgaggtcgatgacgagttgcttccgatgttgactttggaggatctgaaggacatggggatcaatgctgttggttcaagaaggaaaatgtacactgcaatccagaagctgaggaaatgcttgccgtga

SEQ ID NO: 17603 - DNA, 1989 bp, Glycine max
  Peptide Sequence Number=SeqID_109288
atgaagatgaatgttaatatccctaaatatgggagaccaaagaagggagaatcacaaacagtcgagagggggacagcagagacaggacaaacacaaaagggaagaacagaagtgtacctgagcaggttaccagaagcgaatatgggaatccaaggacggtcgtatgcggaggtggtcaacacgaatatcccgaaaccagcacagaggagaacaacagccaaactccaatacataagttccaatgccacatcggaagtgaacctggacatttcgatgacgggtaaacaatggctcaaggaggcctgggtgggtagactgaaaaacttggctagctttgatagcatagaagaagccatatggtgggatagcggacaaaacatatcaccaaagtacatcggtgatgacatggttttgttactggggctcacagaagagaacgcagagaaaatggtgaatgaagaagatgaaggatggggcgacctgttctactccatagagaagtggaatccaagtctacgccctggttttagactaacttggatccaatgttggggaatacctttggttgcatgggacatgaactgtatcaagcagatagtcgcgggaataggtgagatggtggaggctgaggagagcttagaagatcaaaggaggttcgacgtcgcgaggatactggtcaaaacgccatggaaaccgctgattcagcacacggtaaatattcatatacagggggagatttttccggtgcacatagcggaggagagtgggttgtttggagctaggtggcagccaaaaagggaacgtgacttcagctcatcagaggaaatcctttctgacgaatgtaacgatgacgcgtggtctggtagtgagctgcaggggtggcggtacaaagcgcgaatagagagcgtggcggaggaaatacgaacagtagcgaagggagggaccttggaggcagaagccatggaggatatggcgacggagggagtggtggggggcgaggaagataaccgcagagggagaagtgaaatcgtgccatttaaaacccaaaggggagctccagcccagtcggagacggtggatgacacagaggataggggtggcgacgaggagaggtcgccgcgtggtgtggaagaagggcgactcaggcaggtctctcggtcagaaggaccggcgacagtcgcggccggtgcggaccaaaacggaaaggcgatcgggacgaagagcggacatgacccaaaggacaaagctattgtccgatgggtcgtgaagcaagcagataatgcactgacaggtgataaatgcgtgcagaccagggaccgtgagctaccagtgtcgcaggaagaagggaagaccgatttaggggaagaagataacctcgggggggatgtcggccctgacggtttgggcaatttgtatgaaaatagtatgaggaggcagacaagaaacgttggaggcatggtgtacgaggaagacaaacataattttgaatccccctcacccaagtcacgtgacaaggagatgatggggctgctggatttgggccaagctattaacaccccacctaaattatgtccttctcccaaaaatggcccagttttaaaaacaacacctctcctaacccctttgttaacgtattcccgtaaagggaaaatgaagagagttaaagcccaaataggtgaggttgtttcgaaccaagtgctttcaagcccagagcatgttcaaaatggactattccagcgagataacgagggacgtggatcagccaacccccaaatacaaacagaaacatcatcaactcacaataggcaggaaaatcagctccaggaggaaacttttgactcgcacgaagaaagtctatggagaatgatcaaggagttgggactgacaacaggaaaaactcaaagagattatgttcaacagttgacagaaatggaagatagagatggaaaagaggcagatagcttgggaggaaggggaagggactcatga

SEQ ID NO: 17604 - DNA, 1089 bp, Glycine max
  Peptide Sequence Number=SeqID_109289
atggaccttacactctacgacataaaggaatcctcctctggtaaatttgttccctgtgatcaagagttttgcaaagagatcaatgggggtctgctgaccggatgcactgctaatatttcctgtccatatctggagatatatggtgatgggagctcgactgctggttactttgtaaaggatatcgtactttatgatcaagtgtctggggaccttaaaactgattcagcaaatggaagtattgtatttgggtgtggtgcaagacaatctggagatctaagttcttcgaatgaagaggcacttggtggaatacttggatttggaaaagctaattcatcaatgatttcacaacttgcttcttctggcaaagtgaaaaagatgtttgctcattgcttaaatggagtaaatggaggtggtatatttgctattgggcatgttgtgcaacctaaagtaaacatgactccattattaccagaccagccacactacagtgttaatatgactgcagttcaagttggccatgctttccttagtctatcaacagatacatcaacacaaggagacagaaaagggacaataattgacagtggtacaaccttggcctatctgcctgaaggaatttatgagccgctagtatataagataatttctcagcaccccgatctaaaagttcggactctccatgacgagtatacgtgctttcaatattccgagagttgcgctcccatagctgtggtgtccatggtgcgtggcataggtcacattaaaaaggcaaggtgtcaccatccttcaatatggcaattgaatgccatgttggcattgtttaagcttgctgtcatgagcattggcatctgtagtggttggtgtttgagtgttgatgatggatttccagctgtcacattttattttgaaaatgggctctcgttgaaggtttatcctcatgattatttatttccctctagttttatttggcttgttttgggacctgttgtcggtcttctatgtcatatacatatatatgaagaggaatcaagttacttcaagagtaactctaagagagttactcctcatcttcaccattcatttccttaa

SEQ ID NO: 17605 - DNA, 1488 bp, Glycine max
  Peptide Sequence Number=SeqID_109290
atgattataattcttgtgtttgatcatgattatgatgatgacgatgaatatgaatatgattatgatgatgacgatgaatatgaatatgaacatgattacgatgatgacgataattttgattatgatgatgcggtggaggtgctgaatcggtatgggacggatctggtgggggagccgagaggttctgattctgagtgtttggcgggttttgagtgttttctgaacattgtgagggcattgggaatgggatcgtgcatctcggaggttggagctggtggaagttcccctcctcttcttcctttttcgcctgaatcgaacatggatggtgggaagaggagaaggttaaggggttcctcttcctttgatttcaaagtgcctgggaggatgttcttgaatgggtcaagcgaggttgcatccatgtattgcaagcaaggaagaaaagggatcaaccaagatgctatgcttgtttgggagaacttttgttcaaaggaagacaccattttttgtggtgtttttgatggtcatggaccttatggccacagggttgcaaagaaagttagggattcttttcctttaaagcttaatgcccaatgggatttgcatcataagaatagagatggactcagtgatcatagcagcgccacaggaagttataaatctgaagggaatggatttagactggtggatgagaaaactagtcccactgatcatgaacttgatgaaacagatacgattttgacattacgagaatcgtttttgaaggcttgtaagattatggataaagaactgaaacatcatcctgatattgactgcttttgtagtgggactacagcagttactttggtcaagcaggggctgaaccttgttattggaaatgttggtgactcgagagctgtattgggtacccgagatcatgaggattcccttattgctgttcagttgaccgttgaccttaagccaaatcttccaagggaagaagagaggatcaagcttcgtagaggaagggttttttcccttcagaatgaacctgatgtggctcgagtttggctgcctaactctgatttccctggtcttgctatggctcgggcatttggagatttttgccttaaggactttggattgattgctgttccagatatctcatatcaccgccttaccgagaaggatgaatttgttgtgttagcaacagatgggatttgggatgttctgtcaaatgaagaagttgtggacattgtggcatctgcttcacagtctactgctgctagagcactggttgagtcagctgttcgggcatggaagacaaaatttcctttttgtaaggttgatgattgtgccgcagtttgcctcttctttgattctgatttagatttcaagtcaacagatacaaaagacaagttaataccggaggcatctattgaccaatctgagcagttagctttacttggtgaaaagggagttggaaatgaagctgaaaaaaagcagcaatag

SEQ ID NO: 17606 - DNA, 297 bp, Glycine max
  Peptide Sequence Number=SeqID_109291
atgaatgacggcaaatcttacaattgcatgggaatcatgcatgcatgttgggatgatcgtagtgacaggaattgttcgagtggccatgagcaaggatggtgctggagaggagagaatgcggcggtggggaggatggtgttgaggttgtttttggaaaagttgggggaggcaaaggaagggctgcatagggcgggggtggggacggtgtcagagaggttgaaagcagcaatgcctccgattgtgacatcacacatgacaacaatccagttgcatggtgtggtgtcgtggtggttctag

SEQ ID NO: 17607 - DNA, 657 bp, Glycine max
  Peptide Sequence Number=SeqID_109292
atggatgaggccttattccttgcttggtcttggcaaagagccagagagaaaggattccatactcaatttaaccactggtcttccaatctttcggagttttttggtggcacgcttggtgccttgtatttatcttacagtacccctgttaccgagtggtctggtgggctgtatgtatctccaaccatagctggaagcaggcctggaagtcttattgccggtgcatgggcagcgatgatatctctagggaaagaaggttacttgaaaaatacaaaagaaattatggaagggtcaagaagaatacagcaaggcatagaggagattgctgagttgtttattgttggaaaacccgacatgacgatagtggcttttggatccgacgttctagatatattcgaagtcaatgatgttatgtcatccaaagggtggcatttgaatgcattacagcgacccaacagcatccatatctgtgtgacactgcaacatgtgccaattgttgaagactttctcaatgatctgaaggaatctgtgaaaactggtggttgcaggggtatggctgttgatgtgaaagcaaatccaggtccaataagtggaggcctagcacctatatatggcgccgcagggaagatgccagatagaggcatggtccaggaattgctg

SEQ ID NO: 17608 - DNA, 156 bp, Glycine max
  Peptide Sequence Number=SeqID_109293
atggaggatacaccaaatggagatggaggtggccaacggtgtggtttgctggacaatctgttgcaagaagaggttagaaaagtagaaggagaagaacatttaacgagtgaattgttgactattgttttggctaatgtgtcactgcatgtggggtaa

SEQ ID NO: 17609 - DNA, 294 bp, Glycine max
  Peptide Sequence Number=SeqID_109294
atgcagatgaagaacacccctttgtacagaacaactcccttgggggtcatggctgacccttgttatcgcaaagcaccctctaaggtggtttccattcctgttcacttcgtgggctcagagcgcaccagaacaaattctgattctgccacaaagatccagagggtgctgagaggatttctcgtgaggaacaccttgaggaaaatcgctgccatgagggtggagttggagcggattgagtgcgaggtaagggtggaagtgatgaaattgaagagggaacaaagggagagggtgagg

SEQ ID NO: 17610 - DNA, 1320 bp, Glycine max
  Peptide Sequence Number=SeqID_109295
atggagtgtataatgggactcttgaggcttggatggctgattcgtttcattagccattcagtgatttctggctttacaactgcttcagctattgtcattggtttatctcaagcgaaatacttcttggggtatgatatagatgggagtagcaagatcattccagtagttaagagtataatagctggagcagataagcctgcacaaggaaggatgatggtttttaaggactggatgttcaattctttccaattttcatggcctccttttgtgatgggatccattatgcttgcaatactgcttgtcatgaaacacctgggaaaatcgaggaagtacttgcgattcttgagagctgcaggtcctcttacagcagtagttctgggaacaacttttgcaaaaatatttcatccatcatcaatttctttggtgggagatatacctcaaggcctaccaaaattttctgttccaaaatcttttgagtatgcacagtccttaattccaactgctcttctcataactggtgtggctatattggaatcagtgggaattgcgaaggcattagcagcaaagaatgggtacgagttggattcaaatcaagagttgttcggtcttggtgtttccaatgttcttggttcatttttttcagcataccccacaacaggatccttttcaaggtcagctgtaaatcatgaaagtggtgcaaaatctggtgtatctgggattgtttcaggaattataatgacctgtgcacttttgtttctaacaccattatttgagtacatacctcagtgtacccttgctgccattgtgatctctgctgtgataggtctggtagattatgatgaggccatttttttgtggcgtgtagataagaaagattttcttctttggaccattactagcactacaacattgttccttggtattgagattggggtccttgttggggttggggtttcacttgcgtttgtcattcatgagtcagcaaatccacatattgctgttttgggtcgtttgccagggacaactgtttataggaatgttaaacagtatcctgaagcatatacatacaatggaattgtaatcgttcgtgttgatgctccaatttattttgcaaacacaagttacatcaaggacaggttgcgtgaatatgaagttgatgttgatcgttctaaaagacgtggacctgaggttgaaagaatttatttcgtgattctagagatggcacctgtgacatacatagattctagtgctgttcaggctttgaaagacttgtattcaggagtacaaattacgggacattcaggtagaataagattgtga

SEQ ID NO: 17611 - DNA, 858 bp, Glycine max
  Peptide Sequence Number=SeqID_109296
atgtttgtcttcaaacccacctcttctcttctctttctcctcctcagtatttcatactctgcttcttcagttacctcactcaccgtaccgccgcgagggggggccccactcgacctcaccactactccgcaacaacaaaccgatggcgatgatgattccctcacctacctctggcccctccccgcagagttcacttccggcggcgacactctctccgttgaccccgcgctcaccctctccgtcgccggaaacggcggtggctccgccattctcagagaggccttcggccgatacagagggatcgtgttcaagaacaccgctggtgtcgggtttagtttcatcagaaagctgagggaacgattggtgtcttctgtttcggcattcgacgttgacactttgaagatcacagtccattcagacaacgaggagcttcaatttggagtggatgaaagctataccttgctggttcccaaagccaaggaatcttcccaagtcacgattgaggcaaatacagtttatggtgcattgcgcggattagagacattcagccagttgtgttctttcgattatacaactaaaacagtaaaaatatacaaggcaccttggtccatccaagataaacctagatttgcatatcgtgggcttatgctggatacatcaaggcactatttacctattgatgtaattaagcagattattgaatctatgtcctatgctaaacttaatgttctacattggcacatcatagatgagcagtcatttcctcttgagatacccacatatccaaacttgtggaaaggttcatatacaaaatgggaacgttacacagtagaagatgcatatgaaattgtcaagtaa

SEQ ID NO: 17612 - DNA, 759 bp, Glycine max
  Peptide Sequence Number=SeqID_109297
atggcaatgcatagaattgcaattgggacccctggagaggctgcccaacctgatgcaatcagagcagcatttgcagaattcttctgcatgatcatttttgtttttgctggggaaggatctggcatggcttacagcaaacttaccaacaacggacctgcaacaccagctggtctcattgctgcatcactatctcatgcatttgggctttttgtggccgtttctgttggggcaaacatttctggtggtcatgtgaaccctgcagtcacatttggtgccttcataggaggaaacataaccttgttgagaagtattttgtattggattgcacagttgtttggttcagttgttgcatgcattcttctaaagcatgcaactggtggaatggaaacatcaggtttttctctatcccctggtgtgtctgtgtggaatgcattggtttttgaaatagtgatgacttttgggttggtatacacagtttatgccacagcagtggacccaaagaaagggaatgcgggagttgttgcaccaattgcaattggttttattgtgggtgccaacatcttagttggtggtgcatttgatggtgcatcaatgaacccagctgtgtcctttggccctgctgtggttacatggtcatggacccatcactgggtctattgggttggtccattcattggtgcagcaattgctgcaattatctatgataatatcttcattggagatgatggccatgaacctctttcaagcagtgacttctag

SEQ ID NO: 17613 - DNA, 576 bp, Glycine max
  Peptide Sequence Number=SeqID_109298
atgacgtccctgcagaattcaccaacgcttcaccgaactatgctccacaactctttccctcagaagcatgccactcgttcatctcgaagagatgccatttccttcattgtcaaagctgcccaagaaccctctgcttctttagcttctcaagttgctgcagaaaataagaagggatttttgcctgttttggacaagaaagatggatattcatttctctaccctttcgggtggcaggaagtagtaattgaaggtcaagataaggtgttcaaagatgtcattgaaccactggagaacgtcagtgtaaatgtgataccaactggcaaacaggatattacagaatttgggtcccctcaagaggttgctgaaactctaataaaaaaggttttggcacctccaaaccagaaaaccaagatagtagaagcaaaagagacactgatcatgacttgctccatctatgtaatgcttcagcaagatgttgaaggaaaaaagtactatcaatttgagttcattgctaaggctccaaactatactcgtcatgctctcagcacagtctccattggcaatggtatgatttga

SEQ ID NO: 17614 - DNA, 861 bp, Glycine max
  Peptide Sequence Number=SeqID_109299
atggcggatacaattgtggttttcctgatagaaaagttgacgaggttgttagcagaagaagccaaactacttggtagcgcgcacgacaaagtaacatcgttgcgcaacgagctgaggttcatgaacctcttcctcaacaactcccaaggcaagcgcaaagatcacaacatggtcgcggaactcgttgaccaaatcagagacatcgcccacgaagccgaagacgtcatcgacaactacatcagcgacatgatcaagcagagaaggagaaacatgctggagaagtttggccgcggcgtagaccacgcgctcatgcttcgcaacttgaccgtcaaaatagacaggatcaagaccaccatcaacgatatcttcgacaataaggtcaagtacggcatcgaagctggaaggagagacagcgaggaagaagcagagcgtatacggaagcaaagaagagacgtggaggaacaagaggttgtaggatttgcgcatgactccaaggttgttgtaattgagaaactcatggcatcgggttcgcgccttaaactggtttccatcgtcggtatgggtggtttgggtaagaccaccctagccagaaaaatatacaacagcaacagggtcaagaacacgtttccttgtcgcgcatggggttatgcctctaacgattatcgacccagggaattcttcttaagccttctcaagtgtttgttgtccacgtctaagtacaacgatttgttcaagaaaagagaggaggcaagtagaagcgaggaggagctgaagatgaaggtgcgagaatgcttgagcagaagcggtggcaagtacttggtggtggtggacgatgtgtggcaaagccaagtgtgggatgag

SEQ ID NO: 17615 - DNA, 1872 bp, Glycine max
  Peptide Sequence Number=SeqID_109300
atgaaaaaaattggtgaacatcaaactctattagcattaaaggaaactctcgtttattttgcaggtgctaagcggctaattggtaggagatttagtaatccagaggttcaaagtgatatgaagcaatggccattcaaagtcattgctgatgttaatgacaaaccaatgatcgctgttaattacaattgtgaggaaaggcacttttctgcagaagaaatttcgtccatggttttggaaaaaatgcgagcgattgcagagtcattccttggatcaacagtgaagaatgctgttatcactgtgccagcttacttcaatgactctcagcgacaagctaccaaagatgctggtgccattgctggcctcaatgttttgagaatcatcaatgagccaactgctgcggcaattgcatatcggcttgaaaggaaaaattgtaataatgaaagaaggaatgtttttgtgtttgatcttggtggtggtactttggatgtgtctcttcttgtttttgagaaggattatatccgagttaaggcaacatctggagacactcacctcggaggagaggacttcgataacaatatggtgacttactgtgtgaaagagtttcagagaaagaataaaaaggacattagtggaaacgaaagagcccttaggaggttgaggactgcttgtgagaaagcaaagagaatactttcatccactgtaatgaccaccattgaggtagactctttgtatgatggtattgatttccactcatcaataagtcgcgcaaagtttgaggaactcaacatggactaccttaacaagtgtatggagtttgtagagaagtgtctgatagatgctaagatggacaagagtagtgttcatgatgttgtcctcgcaggtggatctactaggattcccaaattgcagcaactattaagtgacttctttgatgggaaggatctctgcaaatgcatcaatgctgatgaggccgttgcatatggtgctgctgtccatgcttctatgcttaatggtgagtccagtgagaaggttcaaaacactttaccgagggaagtcactcctctttcccttgggttggaaaaagaaggaggtatcatgaaagtaatcattcctaggaatactagcattcctacaaagatggaagatgtattcacaacacatttggataaccaaatcaatatcttgattcatgtttatgagggtgagaggcaaagaactagagacaacaacttgttgggcaagtttgtgctagaaattcctccagttccgcgtggtgttcctcaaataatcgtttgctttgaagttgatgatgagggtatcttgcacgtctctgccaaggagaattccttgggaataaccaagaaggtgaccataataaatgacaaaggaaggctttctgaggaagaaattaagaggatgatatcagaagcagagaggtacaaagctgaagatgagatgtataggaagaaggtagaagcaaggtatgcattggagaagtacgcatacaacataaggaatgctataaagcataaggggattagtttgaagctttctccggaagacaaggaaaagatcaatgatgcagttgatcgtgccttagaatggcttgaggtcagtgtggatgctgaaaaagaagatgttgacaatttccggggcaatctttctagcgtttttgatacaatcatggttaaaatgataaagggtgaggataatggtgcgcctccaggtgctgttgctagctctggtagcaaaagtgggaagaatcgctggttatcaatattggcaaaatttggtctccaggcagtgtattcagctgttacaggtgatatcattggatttgtttccgtgattgttgactgtttggcaaattag

SEQ ID NO: 17616 - DNA, 738 bp, Glycine max
  Peptide Sequence Number=SeqID_109301
atggtgaacgtgatggagtggcagaagcagcgttggcaaccgaatgggaacgcggaaatgatgtacgtgaaagtgatgaccgacgaacagctcgagactctgcgcaaacagattgcagtttacgcaaccatctgtgaacaactcatcgaaatgcacaaaaacatctcctcgcaccaagatcttgcagggattaggctggggaatatgtattgtgatccattgttggggtctggtgggcacaaaatagcttcaaggcagcggtggactccgtccgctatgcagcttcagattcttgagcgaatatttgatcaagggactggaacccccaccaaggaaaagatcaaggagatcactaatgagctcagccagcatggccagatttctgagaccaatgtgtataattggttccagaacaggcgtgctcgctccaaaagaaagcagcagaatgtggcacctagtgctaatgctgaatcggaagtggagactgaggttgattctaaggataagaagacaaagccggacgaatttcagtcccctcctagcgtttctgctgtgcctgctgatgataatttaggcttccagaaccatggcagtttgcagtacttgaatccagagtccaacaaaccagattctgtgttcccatctgatgcaacgagtgactatcttactggaaaaatggaagcacctgagaactacgacttataccagccagcaggcgacttcaacatggcaggttga

SEQ ID NO: 17617 - DNA, 87 bp, Glycine max
  Peptide Sequence Number=SeqID_109302
atggccaccgggaagaacattgccggagcgcaaaatggtggctccggacaacgggacctaaataattattccttaatgggtcattaa

SEQ ID NO: 17618 - DNA, 930 bp, Glycine max
  Peptide Sequence Number=SeqID_109303
atgaaatccttgagtagtgtaggtcttggtctcagtattatttttggttgcctcttgttggctctggtagctgaggtatactatttgctatggtggaagaagaggataaccaacagagagattgagaataattatggcaaccctgtgaaggagttattctacatgttttgttggaaaaggccatcatcatcttctttgaggcaaacaagtttcactcctcctgagctttgctcttccatgagaattggtgacacccttgttcataacccagaacaagttcagtctcaaagtggcaaggactttgttttcaaaccctttggggaagatggcatggatgcagaatacatgagccagcaggacctcttaggtcctccaagattcttgttcaccatagtagaagaatcaaaggaagatttagaatctgatgatggcaaattcaaatgtgacaagagtggaaaaggttcaaggggtagaagcttgggtgatttgctagttgtggagacaccatatatgacacctactacttctccacctttctttactcctcctttcactactcctatcagtccctataaccagcgtggattcaatcctctatttgaaacagcaactgatgctgagttcaacagattaaagtcctcacctcctccaaaattcaagttcttacaggaagcagaagagaagcttagaagaaaactacaacaggatgaaaataagggaaatggagatgaggttgatggttctttcatcacaatagttgttgacaagaaaacagaaagagaggttaatcaccagcctcgtccaccacagtaccattcaggcacttcacagcactatggtttaatctaccaagccagttgtgaaatgtactaccactctcaatgtatcaaagcacatgggggacaatattttctgctcataaatgcttaa

SEQ ID NO: 17619 - DNA, 927 bp, Glycine max
  Peptide Sequence Number=SeqID_109304
atgaaacgcaacaaagcgacggtcttgacattcgctgagaaatgcaagaatatattggcatcaaactggcaaggttcccttaatactatcaaagctgatgccaaaggaagcaaggggaatatccatacatctaagattaagtacatagtcagaagggggcagccatacctttgggtgccagaaaacgatttgcataatgtgaacactatcattgatgagcgtggttcatttgctgtgaccagcccctatccaggtccactaggaatcttattgaaatcattgaaaaagttaccagcacggattgctttatctggggatgttcttcctcttaaagaagataaggctaagtctcttgcagaaaaacttcaggaagtcatgctatctgagaaaaaagcaatcaaagagttcacttacactgtttctggtgtactaagttctagtgctagtagcagcacatcacgaagtgataatctccaggatctattgggagacaatgaaagatacacaatatatagatttaaaacgagatcttgcacatttgttgatggccttggtggcacttttgatgtggatgttgaagatttggaaacatccagagctgatccattagcaccattttcagcgaagattgttgatgggattaaccaaagtgaggctagacgtacggcactcatgcttttttgttttgtttacaaggatgctaatgcaaaggatgcatatattacatccattgatcgcaagggatttgatgtcctggcaaaagttagcagtccagttttgaaggatggtattgatggctaccaatggaaagaattcaggttcatgttcaaggaggaggcaaatgatgttgaaatgttctgtagtcaactagtcgaaatggaagaggaggtcatcaataaggtttcaacctctagtggactaaaatag

SEQ ID NO: 17620 - DNA, 369 bp, Glycine max
  Peptide Sequence Number=SeqID_109305
atgattaccgtcatcaccatcgttgttgccaccgacaaaaccgtcactaccaccaccttcgtgatcggcgtcatgaccactgccattgcgatagcggtggtggcaatgatagtcatgttggtggggatgagaatggtcacaacaatgatgattatgatgatggtgatcgtagtgatagaggtggttgtggtgatgatcttgacggagacaactgagggacaaagaatggtggaagtggtggacaaggcagccagttattgtggggaggaagaaggaatgacagggagggggggggaagctccacagccatgcatggacagcgacatggaagatggaacacattgcgcattgtgcataaaaaaatcttga

SEQ ID NO: 17621 - DNA, 1719 bp, Glycine max
  Peptide Sequence Number=SeqID_109306
atggccgtttcgagctcgcacatgcgtttcaccttcgagtgccgctccgatcccgatttctcgccaccgccgccgtccttcgacaacctccgccgccgtaacttccgctcctccgccggatccggcgcggcgtttcacggcatctcctccctcatcctccgattccctcccaacttccagcgccagctcagcaccaaggcgcgccgcaattgtagcaacatcggcgtcgcgcaaattgtcgccgcttcgtggtcgaacaacagcgacaactctccggccgccggggctccggcgccgcccgcggccacagcagcggacgccgccacggtgcctctccccgtcgacctcgccgccgccgaggacgtcgtcgtctctgccgcggccgccgagaacgggactgtacagttaaacagtagttcttattcatttttgaaatccgatgcaagcaaaacgattcatgccgctgaaagactgggtaggggtattgagactgatggaattaccacccctgtgctgaacacttctgcctacttttttaagaaaaccgctgatctcattgatttcaaggagaatcgtcaagtgagttatgaatacgggcgctatggaaacccaacgactgtggttctggaggagaagataaggtttgttgtcattattaaccccagtatattggagggggctgaatcaactgtgataatggcatctggaatgtgtgctagcgtagtcctatttatggcactggttccagctggtggacatcttgtgaccactacggattgttacaggaagactagaatattcattgagacttttcttccaaagatggggatcacgaccactgtaattgatccagcagatgttggagccttggaatctgcattggagcagcacaatttaatagatggtcttgagttaacatggtatgatacaatcattcaggtgtctctattcttcactgagtcgcctaccaatccattcctgagatgtgttgacattaagctggtttcagagctttgccacaagaaggggactttgctctgtattgatggtacatttgcaacaccattgaaccagaaggcccttgcccttggcgctgatctgattctgcactccttaacaaaatacatgggtggacatcatgatttgttcagagttaagcgtcaaggagcatttttcctctttcaggcccttggtggttgcataagtggttcaactaaggtggtttcgcaaattcggactttgcaccatgttttgggtggtacacttaacccgaatgctgcatacctattcatcagaggcatgaaaacgctgcatctccgtgtacagcagcagaattcaacaggaatgaggatggccgaacttttagaggcacatcccaaggtgaagcgggtctactatccaggcttgccgagtcatcctgaacatgagcttgccaagaggcagatgactggtttcggtggtgttgtcagttttgagattgatggagatctacataccacaataaagtttattgattcactgaaaatcccttatattgcggcctcgtttggtggctgtgagagcattgtggatcaacctgctattttgtcttactgggatcttcctcagtcagaaagggccaagtataagatttatgacaacctggttcgcttcagctttggagttgaagattttgaggatttgaaggctgatgtcctgcaagctctggaagctatatag

SEQ ID NO: 17622 - DNA, 261 bp, Glycine max
  Peptide Sequence Number=SeqID_109307
atggaatgtgtgaagattaacactctttggtctggtgagattgattgtgatggttttgaggccaagcttctttgtcacaaggacaagccagcaattgtgaatgtgaacataggtacaactgtgaagggagcaatggatgaccttgatctggtaataaagaaactagaagaggcaggattttcacgagacaggattatgaggtacattcgaagtgaggaaagctctactggtgatgtagttgagcacatcatacttgattag

SEQ ID NO: 17623 - DNA, 1794 bp, Glycine max
  Peptide Sequence Number=SeqID_109308
atggccaaaaaccagggatttgccgtaggaatcgaccttggtacaacctactcgtgtgttgcagtgtggcaggggcaacaaaatagagtagaaataattcacaacgaccaagggaacagaactacaccttcttttgtcgctttcactgacgatcaaaggttgattggtgatgctgctaagaatcaggctgcagccaacccagaaaacactgtctttgatgccaagaggttaattggtaggaaatacagcgatcccactattcaaaatgataaaatgttatggccattcaaggtcatagctgataataatgacaaacccatgatcaccgttaaatacaagggccacgagaagctcctttcagcagaggaagtgtcatctatgatcctcatgaaaatgcgggagattgctgaggcatatttggaaacaccggtaaagagtgctgttgttacagtgcctgcttatttcaatgattctcagcgtaaagccaccatagatgctggaaccatagctggccttaatgttatgcggataatcaatgaacccactgcagcagctattgcatatggccttgacaagagaattaactgtgttggagagcgtaacatttttatctttgaccttggtggtggtacttttgatgtttctctccttacaattaaggacaaggtcttccaagtcaaggctactgcagggaacacccaccttgggggagaggacttcgacaacagaatggtgaattacttggtgcaggagttcaaaagaatgaacaaggtcgacattagtggtaaccccagagctttacgaaggttgagaactgcgtgcgaaaaggtgaaaaggacactctcgtttgctgttacaaccacaattgaggttgattcattatctaaaggcattgatttctgcatttcaatcactcgtgcaaagtttcaggaacttaatatggatctctttgaggagtgtctgaagactgttaataagtgtcttacagatgcaaagacggacaagagcagtgtacatgatgttgtccttgttggtggttcttcgaggattcccaaagtgcaggaactattgcaggaattctttgagggaaaggatttttgcaagagtatcaaccctgacgaggctgtcgcttatggagctgccgtgcaggctgctttgttgagtgacgacattcagaatgttccaaatttggttttgttggatgttgcaccgctgtcacttggtatatccacaaaaggagatctcatgagtgttgtgattcctaggaatactactattccagtttatgaaggcgagagaaccagagcaaatgataacaatttgcttggtttctttagtcttttgggtttggttcctgctcctcgtggccatcctgtggatgtatgctttacaatagatgtaaatggcattctatctgtttctgcggaggaaacaaccactggttataggaatgagattaccataaccaatgaccaaaaaaggctttcagctgagcagattaaaagaatgattcatgaagctgagaaatatcaggttaatgatatgaagttcatgaagaaggctaatacaatgaatgctttggatcactatgtttacaagatgaggaatgcattgaataataagaatatcagttcaaagctttgtttacaagaaaggaagaaaatcaaatctgtaattacaaaggtgactgatttgcttgagggtgataatcagcgggataaaatagaggtgtttgaggatcatctaaatgagcttgtgaacctctttgatcgtgtcattggcaagtttgcttag

SEQ ID NO: 17624 - DNA, 978 bp, Glycine max
  Peptide Sequence Number=SeqID_109309
atggccaaagaagatgaaatttgctgtaggaatcgatcttggtacaacatattcgtgcgttgcaacaatcagaggttgattggtggtgccgcaaagaatcaggctgtctccaacccagaaagcactgtatttgatgcaaagaggttaattggtagaaaatatagtgatcctgttattcaaaaagagaaaatgctgtggccattcaaagttgttgccagtattaatgacaaaccaatgattgttgtcaagtacaaagggcaggagaagcacctttgtgctgaggaagtatcatctatggtcttcacaaagatgtgggagattgcagaggcatatttggaaacacctgtaaagaatgctgttgtaacagtgcctgcttatttcaatgattctcagcgaaaagctactgctgctgctattgcatatgaccttgacaagaggactaatttcgttggagagcaaaacattttcatctttgaccttggtggtgaggaatttaaaaagaagaacaaagtggacattagtgagaaccctagagccctaaggaggttgagaactgcgtgtgagagggcaaaaataacactatcctatgatgttattaccaacattgagttggttgttttatttaagggcattgacttctgctcttcaatcactcgtgcaaagattcccaatcctgatgaggctgttgcttacggtgcagctgtgcaggctgctttgttgaatgaaggcattgagaatgttccaaatttggtaagcatatatagaaaaccttgtgaaaaaaatgttgttgctattgtgcctgcttatttgaatgactctcagagaaaagacggtgccaatgttgctgatgccactgctggcctcaatgttatgcagatagtcaatgagcctaccgcagcttttgagttcaagaggaagaatgaagcagacatcagtgataaccgaaaagttctaggaaggttgagaagtgcatgttag

SEQ ID NO: 17625 - DNA, 267 bp, Glycine max
  Peptide Sequence Number=SeqID_109310
atggatgccgagaacatattaagtgctcaattgtgttctattttttgggttctgcaactctgttttgaagacagatctctatgtactttgatgttcaggataattgttcccccggaacttggatatcctgagaatgatttcaataagagtggcccaagaccaacaacattctcggtctacttatttacagaggatgagaggatacatgcaaacaactgtcctgtagaaattttgttaatattgatattagatgcttgtgtcaaatga

SEQ ID NO: 17626 - DNA, 1452 bp, Glycine max
  Peptide Sequence Number=SeqID_109311
atgatggataaggaggaagcaacaccattgttaagaaagagtgaggtggcaccattagaggatgatgatgcattttgtgtagagcttaaaagggtaggctccatggcagctccaatgctggctgcgaatatgtgtcagtaccttctacaagttgtgtcactgatgatggtgggacatcttgggcttcttgtctcattctctggggttgcaattgccatctcttttgctgaagttaccggcttttgtgttcttatgggaatggctggtgcattggaaactttatgtggccaaacctatggtgcagaagaatttacagagattggaaactacactttttgtgcaattgtcactttgcttttggtttgtctccccatatctctgctgtggatattcatggataaaatactattgctgtttggtcaagaccctgaaatttctcatgtagctcacaagtactgcatatgctccatccctgcactgtatggatttgctgttcttcaatgtcagatccgctatttccagactcagagtatgatctttcccatggttttcagctcaattgcggttctgtgtttgcatgttcctatttgttggggtctggtattcaaattggggctgggacatgttggagcagcatatgctattggaatttcatattggttaaatgtcattgggcttggaatttatatgaattattctccagcatgtgagaagaccaaaattgtgttttcatttaatgctttactaagcattccagagttctgccaatttgctattccttctgggctgatgttttgttttgaaatgtggtcatttgagctacttacattatttgctgggcttttacctaatccacaacttcaaacctcagttctttctgtctgccttaacacaacaacattgcactacatcattccatatgctgttggagcttctgcaagtactcgcatttcgaatgaattaggagcagggaatccaaaggcagctcaaggtattgttcgtgttgttgtgattcttggaattgtcgatggggttattgtcagcactttcttcgtttgttgtaggcatatattaggatatgcttatagcaatgacaaggaagttgtagattatgtttcagacattgttcccattctttgtggatcttttactgcagatagtctaataggagctctttccgggattgcaagaggtggtggatttcagcaaataggggcttatgtgaaccttggagcctattatcttgtgggagttcctttggcattcttattgggttttgttctacatttcaatgccaagggactctggatgggaagtcttacagggtctgttctacaagtgattattctgactgttgtaacagtgttaacagattggcagaaagaggcaacgaaagcaagggagagaatagttgagaagtcaattaaagttcataatgattcagtgatatga

SEQ ID NO: 17627 - DNA, 1206 bp, Glycine max
  Peptide Sequence Number=SeqID_109312
atggaggctggtggtatgcttctcaaacgcctttatatagataggaacctaaggattggggcaatgcttagaactgttttgcctgcattggctcatgctgttgctatgaattcttgccctactttgcaccaagaaggaactgcagaaaatataaaggagaaactacaggatctcatagttccatctctcatgaacaaaggcattgatttttcagtttcaagtttatcaatggttccaggaatccctattaagcctatgctagcaaaaaatggggacgaatcaacttcaagatttcctgatctgattgacataattaaggaatccagcaagccggttgcatcaactttcataatggatgctgaaattgttggtattgacagaaaaaatggatataggattatgtctttccaggagctatcttcacgtggaagaggtggcaaagatacattagttacttcagagagcattaaggatttgttctatgatgagaaacctgggtattttgaatatgcaaaagaaacaactgttgaagcagatgatgcttgcttaacctgtgaagccacattaactaagataaatgctttcctggaagatgctcttcgctcttcatgtgaaggaattatggtgaaaacattggatgttgatgctgggtattctccatcaaagcgttctgacaaatggctaaaagtcaagcgagattatgtggaaggattaaatgatactcttgatttagtaccgattggtgcttggcatggaaatggaaggaaagctggatggtatagtccatttcttatggcatgtttcaatcctgaaacagaggagtatcaaagtgtatgtcgtgtgatgtctggattctcagattcattttacatagaggaaattgatattgcggtgcagatgaaacaattcttctctggggacaaagtcttgtccaaaaaaccaccatattatcaaacaagagaggcaccagacatgtggttttgtccacaagttgtttgggaaataagaggagcagattttactgtatccccagttcatcatgctgccattggtttagttcatccatctcgaggcatctcaatcagatttccaagatttattagttgtgtctcagacagaagcccagaagaatgtagcacagctgccgatataggtgaaatgtttcattctcagactcggaagatggatatcacaactggagactga

SEQ ID NO: 17628 - DNA, 2124 bp, Glycine max
  Peptide Sequence Number=SeqID_109313
atggatggtgtaaagcttggtagcaaaagagttggatcagttaatgctgctgttaacttctatgatgataagaagccctcttcaagaacaaaggaactccacagagcaagaagggatattggaaggtacaaggagagcaaatggactgcagaatctgcaaaagctcaagcagaatctgagctttcgaatgcgaagaagacagcaaaccatctttcttctatgcttgaggagtcaaattacaaggcaaaaacacaaatgagagatgtagaaagactagagaagtgggggaagggccaacatgggacaattgttgttgcaaagaggaatgaaaattttgagtatgcacaagtcatgagagagttggaatatctcaaaaaggaactgttcaagcttaagcttgatgtggcttatgtgatggaacagaaatcgcgggcagagaaggaaattgaagcatcaaactcgaagatgctatcatgtttaacaactgcagaagaacttagaagggagattgaggaggccaacgaggagcaagtacttgctgaactggccaggattgaggcttcgaaagaactgacagatattgagacccagagaaaacaggaagcaaatgaattttcattcaaattggaaagcacgaggagaaagttgaaggaggccattgaagagattgatgagtcaaaggagcttgaaatgaaattggctgtgacaatatcagatgttgatttcttgcagaatgagttaaagtcagttaaggaaatggataaaagggttcaaggagatgggagtgcaaagcaattggaaggaagattcaaaaaaggggaggaatcagaagactctatagtgttacaaactataacagaagaattggaggcagctaggaaagaattagctttggttagagaagaaggtttccagtttatggcctctttggatgtcataagaaatgagttgaagcatgtcactgctgagacagataggttgaagaagaaggaagggaaagtagactcaacagttcaaaatctcaatttcaagattttgagagcaaagtctaaattagaagctgtgtctgctgctgaggaaaaggccagatccatagtcatgagtctgtctcatactcttgaaaagctgaagacagaaacagaagaagcaaaaaaggaaaatgaggatgtaagccaggaggttgcagccaccaaggaagaaattcaaaaagttgagttggatatagacacgaccgaggaaagattgcaaggcgtcatgcaagagctagaagtagccaaagcatctgaagctctagccttagagaagctgaaaactcttactgagaggaccatgagagaaagagctttaacagcacagcatagttccatgatcactatctcaaaatttgagtatgagtatctaacaaatcatgcagcctcagcagaagaaattgctgataaaaaagtagcagcagctgaggcatggattgaagctctcaaggccagcgagaaggaaatactgatggaaacaaaaatagctcaaagagaactcaaagaatcaaaattggagcaagagctggaggtttacaccaaagagaagatgctttcaagaagagttagtagtagtgaggagcttgacaattggccaagaaaacgcgagaagacttcatccaagaacttccagagagccttgtctagaaagagcatcaaacttaatggcactataactcctgcaaggggagcaaagtttcagaagactgcttcacctgcagctcggcatatcagtccttttactattaagaagagaaagaagaatagcacaggaggttccttgtcctcggattcaaggggttcttcatcctatgttcttaacaacatccaactagctagtcgtaagaagttaataccatatgacccatcatctcaatgttttgaagacaaaaagcagttccattgttcagcttggaatgctaaaaaaacaatatcattgattactcagttctcccctgcaactttagttaacaagtggctaataccagctgttagggctgatgatgaggtcaaagatgcttgtagaatgctgacaccctgcaccaacatcgtaaagtttactgtaactgcaaaatcttctggcaaaccaatctaa

SEQ ID NO: 17629 - DNA, 927 bp, Glycine max
  Peptide Sequence Number=SeqID_109314
atgaagcccaaaaaaataacaagtgaatgcccattatccctattgaacccggtttcaaactttcggaccccattcctttcgtttcgtcgccacttccgaacgcgtttctctctgcctcttcacattctcgccgtcgctgctaagttcattgaaccagctgaacggtttcgaagtgttctgttgcagcagttaggttcgcggcaaaaaatgataaagaggaggttctacaagctcgatcacggtgatagagaggccttggatccgtcttcttcttcttcttcggactccgagattgaagccgaagccgaagtcgatgcctctgaagaagaatcagaggaagatgtaacagcagaagtgaaaccgaatgatgatgaagctggttcaacttcttctgggtatgcaagtgaggatggttctgccagtgatgttgatgtcaactcagcaggtctgttatttagtgaagatgatgctggagctataaatgaaagacaagtgcttattaacagggagttgctgattaaatgtgatactgaaaagtctaatgtcttggctgaaaagaaatccttaccgacagatacgccatcctgtgtcttaaaatgcaaatcagtatttaagtgcaagatatgtccccgaattatctgtttgtctgaggagactttgcgggatcatctgcaatcaaagagacatgctcgatctgaaaaactacttagtgaaggtagactgaaggctatgctcaacagtgatggtgaaattgataatcaagagatctcagagatccaaactaaagatactgaggataatgctgagaagaatcacaaaagaaaaaatcagcataaaaagagattgagaaagaagaaaagtgacaaagcaaacacaaggaaaatactgtcaacaaaaggagcagccaagagagggcgaaacaaatga

SEQ ID NO: 17630 - DNA, 786 bp, Glycine max
  Peptide Sequence Number=SeqID_109315
atgaaacaactgcttcttgagccttgtttcatcttcattttgttggtaatctcagttaccaacactccaacttgtctttgcgtggatgatgcgagctacaccaactgtagtaacgcttttagctgcggaaataacaacttcaacctcaaatacccattctggggagaaaacagagataaccattgtggtggacctaactcggagtcggagaaactcacatgtgaagctcaagtccccaagataaccatcaatttcatcaaataccgtgttcttggctgggaaaacacatcacagatactcaaagtcgcaagggacaattattgggacaataatgtctgtgtcaatggtgacaggaacagcacatttgataacactccgtttcaatatgattatgatggccttgttaacgttacgctcttttatgattgccctgccagttcttcacctcccactatttcatcgcttccagcatcgtctgtgcttacttttccctgtggtggtgctgtctactacactgtccaacctttaccttcttcgtacgagtcgccctgcaatattgttgtgattccaatctttaacgattcactttacactccggatagaatcattgaagctttacagggaggttttcagattgaatggacgggaaattatgacaagtgcgagaaatgcactggttctggtggagagtgtggatccgttgatggaaatttccaatgtttctgcaaggatggacctcattctgcttcatgcaaagataaagtcgtagataccaggtgggagtaa

SEQ ID NO: 17631 - DNA, 1347 bp, Glycine max
  Peptide Sequence Number=SeqID_109316
atgctctttctttcctttcatccttctctgtttccaaattcatattctcgctttcacatttcctcttctctgcccccaaactccaacaacggccataatcatcaacacacttcaccttctcaagttcccatcaaatcccccactcctccatggatgaaggttcctcttcttcttcaaccccacgagctcgttgacctctccaaccccaaatccaagaagttcaagccggaaaaacacgaactttctgataaagctttgatgggcaaagaggtaagagggaagagggccatgaagaagattgtggacagggtggaaaagcttcacaagactcagaattcaaatgaaactcgagttgattccctcaatgttgaaaactttggagggtatttggaaattttgaaggaaaatgaggaggttaggagtaaggggagaatgccatgggagaaggatgagaagtttggttttgtgaaagtgaaaagggaaaaagctgtcactgctgcggagttgactcttgataaggccctgcttcgaaggttgaggaatgaagctgcaagaatgagaacatggatcaaggttaagaaagctggtgttacacaagatgttgtggatcagattaaaaggacttggaggagaaatgagcttgccatgattaaatttgatatccctttgtgccggaacatggatagagctcgagaaattgttgagatgatcgaaagatgggttatagaaggccatgttgatccaatgtctgagaagggtgtgacttttggggttgtggtggtgacaaagactggaggcttggttgttttgagtaagaaggattttcttgtggtttaccgaggatgcaatcatcagttgaccactaaaggttctcctagtctaagaacaaaccattatgaaatgaatagggtggaattagctaccaaaggtgatattttccgggttgaatccaaccacagttcgagtgagatgctgaactggaatgctgatcataaggattctatatcaactggcatccaagatgtgaattgtcaactggtcaatggatcattgtatgagagggaaactgagagattattggacggcttaggccctcgctttattgattggtggatgcacaagccacttccagtagatgctgacttacttcctgaagaggttcctggatttcagcctccatttcggctttgtccacctcattctagtgctaaactaactgattatgaactaacatacttcaggaagctggctcaatctttaccaactcattttgtccttggtactctactgcttcctgcaatccttcaatatcgttttcaagctgagactacatatttattttcttga

SEQ ID NO: 17632 - DNA, 476 bp, Glycine max
  Peptide Sequence Number=SeqID_109317
atggacggctttggagatatcttgcatgtaaaaggacaaggaacgtctcgacatgcccttcacgttttcaacgcatcttcacgctttcttcattcctcttcttcccgaatcccgcgcaaagcacctccttctgatgtcgtttacccttcctcctcctctttgctctccgacctcgtctcttgcgccaccgacgatgcccacatccgtcgcgttttctctcgccacaagcgagacctaacctcccccctcgttcttcgcgttttgaagagctacaagcaactgggtagggctaaaaccttgaaattcttctccttggccgggacccacttaggttttcgctttgacgattccgtcgttgagtacatggctgatttcttgggtaggaggaagctctttgacgacatcaagtgcttgttcaatacgatgtcgtttcataagggtcgagtttcgcccaaggcattgtccatttgcatcag

SEQ ID NO: 17633 - DNA, 2835 bp, Glycine max
  Peptide Sequence Number=SeqID_109318
atgaatgattctactgtgaagaatttggccatcacggagaagaaggtgcagcagcataaacctggtggttgtgttggcattttctttcagctcattgattggaagaggaaactctccaagaagaagctcttctccaagaagcttcttcctcctgctcgtgcgaaaaagtttaagggagatgaaaaaatgccaaattccaagcttcacttgattgctaatgagaacagtggaggttttcctggtgctaaaaaagttgggaatcatggtctagatgtagaacaaaagagtgaaatgcgagttccgagtctggtagctaggttgatgggtctcgaatctattccggcagctcagcgagacaagtccaagaaagccttgtgtgctgatgggaagaaggaatctttgggtgaccattgtgagttggataggcaaggcgtggatttggaaatgggagttgtaaagcatgattcaagacctcagaagcttcagaaaactgggtcatatgagagaagggcggtgaccaggtttggagccgaggcactgcaaattaagagtgttttgtcacgagcaagaaaatataatcaccatcatcatcagaagcttgcttctttgagaaccccaagaattccttccggaaagagtgcttctcgaagctctaggttaataggagcagctacaaaaattttggaacctggactgcaaagcagaagtagagctaaaaattctcttacatatcctgcttccatgtatcctcccaagactggcattgtgacaaatggtgtggaagatgggtcagcgattatgcaaaatcaatcttgttttgaaaccagctcatgcaagcaattgatggggcagacctcttgcaaaaactgtggtaatttgctagatgttcttgactgcaagcttgaggttgggagacagtcattggttcctccacccattgtttcagatgtgatcactgctacctctatggtatcattagagaagaagggaaagtcattccctcctcatggacatgaaagagatgtagttcttccgagaagtcaggaaaagctcatatctcttgttactgaaggaaaaggaaaaaataatgcacaacaatcatggagtgaacccactgccagaagaatgccaatgccccatgacggtccagctaaatggaattcatcttgccaaccatcaagggccctagaggatgatgcatcttcttttgccttaaaacacaaaactcaaacacaagaacagatgttaagcagtgaaagatattcatctgggtctacaacgagtgatatgcaagtaaaaagggtatcatcatctatgagtgctgtgaatggaactaaagattttgttgctatgaatagaagtctaagtggtcgatcaaggataaggtcacttaccaaagcggatggttccaaatttgacctagagaaaaaaccttacaatcgacaacagagttccttatctcacgtaaggacattagagagaaaaagaaggattcctaatgtcacacaactagaaggtacaggttctgtttattcagttggtacaaaacaaagaaatctccattctggtggaatgggtggcaaaagaagggacttcaatgcttcttccttgaacaattctattgtaaaaaataaacaagatggtcaaggagaaagagttattaaggttaatgacaataagatcaatgatgtagtgtcatttacatttaattcctccttgaagcaaaagatagaaatacctggcaagagggaagagacaagcagcgacaatgagagtatggtgtatttccaaaggccttcgcccttgagagttgatgctttaggtgcctttcttgaacaaaaattgatggaattgacctctcaaagagatgaggagttggctacaggtgctccacctaaaaaatctagtgccatgattcttcaagagctgatatctgctctaagttccgagcatctgatctgtcatgatggtcatcacatgtttaatgaaaatgtttgttttcattttctagaaaaaggacatgttcagctgatcagtgtcacagcagttatacctgacattgtgtttccttccttttttaccagtatggagcaaaacaagaaagggcatggttttcaccctgaccccatgaattactcttattatggtcaaccggaacatgatactgaactttcagattctgcaacatcctttaacaaaggaaggatggatgagatactgagtgatgttgtcaaccaaattccccgggcattagaaagtttgctcacttttgggacagaattgacacgaagcaagctcaaccatatgaaggatattctcttgaattctgagttggtgcttagaattgcaactgaccgcagagaggatcaagggccacaacttctaatttatcagtttctcgttgatgatcttgacagtatggtgagtgatgctatgtggacagatgctaatggcatcgtgggttgtgaggattctaaacagagaaaggagctaaaggggtttcttcttgattgtgttatagaatatctagaatcaaattgctgccaatattttaactctggattcaagaaatggacgaagctgcccttgtgcatggaagctgagatgttggctcaagaggtgaagagggagatcaacaagtggttatctatggttgggatggtgcctgatgaaataatagaatgggaaatgagccactccttggggaaatggactgactttgacattgaagcatttgaggctggtgttgatatagatggggatatacttcaaattttggttgatgaagttgttcaagacctgcaggttgcaagcaggggcaccatttacttctaa

SEQ ID NO: 17634 - DNA, 375 bp, Glycine max
  Peptide Sequence Number=SeqID_109319
atggtacatgggtcatgtggaattctgcaatctaagtctccatgttatgacagagtcactgttgttatttatgatgctaatgatgcacttgagaatcctatcactcaaaatgatgagattaaagaatatgtagattgcagatatatttctccatgcgaagctacttggagaatttttggttttccaatacatgctagaaagcctgctgtggagagattacattttcatctgccagggcaacacaatgttctttatgaagatgatgatgatatagatgatatcctgtcaaagccaagcatttcagattcaaaattcttagcttggatgaatagcaacaaatgtttttcagaaggtagaaatcttacttattcataa

SEQ ID NO: 17635 - DNA, 1343 bp, Glycine max
  Peptide Sequence Number=SeqID_109320
ggtacatcctttgtggtactagtagagggtacatctacttgggttgttgtgactgagaacaagagagggtacatctcttgtggatcagttcaagtggaggatacatccacttggttgttacaaagagagcaagggagggtacatcccttgtggatctttgcttgtaaaggattttacaaggttgaaaagaaatctcaaggaccgcagggtgcttggggactggatgctctttggggagaggttagcgcttgtctgaattgggcctcttgtttgacttgtgcaagtcggccttggagtttgctttgcacttttcgtgcttgtgttcggcttgacggacttctttccagaatttggacatttcttccatctatatgtaacccttggctcactcgtgcagctcgtccatgctaccgaattttcgatctagatggtcgtgcgcccaaatttgtccatgaattttctgaggaactcgtcgtctgcttgtggcagaatgtccaaggtgatcaaggttatgcggtgaaacatgttggtggcatacttcgcactgaatcgttcgacgaaggtgtcaaaactgtctatggacctaggcaaaagtctaccgtaccagaaatatcttctcgtagttcaattgagtcatctgctggtaatacctttgctgaagatgtgtcatatttgagtaatttgtgtcaagtggaaagttcacttcgtgtagaggatgataatattgagacaacatattttgtaaggagaacatttgtttcggaagccatgaagatgagatatgtggtggtttcaatgtgtacaccacttatagaagtaatagatctcatgcttgcagagaaacaatcttgtgtagtaattgttgatactgatgatactttaatcggttttttgacgcttagagacattcaagagtatgctacacctgatacggaacttcattatgctcaaatgataatgaagaagcgcagattcaatcatgttcctgttgtgaggaatatctatgaaagaacctatccagttggcattatagacccagagagtatcagtctaacatgcaggattgagaaattcaatggaaagaacagcttcaatctgtggcgcatcaagaagcatgctttgttgaaggaacaacgtgtttgggctcctgttgcttttgcatctgtgaagaaagaagtggcttttgaatcaaaagaaaaggcctctgtttcaaagactgaagaacttgcagaacaagaagaaaaggctcactcactaatcttgctttccttgtctgatgaagttttatatgaagttgcaaatgaagaaactgcaagtggcttatggctcaagctggaaaagct

SEQ ID NO: 17636 - DNA, 2394 bp, Glycine max
  Peptide Sequence Number=SeqID_109321
atgatgagagagagagagaaacacgttagagagagagagaaagagagtcagggggagagacaggcactctgtagaggaagagcgcctgagagagggagagcacgtcttttagagagacagaggggttccctgagaaatcgagagcctgcaagagaccgttcttatgacaacaacagtatacacagacgcagcagggagagggggagagatagagataggcgatacgtggaatatctcccacgttgtcggagcatctccagaaagacgcgacaagacgaaacatacggaagctcgaagggggggaaccaggaacataatagacaggatgctgaacctgatcaggaagtatggaccaaggtgacaagaaggagggaagcaaaggcagcaaagaagaactatacccagaacagatctttacataacctatcggcaaaccaccccagctggagagacaaggaggatattacatccttttacttcactaatttcacagacaacgttaatgaagtgaggctctgggggaagtttaagagttggggagatgtgcgtgaagttttcattgccaaacgtcgtaacaaggagggaagaaggttcggcttcgtgaggttcaaggacgtttcggacgtaaagcttttggagacgcacctggacaatatcttcattgatgaccataagctgttcgttaaccttcccaggttcacaaggctagcgtcgaatgctcatacgcatacaaaagtagataaaaaggaaaagcaaagtaaagaagctgtcaaggattctcaggccactaatagacctcgggtgagatcatatgtggaagtggtggttcagaaaggaggcttaggaggaacaacgacagctgtagatggcattccaacaattaccatcgtacctaataaaggtcgggaagtctggtgtgaaggggcttgggttggtaggttgaagaaaccgatgcaggcggagaagatggaggactacatatcgtgggagctgggatatagcatcagcgctagatccctcggagacgacatagtactaattactggtctttcagcggataaggcccaacagcttatcaactcagagacgaatggtggcaataccctcttttattccctcgagaggtggcgtccggggtacagggtatctaatcggatcgtgtggcttcaagtatggggtttcccgattgaagcatgggaagtggaccatatgaagcaggtcgtctcaaccatcggagacgtgatcgaggtcgatgaagacactgaggacaggagaagactggatcgtgcacgactgctagtacgaactcccctgccgccggcgataatcaaggaaacaatcgttcgttgtggtgaagaagatcacagagtgtggttggtggaggaggtaggtgacggcggggacatgcggagaaccagatcatccatgtccggcgagtggacggaggaggtcacgtcggaggaggagggtgttgcggaggaagacgacgacggtgacaccgcattttccttctcgccggagctggcagtaaccaacaacaacttcttcttgaaccaccagtcaaaagttttacccagcggtccgtgtggccaaactcgggatcggtctgaaccagtgggcaagagtccaaatcctgatagttgcagacttaacgcaggcggcgcagcaaggcactctcagggccctactttgacaaaggttgaccaggggtatgtgtgtgcagaggagatgcagggaaatctttccccagtggtcataacctcggaacctgagttagacgtgcttcgaaagtctgaggaagaccaaaatggaaaagtttcaaattctgaagaacctataggtcagcagtgtattacccatggggattataagacatgtgcaacggataggggagacttttatgacacaggtcacatacagggtcaaaaaaatgttgggccaagttccacttcgggcctaataacgaatctggaggagtgcataaagaaaaaacatttaactatgacccagactgctagcaggaacatggacggatttcctaaagtttatgctaggcagcggaacggcccattaaagggctgccttcttaagcctgtagctgaagaaaatacactggacatggaggacaaggctgctcccgacccaaaggactctctcactaaaggtcctctcggcaggaacaggggagagatgaagggggaggcggaggaggttaatagtgttgatgggaatcccttggaagaccttgaagatgccaatcagcagtggacccttgcgaaatccctgggtcttcagcatgcatcagatcaggaaggcattcacagcttcaagaacatggagactcgggataggaaagaggcattacagctgggaaacaggagtatccataaatga

SEQ ID NO: 17637 - DNA, 489 bp, Glycine max
  Peptide Sequence Number=SeqID_109322
atggcttctgcttccacttctgctcctcctcctccccctcctctgccaaggaatgatggctctctgctaggttcttcgacggttatcactgccaaggagtttttgtactccatctcacagaagcttaacaattccaattatctcctttggtgtcaacagcaacaggatcagccccttctgtcgtggcttcaatccactatttctggcgaggcgattccagtccgaatccaaggaatcggtcttgaatcgcaggaatcacaatttgatgatgaatcaaatgattttggcctagcaggtcatgattccaaaccgggttttctgatacatgatttgtatcctgattcaactaccatgtttaggactgatgctacattcatcccaaataaggttccattgataagtagtaaaggcacagcagctgctcgtcgtgcaactgcaaaggccattgctaaggcaggatcctctgacaaaggcaacctaaaaccataa

SEQ ID NO: 17638 - DNA, 558 bp, Glycine max
  Peptide Sequence Number=SeqID_109323
atggagaaacttactctagccatgaaaattgaaattgttctgattcttgtcatacaacacaaggagagacaagcgaagaagaacaccgatatagatcaaagtcaaaaagttgaacaaactatcgattgcatcaacaaccctggcaatagtttcctccaagatctccagaccggggagaggaggaagaggtctattgagaagattcggttagatgtaatccatcaggtgcttgggtgggttgctcctgcgtttgggttgttggtgcatgttctcaatggcacgtttagagcttggttcctaatccctaacaaagaaccaatcacgcatgccatattgaagtgtctaactgttcaattgatttggtttgcatcatatttgggaatccgaattgagctacttgaccatctaagttttgcagattggtcatatcagtattttcaattgggggaggatgaacttttggatcacatcgttgcaattgcttgggcaatatggaaaagaagaaattgttgggtatttaacaacaaagaaatccattttgtccaagttttggcctaa

SEQ ID NO: 17639 - DNA, 591 bp, Glycine max
  Peptide Sequence Number=SeqID_109324
atgagggggtgtattggaaaaaattcaagtttcatattggctagagataaggcaaagatagaatttagaaatgagggacaaccctcaccccatgagctagcttttggggttgagttaggaaggcatgtgcattccaggtctgtgctagaggttccagtcttttggttcatttacagtgaaccacttttactcgataaatattttcaggcaaaagcactgtctgacatgattattgtcgttcagtcagagccctcgtcctgggaaagccatctacattgtaatgggcattcacttctgctgaacttgaggcagcctataaaagctgcagtcgctgctactgctgagcatcttgctggtttgcttccccttcatcttgtctatggacaggcccatgagactgcaattgaggactggttatggtcagtaggatgcaaccctttttccattacatcacaaggatggcacctttcacagttccagtctgattcaattgctcgaagttatgtcatcactacccttgaagaatcaatacaactgctggaggtggcagcaggaaaaggtctccaaaagagctactggaaagatctctga

SEQ ID NO: 17640 - DNA, 174 bp, Glycine max
  Peptide Sequence Number=SeqID_109325
atgtctttattgagttatcaaaaaccaggcgagaaagcgttttgtagtgcagaatgccgtgagacacacattagcattagcaacgatgatcaccaagacgtagtcaagtgcagatctcgtgttgtagagcacaatcctgtcacactcacatcttctattcttgctgcagcatga

SEQ ID NO: 17641 - DNA, 1953 bp, Glycine max
  Peptide Sequence Number=SeqID_109326
atgcctgcatatgctaaattcatgaaaaaggtcttgacaaagaagaaaaacattgaaaaggataacattgaggtcctagttaagacgtcgacgaccactgatagatgcaccattattagaggaatgagaaacaagggtagagcactccctgatagacgtggaaaagtttccaaaagtatgcagtgtggagaaacacaacaactgctcctaaaccatgtcatagactattccgcaatcaagcaatcgagcttacctcggtatgtctacatgtcagcattctccaacttgatgtttgttaaagggggctttggtcttggaaccgcaactgaacagcactgcctaggtgcaggtgctgtagttggttgtgccaatgagtttttcgcaggagataaagggtcgtttgtgaaagtcatgacagaggaagcagatccaaaattagatgaagccatcgccaaagagcaactaaacacaactaaaaggagccaaacagccaaaaaggatcattggaggaacaggagcacaccggagatagagaagaaagagagatacagtgagagctggagagaggattcccaccagaatcatgccggaattaggaatggtcataaaccaagctacaatcgagttaattggaggggttggaatgacattatatcgttctacttcactcgttttccaaaggaggccactgtgaaagacttatggcaccatttcaagaagtttggtgatgtaagggaggttttcatctccaagaataggaacaagaatggtagaagatatgggtttgctagattcaaaggcgtggaggatgtgcatagtctcgaaaagaaacttgatgacatcgtctatggtggcctaaagatgggagaggaggcaattcggttaaggcagctgcaacccaagtcgaacaaagggtcgtatgtggaggttgtgtcagggaataaaagtggaacaggctcaaggagaccagtaggtagtgaaattcgcagttatgaagggtcatggtcatcggtgtatcttgatgtgccggaaactgagtttacccgggtcaaggaggcatgggtagggaggttaaaaaatttggccatgtttgataaagttgaagatgatttgtactgggacgatggagaagatgtagtgccgaaccaagcagatgacagaggaagaacagtaagaggagctacccctttctactccctggaaaaatggagcccgaagctgtgcacggggtatagactaacgtgggtcaattgctggggtataccactattggcttgggacaccaaacaaataagcaagattatggctgccattggtgatttggtggacgttgatgacgatgtcaaagtggttaggaggctggacaggacacgggtcctgctgaaaacatcacgaagaccactcaaacaacacatagtcaatgtacatatccatggggagatgcacagtgtgcatatagtggaagaaggcagaagtaacccagagaggggtcattgcaggcgatggtgtgagtatggatcatcggaggagatacaaacaatagatagtgataaggacgatgaatgcgatttcacgatggcactcagaaatgctgaagtgcagccattatcaaatgaggcgctgccggaggggggatcgagctatgtacctgggcaattacctaaccgtcgcgagatgatgttggcagctgagcaggaagcgtcgccgacgatggacgcggcggtgaactcgaccgagcaggactcgacggtgtacgaagctaaagaagaggagctcgcggctgcagccaaagaggaggaggtggaggcgctgccgtcgggaacagtgttacacgctaccacccaattatccactgaacaaaggataatcagcaaccataagacaactgcattacccagtggttttctggcccaacggctaatgaaatacgtcagggcagacaaacgtgcttga

SEQ ID NO: 17642 - DNA, 4902 bp, Glycine max
  Peptide Sequence Number=SeqID_109327
atgggtattgagatggagcaaccctgtgtggagctttcaaaagttgcagtttctgaaactcacggggaagattccccttattttgctgggtggaaagcctatgatgagaacccctatgctgaattaaccaatccctcaggagttattcaaatggggttggcagaaaatcaagtttcgtttgatttgcttgaaaagtacttggaagagcattcagaagcttccacatggggaaaaggagctcctggcttcagagagaatgctttgtttcaagactatcatgggcttaaaaccttcagaacagcaatggcaagcttcatggaacaagtgagaggtgggagagcaaaatttgaccctcaaagagtagtactcactgctggtgcaactgcagccaacgaactcttaaccttcatcctcgctaacccaggagatgctttactcgttccaaccccttactatcctggatttgatagagatttaaggtggagaactggggtaaacatagttcccatccactgtgacagctcaaacaacttccagattactcctgaagccttagaggcagcatacaaagatgcagaagccatgaactccaaagtgaggggagtgctaatcacaaacccttcaaacccattaggtgtaacgattccactttcggttcttgaggagattcttgacttcgtgactcgcaagaacatccatcttgtctcagacgaaatctactcgggctcggttttctcttcctcggagttcttcacaagcgtggcagaagtcctcgaggctcgccaatacagaaacgctgagagagttcacattgtctatagtctctccaaagaccttggccttcctggtttcagagttggcaccatttactcatacaacgacaaggttgtgaccacggcgagaagaatgtcgagtttcaccttaatatcttctcagacacagcacttgttggcttctatgctgtcggataaggagttcaccgagaactacataaagaccaacagagagaggctgaggaagaggaaccaaatgatcattgaagggttgagaagtgcggggattgagtgcttgaaggggaatgcagggttgttttgctggatgaatctaagtccacttttggagaagaataagccaaaaggaagggaaggtgaattggagctttggaatgctattctgcatcaagttaagctcaatatctctccaggctcttcttgccattgttctgaaccagtggtaaaattgtgccttggtgacttgttggtcatggattcgaatctggaaacagcttctttgcatatgcaaggggcgagccctggtgcagcggtaaagttgtgccttggtgacttgttggtcatgggttcgaatccggaaacagcctctttgcatctgcaagggtcaaccatcgaccaccctttccttttaattcttcccacaaacatgtcacgcgccgctgcttcattcggaattctcctctgtctgttccttgccgccgccgccgtcgtcaactgctccgatcaggcaaactgcagcaccacatgcattgcggagcagtgcgacactgttggaatcaaatatggcaagtattgcggggtggggtactggggttgtgctggcgagaaaccatgcgatgatcttgatgcttgctgcatggcccatgacgactgcgttgacaaattcggagtgtccctacagcagagctgcacctacgatgataagaggcatggacttggccatcttgctaagccaattggcaaaacgacattgaagctcgccgtttcacgcataaagcttttgaagaacaagagagaagcccaaataaagcaactcaagagagagttggctcaattgcttgagtctggtcaggaccgaactgctagaatccgggttgaacatgttgtcagagaagagaaaacgatggcagcttatgatcttgttgagatatactgtgaacttatcgccgcacgcttgcccatgatcgaatcacaaaaaaactgccccattgacttgaaggaagcagtttcaagtgtaatatttgcatctccgagatgttcagacctaccagagctcatggatgtgaagaagcaaatcacatctaagtatggaaaagaatttgtctcagcagctattgaattacgccctgactgtggtttggttgagaaattgtctgccaaagcgcctgatggtccaaccaagataaaaatactggccgcaattgccgaggagcataatatcaaatgggaacccaagtcacttggagaaaatgatgtaaagtcttctcaagactttttggttgggccaagtacttctgaaaaggttgcttatgctgaaccttctcaaattcatgttccacctgctcatgatgaaaagggtccttccaatttacatgctccctcacaagttaaaccagtgcatcattcatctacaaattcatatgagcagactgcaagtggtgctgctagaaaggatcaatcaacaacatcaggcgtgtccaattcagaagtcggatcttcaggaactggaagtcaagaaacgaaatttcaagattcatactctggaaacaatagttcttttcctatgaataggcagaattggagcatggaattcaaggatgcggcctctgctgcggaggcagctgcagaatctgccgaacgtgctagcatggctgcaagggcagctgcagaactttcaaaccgtgaaaatatgacaaggcagtattcaagtggatcacatagttcttctagaagcgggttgagagatgaaagatcccaagaatacacttttcatgatgacaaaaatctttctacaagtcctgttgatgctagcttccatagaagcagttctgggatgcacaatgaacaaattactgctacagaacaagataatctggtaggaccgcccaatgaatattacaggaatagtcatgagaatgtggtgagacatgcccagtcagcttcattgatgcctggcagtgttttcaatgatgataaaccatttaccgatggttctcaaatggctgatatatatcagcataataactcatttgggcaaaagagtagtgacttacccgaaatgagtataaaaacacaagcaggcagaagtgaagaagattttgtgactgacctatatgatgacagtgatttgaatgctgaaaacaattatcactttggagatgcaaggacaaatagacaatctagtaaagtttcctcttctcatttcattactccaactgatgatcacaatgataatttggacttggatgactggaatacgaggaacaaagctgtggaagacccttttgttactgatgaagtaaacactcagagaaacaatatggaaacaagttcttataatgatactactgttgtatttgatgattctggatcagaggatgatgatcataagtttgatgttgataaaaagtacaatggtgagggatctagtttgtttgtctcatcccctgctagcaaatcacaagttgatccatttgaaaatacaaattctttggcctatggacaaaacattgatgagaaagtgacaagttctggtacacagtcacatttttctgtggtttctgaaagattgacatctgcagtttcttctgaaaaagaagacttgccatctgtcacttttgatgattcagatgacccaggttcagatagtgacatgaattttgtcaacaagtctaaggtttctgggctctctgattatggaaagtttttccttgatccgattgcaagccatggggttccagggtcctcatcaagaaatgagaaaaatgtgggcactgacagaaagtcttggttgtcacctttgtcagttgattcagatactgtggaagagcattttgagagaagggtagacaccactactgtgtcagaaaagaatttgggttatgatgacttgccagccagtcagccacctacaaaggaaagaagctctatattgggtttggatctcgaggcaaacaatgatactgaaactctggaggaatatcataaagagagtggcaaggaattaagctatggtaccttgaagggcggtcttcgcaataaaggcttcaagcgaccaccttatattaagaatacactggatgatgtttcatcttcattgggggacacttcagtccagaatgaaggatctttgcctacagcaaggacttcaattggttctgatgctcgtgttcaggacaagtacacgagggaagtgagcagaggaaacaggaatgtgggcctgggagcgcacaaaataccttctgattctgatagttaccgtgtggttgcaaattcacaagagactcttgctagtactaatgaacctcgcattcaaaaagagcagagggaagtaaaaaagaaatcaagctcaagggcctctgttacatacttcggttctgataatagtgattctgaagatgaacttactaaacaaaattcacctagtcttgcccgtcctattagtggaatatctcgaaggacatcagcttcttctaaagctgctacaggtttaagctcaagagatgctcctttatccaaggcttctgtgacttctgctgcaacacttggatggaaatcttcaaggacttcatatgagagtaataatcaaaatgcttcaaccataatgaagagctctgaaaatgggacaggatctaagcctggatcagccaaaaacaaagcatccgagccaatttcagaacctaatagatccttggatggggaaatttcgaaatcatctgcaagggtgcaacctttcagttctcctaaaacagtgatacaagataatgaagaggcccaagaggttgatggagatacttcctctaagcagaaggttgggcacgttcatccaaagttacccgactatgattcttttgctgcccacttcctgtctcttaagaagggtcgtcaataa

SEQ ID NO: 17643 - DNA, 837 bp, Glycine max
  Peptide Sequence Number=SeqID_109328
atggggagaaagtgctcacattgtggaaacataggtcataattccaggacctgtgcatctttcagagcaactaattttgtaggagttcgtctttttggggttcaactagctgacatatcatcaacctcttctaattctctttccatgaagaaaagctttagcatggattcctttccctcttcatcctctccatcttcctccttttcttcctcaagaacctctattggctatctatcagattcagatggcctcattgttggagcacaagagattaggaagaaaggagtaccatggacagaagaagagcaccgaacgttccttgttggacttgagaagctgggaaaaggtgattggaggggtatctctagaaactatgtgacttcaagaaccccaacccaagtcgctagccatgctcagaagtactttattcgccttgcaaccatgaataagaaaaagagacgttcaagtctttttgacatggttggtaacggcatcacaaatccaattagcagctctaactgcaagtcttccaaatgtgaaattgaggatgatgtgaccttgtcacttgttcaattacaagatactaaattagatgagcagaaagatagtgataaatattgtgaagctggaccagcaggtgctgaacatgaagctgtgcctttgtggcttcatcttcagatgaaatcttcaaataataatgttgcagcagtagttcctgatctggagctcactcttgcagtctccaagggcaaggctaagaccctgctaggcctggaacaaacacaaacaaaatcatccccagattccttccttcttggaccaattagcgtgacttga

SEQ ID NO: 17644 - DNA, 501 bp, Glycine max
  Peptide Sequence Number=SeqID_109329
atggaggacgatttggagcggagtatggaagctagggctatcggttgtagaggaggaagaggaacgcatggcagggatatggaggccagcgaagggggtggtggtgttgaaggaaggcgttcggtggaagttgggatggtgcaagtattgatgtgtggcagcaaccttggttccatgtacccaggaatggaaattctgaaaatgaaggacctcaagcaactcattgacgagctcacattccaagtgcgcatagcccaaatgctgttgtgcagcttgtggaggaggaggaatgataagctgtgggaaaacatggttgtttcagactctagtgttgttcagcgaggggatgattttctccaagcttgggttaatgctaagatgaaatctaattctggccaacttcaaactgatcaacatccaagtgttgtgttcacgatcatactgggtgtaccgactagaggtcactgtgtaatattcaagagagagaaacttgggctttga

SEQ ID NO: 17645 - DNA, 744 bp, Glycine max
  Peptide Sequence Number=SeqID_109330
atgtcatgtttccaaggattatttttctgtccagaggcagcttctttgcttcttcacaacttctgcatatatcatatcagtcctcctgggaatgagttgggagctgctgcaatttgtcctgatgatccagttccttctgctgaagacttagcagatcaaataattgaggatctcaattattttcggcttggtgcagtgatgtgcatgggaatatcgtctggtgcttatatcctttcactgtttgcaacgaaatatagggagcgtgttcttggtttaatacttgtatctcccttttgcaaatctccttcttggactgaatggttttataacaaggtgatgtcaaatttgctatatttctatggtgtgtgtggcttgttgaaagagtgtttgctccagcggtacttcagcaaggaagttcgtgataatgctgaatttccagaatcagagatagttcaagcttccagaaaactactagatgagagaaagggcatcaatgtctttcggtttcttcagcaacttgtacgtaggagacctgatataatggaaggattgaagagactaaaatgtggtacgcttatttttcttggggacagttctcctttccattcggaggctcttcatatgacttcaaaacttgctaggagatacactgccttggtcgaggtccagggttgtggatcaatggttacagaggaacagccacatgcaatgctggtcccaatggagtactttttaatgggataa

SEQ ID NO: 17646 - DNA, 489 bp, Glycine max
  Peptide Sequence Number=SeqID_109331
atgaagatgaagggggtgttgtgggttgtagttgtatcagtggtggttgcagcatggattcccctttcacactgttcaaagaaaccggtgggggtggctagaaaggaggacattccgtacatcaagtgtcaagtgtgtgagaagctcgctaaagagttgtatcagcaggttcaaaacaagcaagctgagatcgctcccaaaaagatctcggagtaccaaatcattgagatagcggagaatgtttgtaatctgaaaaaggtagaagcggattggatattgcgcatagatattgtggagaaagaagataggctggagctggtggaacaagactctgaaggacaatgtaattctgaatgcaagacaattgagcgagcctgtcaagagaaggatgaaataccaagcagtatggagatgataggcagaggtgtctctaatgctgtcctcataaggatctctggttgcacaaaggataaatccacattaagctaa

SEQ ID NO: 17647 - DNA, 1371 bp, Glycine max
  Peptide Sequence Number=SeqID_109332
atgaccacatatggaacgatctcagaagaggcagagccttcatcaaattcaaactcagttttcgtttcacaggccaaagagcacattcaaggtggtctaggcacaagaagaccatggagggaaatgctccaaacttctcatttcaaatttccatcttccttcttcggtgcaatccaaagaatcaacacaaatgccaaacattttcgtgcaaactacgttattatcatactgcttgtgcttttccttagcttactaggacaccccatttctttgatcatattaattgttatgatgattgcatggctgtacttatatttcttacgagatacccctttggtgatcttgaggtttgagatcgatgagcgattggtggttatctctttgttgctgatcaccattggtttgcttgtactcacaaatgtaacctacaatgtgatagtaggtatatgtgttgccttagtgattgtgttggtccatgctatgattagggaaacggaggatctgtttaccatggatgaagatgtaggggttatgaaaggtcttagagatattgtcaaagtccctcttagacaacctgtgaagtgtgaaaggatgaccaattttgttggactaaggttgcatacgaggttgtcattgccattgccattgccagtgttgggtggtgcttctcactcttgttctgccactgccactactctgtcaagagcagtaataaggaagtggaattggggaattaagggtcctcgtcgtatggtattgggccttggacttggagtttccttcttgtctatggccgcacctcgatttgtgacgcacattgatgatcctgcaattgctgctctgactaagtattactccaaagttttcccacccagcaacactcctggagtaagcatcttggatatgtgtagcagttgggtcagccattttccatcaggatacaagcaagaacgagtggtgggattaggtatgaatgaagaagagctgaagaggaacccagttcttacagagtatgctgtgcaagacttaaacgtgaaccccaaactcccatttgaggataactctttcgacctcatcactaatgtggtcagtgttgattaccttacaaagcctcttgatgttttcaaggagatgtgcaggatacttaagcctggtggactggccataatgagcttttcgaaccgatgcttctggacaaaagccatttctatatggacatcaactggtgatgctgatcatgttatgattgttgggtcatatttccattatgctggaggatttgaacctcctcaggctgtggatatatctcctaatcctggacgctcagatcctatgtacattgtgtactctaggaagctctctactgcttga

SEQ ID NO: 17648 - DNA, 1332 bp, Glycine max
  Peptide Sequence Number=SeqID_109333
atgagtaagatcagcaacttgagttctgtaagcagttctgatctcatagatgccaagcttgaagagcatcagttgtgtggatccaagcagtgccccggttgcggacacaagtttgaagggaagccggattggctaggcttgcccgcaggagtgaagtttgatcccacagaccaagaactaatagaacatcttgaagccaaagtggaggcaaagaacatgaaatcacaccctttgatagatgagttcattcccactattgaaggagaagatggaatttgttatacccatccggagaaacttccaggagtaacaagagatgggttgagcaggcacttcttccatagaccttcaaaggcttacacaactgggacaagaaagaggagaaaaattcaaaacgaatgcgacttgcaaggtggagaaacccggtggcacaagactggtaaaaccaggccagtgatggtgaatggaaaacaaaagggttgcaagaaaattcttgtcctctacaccaatttcggaaagaacagaaaacctgagaaaaccaactgggtgatgcaccaataccatttggggcagcatgaggaagagaaagaaggagagcttgtggtgtcaaagatattctatcagacacagccaaggcagtgcaattggtcagatagaagtgcaacaactggtgaaggaagtggagaacctaacaacagtggtagaagggacagtggaagtggaagttgttcttctaaggaaattgttactcacagagatgagatgtctgctgttgttggtgtccctccaatgacaagtttcactcatcatcatcccttggatattcaacagctaaaacctgatcacttcagcttcatccctttcaggaaaagctttgatgagagaatgcaggttggaataggagaggcttcaacagcaagagaagtaatgcaagcatcaggttcatgtgaagaagtgcatgaacggcacctagcacaagtaactcctcatcatcatcaactacaacaacatgctcatcatcatcaaatttcaaactcagcttttcatattagtaggccgtcacatcccatctctaccattatctctcctcctcccctccaccacacttccatcattctcgatgacaactcttaccatgtctctagaataatgctccaaaatgaaaattttcagcaacagcagcaacaacatcataagcttggaggaaggtctgcgtctggtttggaggaactcataatgggttgcacttcaactgaaatcaaagaggaaaaacgcccattgacgtttgacacttttgaccatgatcgaggtggaaagacatctaccagttaa

SEQ ID NO: 17649 - DNA, 1923 bp, Glycine max
  Peptide Sequence Number=SeqID_109334
atggtctgtactctgttgagtggtggtggcccactggttatcttcagcgggggatgcttaaacctcaatcgattctctcacttcccatcccctccctctctaccatcctctcgttccgatttacttaaggttgcgtctcgtagattcgctttatcagtgactaaaacgcagcaatctccagtcactaagccacaatccacctccaccgctataattgcaaataacccggccagtgtcaaaaggcaattggcgcagctgtttgacttgtctctgagggcaactgtgcccgatgagccagatgttgtgccgttaattgatgcttgtgctgttaaaggtggcgtaaaatttggtgattatcaatgtaataatgcaatgggtatatggtctaagatgaagggaaagcagacaggatttaggggtcccccagcaattggtcaggctatcgttaacaatcttcctccatctgaaatgatagattcgtgctctgtagctggtcctggatttgtcaatgttgtattgtcaaagaagtggatagctgagggtgaatatgtgaaagttaagagaatgctaattgatggtatcaattcatgggcacctcgacttccagtcaagagggctttgattgatttttcctcacctaatatagcaaaggaaatgcatgttggccacctgagatctaccattatcggtgatacattagctcgtatgcttgaattttcacgtgtagagtgtgtaatccgtagaaatcatgttggtgactggggaacacagtttgggatgctgattacaaacctctttgaaaaatttccaaacccagatgatgttagtgaagcagacattggagatcttcaggattatctccccaaacacgtgatgcctcctccaattcgtaacccggagcacgtcctccacaagacgcagtggctggctatattcgctctcttcggtgcttgttcactctttgcaccacctcacttcagatctgagtgtgtgctgtcacatatgctcatcggtgaggcagtgatgatgttgttcagatctgagtttgtgcgagatggcagcggcaacattgttgagatccgagcattctataaggcttcaaaagtgaggtttgatagtgatcctgagtttaagttgagggcacagcaggcagttgtccgcctccagagtggagaaatcaagtatcgcaaggcatggaaacaaatttgtgatgttagtagggctgaatttgataaagtctatcaacgccttggagttcaattggaggaaaggggagagagcttctataatccatatattcctggggttctggagaaactagataatttaggactgattgaagagagtgatggcgcgcgtgtgatttatgttgagggtgtagacataccacttattgctgtgaaaagagatgatattgggcagcagcaacactttgatatgctatttaaggcctataggcgtgcaggttggttaccaaaggatgagaatgcatatccaaaatgtactcatataggttttggtcttgttcttggggaagatggaaaacgatttcggactcgcagcagtgaggttgttcgattggttgatttacttgatgaagctaaaaggcgctgtaaaattgccattcttgaacgtggtgaagctcctgtgctctttttacttcttccttctaaagattggtctgaggaggagatcgagaaaacatccgaggcaattggttatggggccgttaagtatgctgatttgaagatcaacagattaacaaattacacattcaactttgatcagatgcttaatgataaggggaatactgctgtttatttgctgtatgcacatgctaggatctgttccattatcaggaaatctggtaaagacatagaagaagtaaagagagtaagtttagcttcttttctccctggatga

SEQ ID NO: 17650 - DNA, 387 bp, Glycine max
  Peptide Sequence Number=SeqID_109335
atgggcattactgcatctgttacaagcagcacggagaaaataaaaacaaaaactgttattgtgatggaaaatgagaagctctggttacaattgaataaatttcctaagaaggttcctcttatggtagttatgaaagctatggggatggagagtgatcaagaagttatacagatggttggaagagatcctcgttatagttttctactgttgccctctattgaggaatgtagaaaatgtaaggtatatacaaaagagcaagcattggagtaccttgataagctggtaaaacgtcccacttattcaagcaattcagctgaaaaggaaggagcagcattttctgccctaagagatgtatttcttgcaaatgtgcctgtaagattgctttga

SEQ ID NO: 17651 - DNA, 174 bp, Glycine max
  Peptide Sequence Number=SeqID_109336
atgaatgaggctaaaaacataaaagatttcatgaccaccattgaagacaacaatacatggcagctggttgacaaactggaagacaaaaattctattggagttttatactttatgcattgcatatacgagctattaagcttgttgggtagaagtaactactgttctgttttgtga

SEQ ID NO: 17652 - DNA, 780 bp, Glycine max
  Peptide Sequence Number=SeqID_109337
atgacaacggaaagtggtggcaacaattggaggcaccaacagcgggttgttaacggcacaagacgaagcgaaacacaaagaagaagggggcgcaccaacaacataatagagatcaagcgcagacatgggaacttacaaaggaagaaacgcgaattgatgatggaggtcaccaaagacgaagctgcaacgccaggatcaggaggtgctcaacctcccaatccaatttctaacggtaaccctaatccaaatccaaaccctaacccgaacatgcctcacacccccagaggatccaaaggaaaatcgtgtaagggatgcacctactacacatcgcttcataaggccaagtccaaaaaccccacatgcgttggtttctccagagcactccagcaagtacccccttttgttgttggagaaactgagttggaagcttcaaaagagggccgcagccttgcaaatttcaagtatgcatgtattggatactctgtctacttagacaacaaagattcttctgctggctctcaggataaaacagcaaaattgcccttttgtgttggtcttgaggtggtcttagtggagaaagcttcaaattcagatgctggccatgttcctgctactcataaaactgacgatgaacatgctgctcctcaacctcgaagatacatacctccaaatcatgcgacagagttcttgaataggcaagtggaagttttcagcatagtcaactcttgtagtttcaaagaaatgcaggcctggtggcatctggtgttgccaaaaacttga

SEQ ID NO: 17653 - DNA, 354 bp, Glycine max
  Peptide Sequence Number=SeqID_109338
atgcaggatacattatacttggagaacatagaggaaagggaaactgggggcacacctccaataatccagacagtgagagcatgggacctggtgaagtccacaccaaaggaaaagcagaagaagcaagagagagatgatggtatgaataatggatttgtttcttttggtattagtggtgcaagctacttcactggaactttcactactgtcgatcgctctacagatggaaggtatgttgtagtctcaagtcggggaaacttctacttaacctgggagtctggtcaggttgtggaggcaagtcaagattttgtgccacttattttgaggcaagtgttcacaaacaacaaaaagtag

SEQ ID NO: 17654 - DNA, 1023 bp, Glycine max
  Peptide Sequence Number=SeqID_109339
gtgccaaaggctttgtcaaagcagctgcccattgatcaacagctagaatgtgatgaaccagaagttgctttactagaactctctcatgaaccagaagtgtgctatcttgtaaactcaaatcgtagatccaacactttgagaggagtgtttgtaaatggtgtttggattgatgaatctagaagggtgaaggaggagatatgcttgttcttcaagaacagatttcaggaggaagagtgggtgagacctaaactagatggggtcagctttaaagccattggacagcaagacaatgacagattattggagcttttcactgaaaaagaaattaagaatgcggttgatgtgctttgcttgatgaatgaattttttgttcacgaaactctcccaaagggttgcaatgcatctttcattgctctcattcccaagggacaaaatggactgatgagagaagcgatggagaaaaacttgtttcaaggtttcttagtgggtagaaacgaggtggaggttctctactgtgtgttcatggcttccgctccttccaattccgtttctcaatctttttccaactcgattgcagagaaacttgatgattctaattatctacactggcgtcaacatgttgagccagtgatcaaatcgcacaagctgcagcaatttgctattaatcccattgttccaccacgttacctcactgaggacgatcacatcactgatcgagtcaaccctgaagttcttggttccaatcattcgtatgaagttttgaacaaaatccatgaatacattagccttcacaccaaatctcatgggcggcaactttgttatgccatgcgcgcggttagtcttgatgaaaaattgattgaggagtacttgcgcaaaatcaaaggctacgttgatgaattagttggcgtaggcgttcctgttcgtcacgaggagtacgttgatgcgcttctcgaattagttggcgtaggcgttcctgttcgtcacgaagagttagaagcgtattccctccattgccgaaattga

SEQ ID NO: 17655 - DNA, 291 bp, Glycine max
  Peptide Sequence Number=SeqID_109340
atgctgaccagtaaccttgtcttgctggttaagcattccactgcacaccttgacaaatccttaaccaataagcaacctcaactgcttgcgatacgtgcccgaggttcttgtgacctcaattgcttgagatacatgaacgaagatctaaaacacagaagaaggcatagaatagagttgaaggcctacagactctcgcttaacgcaccatacgcactcagcgtgacacggtcgctcagtgggctgtcatcgcttaacgcgaagaaaccactttgtgagtcagatgttacgtga

SEQ ID NO: 17656 - DNA, 1347 bp, Glycine max
  Peptide Sequence Number=SeqID_109341
atgaatgatgatttagctgttggtcgttatttcttacagggtggctatgatacagttgttaatgtcccactagatgataacagtttagtcgtacataaggctttggatttttttgtggtgtgttctggggatgagaaaggactcttttatgcattagaccttggtggcacaaacttccgaacccttcgcgtgcatttaggtgggaaggagaaaggtgttgtcaaaatagagtctgatgaagtttccattcctcctcatttgatgactggttcttcacaagaattatttgattttatagcatctaaactagcaaaattcgttagttctgagcctgaagagttacaccctccccctggcagacaaagggaattgggttttaccttctcatttccagtgaggcaaacatcaattgcatctgggaatataataaagtggactaaaggtttcaatattgaggatgcggttggagaagatgtggtgggtgaactgaccaagtccttagaaaaaattggtctggatatgcatgttgcagctctagttaatgacacagttggaacagtggctagagcaagattcagcaatcaggatgtcattgctggagtgattcttggtactgggacaaatgcagcttatgtagagtgtgcacatgcaattccaaaatggcatggtcttctaccaaaatcaggagagatggttattaacatggagtggggtaatttccgttcctcgcatcttcctctaacagaatatgatcatgctctagatgcagagagcttaaaccctggagaacagatttttgagaagataatttctggtatgtatttgggtgaaattgtaaggagagttttgttgaagttggctgaagaagttgacttctttggagatactgttcctccaaaattgagaattcctttcgtacttaggacacctgacatgtctgcaatacatcaagatacatcttcagatctgaaggtggttggaaacaaattgaaggatatattagagatcaataacacatccctgaaaatgaggaagattgttgtggaactctgtgatattgttgctaatcggggagcccgcctttctgctgctggtatttttggcatcctcaagaaaataggaagagacacagtaaaggacgggaagaaatcagtagtagcactggatggaggattgtttgaacactatactaaattcagaagttccttggagagtacactaaaggagttgttgggagatgaggcagctgagacaattggcattgagcagtctaatgatggctctggaattggagcagccctcctggcagcttctcactcccagtatttggaagtgcaggagtcctga

SEQ ID NO: 17657 - DNA, 2628 bp, Glycine max
  Peptide Sequence Number=SeqID_109342
atgcctagcaagcgcaagaccagatcctccgcctctcccgctgccgcgccgccgagcaagcgcgcctccagatcctccgcctctcgcgtcgccgattccgcaccggtcaaatctgaagccgaggaagttgtggcagcttcctctgtcgtcaaagaagaggcgcaagcaagcttcacggacgttactgacggcaacgttagcgatggcgaggggactaacgccagattcgtcggagagcctgttcccgacgaggaagcccggcgccgctggccgaaacggtaccaggaaaaggaaaagaagcaatccgctgggccaaaatcaaacagaaacgatgaagacgaggagattcaacaagctcgacgtcactacactcaggcagaagtagatgggtgcatgctttacaaactttacgatgatgcccatgttaaagcagaagaaggagaagacaattacatttgtaaaattgttgagatatttgaggccattgatggggcactgtattttacggcacaatggtattatagggctaaagacactgtcattaaaaaacttgcatatctcattgaaccaaagcgagttttcttttctgaagtccaggatgacaaccctttggattgtctagttgaaaagctgaacatcgccagaataacattaaatgtagatttagaagcaaagaaggaaaccattccaccttgtgattattactgtgatacacaatatcttttgccatactccacatttgttaacttaccatcagaaaatggggaatctggtagtgaaacttcttctacaatatcttctgaaactaatggaatcggaaaatatgaggtgaactctcaacctaaggaagcttttcttcccgaagaaagtaaagatccggagatgaagttactagatttatattgtggttgtggtgcaatgtcaactggtttgtgccttggtggaaatttatctggtgtgaaccttgttactagatgggcagtggacttgaatcaacatgcttgtgaatgtcttaaattaaaccatcctgaaactgaggttagaaatgaatcggcagaaaattttctttcattattgaaggagtggcaggaattatgtagttacttctctctagttgaaaaaaaggtgtcacatgagaaatatgtgaatctttttagtgaagatgacgatgacactagcagtaatgaagaggttaatagtgaagatgacaatgaactgaatgaagatgatgaaatatttgaagtttctgaaatccttgctgtctgctacggtgacccaaataagaaaaaagaacaagggttatacttcaaggttcattggaagggttatgaatctgccctggattcttgggaaccaattgaaggtctaagtaattgcaaggaaaagattaaagaatttgtcagtcgaggcttcaagtcacagatattgcctttgcctggagatgttgatgtaatttgtggtggacctccttgccaaggtattagtggtttcaaccggtttcggaacaaagagagtcctttggatgatgagaagaacaaacaactagttgtttttatggatattgttcaataccttaagcccaaatttacattgatggaaaatgtggttgatcttgtaaaatttgcggaaggctttcttgggagatatgccttgggtcgccttcttcaaatgaattatcaagcgcgtttaggaattatggctgcaggtgcttatgggcttcctcagtttcgtttgcgcgtctttttatggggggctgcaccttctcagaagttgccacaatttccgcttccaactcatgatgttattgtaaggggtgttattcccttggagtttgagataaacactgtagcatacaatgaaggacaaaaggttcaactgcagaagaagcttttattggaggatgctatttctgaccttcctcgggttcagaacaatgagcgtcgtgatgagataaaatatgacaaagctgctcaaacggagttccaacgattcattagattaagcaaacatgaaatgttggagcttcaatctagaacaaaatcgtcgaagtctttgctatatgatcatcgtccactagaattgaatgcggatgattaccaacgtgtgtgtcggatccctaaaaagaagggtggatgcttcagagatttaccaggtgttcgtgtgggagctgataacaaggttgaatgggatcctgatgtcgaacgtgtatatttggattcaggaaaaccattggttccagattatgccatgacttttgtgaatggaacttcatcaaaaccttttgctcggttatggtgggatgaaactgttccaactgttgtgacaagagcagaacctcacaaccaggcaattttacaccctgaacaagacagagtgttgacgattcgtgaaaatgcaagactccaaggttttccagatttctacaagttgtgtgggccggtcaaagaaaggtacattcaagttgggaatgcagtggcagttccagtagctagagctttaggatacacactaggccttgcatttgaagggtctacttctacaagtgatgatccattgtataaattacctgataaatttcccatgattagggatcgggtttcttctgtatcttccgaagatgatgtgtaa

SEQ ID NO: 17658 - DNA, 468 bp, Glycine max
  Peptide Sequence Number=SeqID_109343
atggagagttccgatgagatgcacagcaaaattataacgatgaaacaatctttcttcgatgagggatttctgattccaacccagtttcaagagctggagctgctacaagacagagacaatatgaactttgttagggatgttttttgtttgttcttcacggatatgactagacagttttctgagattgagcaaattcttcgagaagaaattgatggtcagccaagggaagacatgaataggttacttcaacgactcaagggaagtgtgttaagcattggtgctctcaagattttgaacggagtcaataagatgatacaacttttcgaagaaggcaacttggaaaggatcatggctgcttttgaacaggtgaagatggagagtgtaaatcttagggcgaaagttgagccttactttcagttgctggagtcccaagctgaatcatttacagagtcccaagctcccaaatga

SEQ ID NO: 17659 - DNA, 1764 bp, Glycine max
  Peptide Sequence Number=SeqID_109344
atggagagcacacttaaggccctgagagatggtgaatcagtgcttgatctgagtccaagatccaccgtcagcggcggcgtcgaagatgtctacggtgaagatcatgctactgaagaccaacttgtcaccccatggaatttctcagttgccagtgggtattgtttgcttagagatccgcaatacaacaaagggcttgctttcactgagaaagagagggatgcacactatttgcgtggactactacctccaacaattacctcccagcaacttcaggggaagcagttgataaacaatatccgacagtatcaggagacaaatgaaaggctgttttacaaacttctaattgataatgttgaggaactactcccaattgtgtatactcctgttgttggtgaggcttgccagaaatatgggagcatcttcaagcgtcctcagggtcttttcataagtttgaaagagaaggtcattaagctgttggccttttttagggggaagattcttgaagtattgaaaaactggcctgagaaaagtattcaagttattgttgtaacagatggtgaacgaattttgggacttggggatcttggatgtcaggggatgggaattcctgttggtaaattggccttgtacacagcactaggaggagttagaccatcagcatgtttgcctattacgattgatgtggggacaaacaatgagaaattactaaatgatgagttttacattgggcttagacaaaagagggcaactgggcaggaatattctgaacttttgcacgagttcatgactgctgtcaagcaaaactacggagaaaaagttcttgttcagtttgaagattttgcaaaccacaatgcttttgagttgcttgcaaaatatggcacaactcatcttgttttcaacgatgatattcaggggactgcatctgttgttcttgctggggttgtggcagccttgaagctcattggaggtactctggctgaccacacattcttgtttcttggtgctggagaggcaggaactggaatagcagaactaatagctcttgagatgtcaaagcagacaaagacacctatagaggagactcgcaagaagatatggcttgtagactcaaagggtttgattgttggttcaagaaaggcttcacttcaacacttcaagcagccttgggctcatgagcatgagcctgtaggcagtctcttagaagctgttaaggtaatcaagcctacagttttgattgggtcatcaggagtgggaaaaacatttacaaaggaagtaattgaggctgtgacttctataaatgaaaaacctcttgtcctggctctctccaatccaacttcacagtctgagtgtacagctgaagaggcttatcaatggagtgagggtcgtgcaatttttgctagtggaagtccatttgatcctgtagaatacaagggcaaagtgtactattctggccaggccaacaatgcttacattttcccgggctttggtctggggttggtaatctcaggagcaatcagagtgcatgatgatatgcttctagcagcttcggaagccttggctaaactagtgtccaacgagaactacgaaaagggcttgatttatccaccattctctaacatcagagaaatttcagctaacatagcagcaagtgtagctggcaaggcatatgagctaggcttggctactcgtctccctcgtcctcagaatcttgtcaagtatgctgagagctgcatgtattctcctgtctacagaaactataggtga

SEQ ID NO: 17660 - DNA, 183 bp, Glycine max
  Peptide Sequence Number=SeqID_109345
atgaccgcaactgagggaaaggaagaagggggccgcggcggaggaagaagaagaaaaagaaagaaaaagaaatgtatgaggggagggagagggaggaaggagagaaaaaggaagtataagttgagaggaaaaaaagtttttaattttcctgaatatcacgtgaatctaaccagcaatacctag

SEQ ID NO: 17661 - DNA, 291 bp, Glycine max
  Peptide Sequence Number=SeqID_109346
atggtggacttggtcatggaggagagatgtgaagtagagtggatggactttcttaattatggagtaggaaaatgtgggcacgttcagaatggtatgatgtttaacaacaaggatatgcaggttatggatattatagaatcagtgaaaaacaagtctgggaagaaggtaattgggtgtggagtaatcaccctcactggagatggcgtccatgatgccaatgacttcgccggaggcaagcttggtggtgactatggagttgggtttgagaaggcgggcataaagaacatttaa

SEQ ID NO: 17662 - DNA, 480 bp, Glycine max
  Peptide Sequence Number=SeqID_109347
atgacgaagaaggggaagaagcaattgatgtcatcggcgccgtggagaggcgaggagagtgaagaatccttcaaagagggaaagctgaaagtgacgaggcagggtgatggcacttccaccatgcacgtccctgcctccaagtccaagcatcatcaccatgacctccacgacgacctcggaatcgagattgatcctgaactacgctacagcttccagcgcaattttcaggtaccaattgctcgcaaattgggtcctccaagtattgcaattgtgggattttggttcctccaatttcttcagcgtgtttttagcattgacactatggtgaaacctcttcctcctgtcatggcatacaatgtctctcgcaacttgaacttcttcactcgcattttcacacaattctttgatcctgaaggtattgcaaatgcccagaaatccttgggcataggacaggaagataaagttcgcaaagttcgttga

SEQ ID NO: 17663 - DNA, 294 bp, Glycine max
  Peptide Sequence Number=SeqID_109348
atgtggcaaggtcaaggcatttatctatggacttttgaggggttccgttcagccgccgataaggtggatactgcggactcagactgctgggaatttaggagccaattaaagagtatgaaaggatacattatacttggagaacatagaggaaagggaaactgggggcacgcctccaataatccagacagtgagagcatgggacctgttgtccagttgaagtccacaccaaaggaaaagcagaagatgcaagagagggatgatggagtgatagcagctagaagtgatacagattga

SEQ ID NO: 17664 - DNA, 747 bp, Glycine max
  Peptide Sequence Number=SeqID_109349
atggaggtgaagaatgaaaagaaagccccgagtgttgaaaggaggcatattgaggcgcccaaaaatttgatggaggtagtgtccatattaacggaagccataaagtcgctcggttacaaggagaaatggcacatcctcaacttgcccatagccattgcttccgctgtgttggacatgggtaagaaaacagttgcaagagaatgcggtgaaagaagtgattgtgtacagctgaaggcccccgaagtcataaaggagttatatgagataaagaaattgttgacacggaccttgcttttcagcagaaaacggtttcatgggttcttatttgctgctggattcgacaaggaggatgtcctcctaagaaagagaacagctcggattctaaggccagttttcacagttatacgtgatatagaatcaaaaagtgtgttggtgtttattcggggaactcgtagcctaaacgacacgctaacagctgcactctgtgctcccgtctccttcgagcataggaggaacaacaacattgtttcaggacatgcacaccgtggtatggttgctgcagcttattggattctagactactgcactcctgtactaaaaaaggctcttgatcaatacccccacttcaaaatcaagatcgttgggcactcgcttggtggtggtaccgctgcactgctgacatttaagctaagagaaatacaagagttctcttcaagcacttgtgtcacgtttggcccaggcatgtag

SEQ ID NO: 17665 - DNA, 1557 bp, Glycine max
  Peptide Sequence Number=SeqID_109350
gccgccggaaagcttgaaaagaggccagccgaggcgcccaaaacattgatggacacagttcttacgttagcagaagccataaggttcggttacgccgagacactgggcaaatggcacctcttggacttgccaagagccatcctttactctgtcatggacaagggtaagaaaacagttgcagttgaatgcgctgaaagaagtgactgtgtacaactgaaagaccccgaattattaaaggagttatatgagctcaaaaaatgcttgacacagaccatgcttttcagcaaaaaacgttttcgtgcctttttatttgctgctggatttgtcaaggaggatgtcctcctaaggaagagaagagctcggcccgctttcacagttatacttaataaagaatcaaaatgtttgcttgtgttcatccgaggaactcgtagcataaaagacacgctgacagatgcaatcggtgctcccgtttccttcagtcacttcatttgcagtgatggtgagctgaagaagagagacacggtttcaggacatggacaccgtggtatggttgctgcagctcgttggattaaaaagcactgcaccactatattacttgatgctcttcgtcaataccccgatttccaaatcaagttagccgaattcgggaagcctttcattacttccattataaatggttatgacatcgtgcctacattgtcaggttcttctgttcatgatttcgttgccgagggtaagataaagcgtaaaaaaatcctaaatgctgctcgtagctctataactgcaattggatcacgcttaccatttgcatctactgctaaagccattgcagatcatgcagtaactcgtggcacccaggttgtgatgaagaataagcaaaaaactcggtcactgttaccctggtcccgacgtgagaaaactgaggcactgccaagctctaaatcagataacttggctgaagcttgtggatcatccgagacaagttgtggagtggttgaagagataaaaatctcagactctacgagtgatgagtacgatgaatctaaatcatctagtgaggaatctgataatgatgatgatatagatgaagaggaacaaatcatatctgccgctcagaacgttactactcacactgcctgtgatatctctgaaaatgatctgttgaatgaattgaaggagcttgaactagaggcacaggatgataaccctaaaattaatgctcaggaaaaagaaggagccaagaccaaagacatcactgaagaagagatcaatgatcaggttgttgataccaaagacaaattggatacacatctttatcctccgggaaggatcatgcatattatcccttcaccttcgtctgaaaataattctaattcatcaaaccataatagttctgaagagaaagaggtctacttatatgaaacgcctagacagctatatggcaagctaagactttcaagagggatgataattgatcatctcacgaggaactatctgaaggtgttacaacaattaatcaatcaactagagaaagagaagtcccattatggtggatga

SEQ ID NO: 17666 - DNA, 1548 bp, Glycine max
  Peptide Sequence Number=SeqID_109351
atggaatgtggggaaagaagtgattgtgtacaactgaaggaccccaaaatactagacgagttatatgagataagaaaatgcttgacacggaccatgcttttcagcaaaaaacggtttcgtgcgtttttactggctgctggaatccccaaagaggatgttctcctacggaagaaaagagctaggattctaaagccggctttcacagttatacgtgataaagaatcaaaatgtttgcttgtgttcatccgtggaactcaaagcttaaaagacacactgacagatgcaatcggtgctcccgtgtccttcaatcatttcatttgcagcgatgatggtgagctgaagaggaacaacaaggtttcaggacatggacaccgtggtatggttgctgcagctcgttggattaagaagcactgcaccactatactacttgaagatcttcgtcgacaccccgatttccaaatcaagatcgttgggcactcgcttggtggtggtactgctgtgctgttgacatatatgcttagagaaataaagcagttctcttcatgcacttgtgtcacgtttggcccaggcatatgtagaattactagcgcgttatgcagatctgcctccgtgtcattggagttagcagaattcgggaagccctttatcacttccattataaatgattcagacatagtgcctacattgtcagcttattctattcatgatttcatttttgagggtcagattaagcataagaaaatcctaaatgctgctcgtagcgcagttgtatctcgcttaccatttgcttctactgcgaaagccattgctgatcatgcagtaacccgtggcacccaggttgtgaagaagcataaagaaagaactcgcttattgttatccttgtcccaacaacctgagaatgttggcgcattgtcaagctctaaatcagataacttggctgaagcttctcgatcaaccgagacaagttatgaagtgtctgaagagataataatctcagagtctacgagtgacgaagacgaatcgattttctctagtgatgatgaatctcagcatgatgacacagatgaagaggaacaaatcatatcagcttttcagaacattactgcttccactgcagcctctgacgaagaattgttgaatcaactggagaagcttgaactggagaaacacgatgatatccctaacattcatgttaaggaaaaccaagaggctaccacttccatagatgtcactgaaggagagaaaaaagttgttcttgttcatgctgaagaaagtgctggtgcagtcacagcttcatacaacttggaaaagcatcctctttatcctccaggcaggatcatgcatattgttcctgcaccatctaattcatctgaaaattctaattcagatgactatgatcctgatgagaagtacctttacttatatgaaacgcctaaacagctgtatggaaagcttagagtttcaagaaggatgatacttgatcatatgacgaacaagtatctaaagatgatacagcaattaatcaatcaactagagaaccagagctag

SEQ ID NO: 17667 - DNA, 517 bp, Glycine max
  Peptide Sequence Number=SeqID_109352
atgaatttggcggtgtcggcgttgggagggtggagggtgtgcaatggagcaatgtttttgcttgagggaggcggtaatggtttgggaatgggaagtgggagagtgtgcagtcggagtcggagtgaggttagtggagtcagagtcggagtgaggctggatggacctgtgcccctaaaagacgacgttttggaaaaggaagtggttttcgagcagtgcgtgacgcggactctgtctccggcgttgacattggaggagggacttgagaaactgaaggaggctctccaaatcttgaattctccttccccttcttcccctactggattccttaggtttcaggtggcgctccctcccagtcctaagaccttcactttgttttgctcccaaccccactcctcctcggtctttcctctcatttatgtttccaagaacgatgccgactctaaatcactctatgtcaatttggatgataatgtgagtcaccagaaagaaaggttctttttggtttttcatccctcag

SEQ ID NO: 17668 - DNA, 747 bp, Glycine max
  Peptide Sequence Number=SeqID_109353
atggaggtgaagaatgaaaagaaagccccgagtgttgaacggaggcatattgaggcgcccaaaaatttgatggatgtagtgtccatattaatggaagccataaagtcgctcggttacaaggagaaatggcacatcctcaacttgcccagagccattgcttccgctgtgttggacacgggtaagaaaacagttgcaagagaatgcggtgaaagaagtgattgtgtacagctgaaggcccccgaagtcataaaggagttatatgagataaagaaattgttgacacggaccttgcttttcagcagaaaacggtttcatgggttcttatttgctgctggaatcgacaaggaggatgtcctcctaagaaagagaacagctgggattgtaaggccagctttcacggttatacgtgatatagaatcaaaaagtgtgttggtgtttattcggggaactcgtagcctaaaagacacgctaacagatgcactctgtaaacccgtctccttcgagcataggaggaacaacaacattgtttcaggacatgcacaccatggtatggtttctgcagcttcttggattctacaccgctgcactcctgtactaaaagaggctcttgatcaatacccccacttcaaaatcaagatcgttgggcactctcttggtggtggtaccgctgcactgctgacatttaagctaagagaaatacaagagttctcttcaagcacttgtgtcacgtttggcccaggcatgtag

SEQ ID NO: 17669 - DNA, 402 bp, Glycine max
  Peptide Sequence Number=SeqID_109354
atgataacgtcgatagtggttaggaaggccgccggaaagcttgaaaagaggccagccgaggcgcccaaaacattgatggacacagtgcttacgttagcagaagccataaggttcggttacgccgagacactgggcaaatggcacctctttgatttgccaagagctatcctttactctatcatggacaagcgtaagaaaacagttacaatcgaatgtagcgaaagaagtgattgtgtgcaactcacagaccccgaaatattaaaggagttgtatgagctgaaaagatgcttgacactgaccatgcttttcagcaaaaaacggtttcgtacgtttttattcgctgctcaattcgccaaggacgatgtcctcctaaggaagaaaaaagctcgggtcccagtttaa

SEQ ID NO: 17670 - DNA, 322 bp, Glycine max
  Peptide Sequence Number=SeqID_109355
ggagtggaggtcgatctgtggtcatgttgggtctccgactcgtttaatgatagtgaaacatcagctagagttaaacttttttggtgatgcattgccgctggtagtccctatcgacgtagtgttgttacctaagagaatgatatctctagagtccagtgaggtcgatatggaggccatgaaggggcagatgacaattatgatggcaacaatgatgagcatgaacaaggtgatgaaagagttttgtgaggatttcaagatccaacaccatgattcgacaccttattggcccaagatgaatgatgcaattgaggtcgtcaattag

SEQ ID NO: 17671 - DNA, 981 bp, Glycine max
  Peptide Sequence Number=SeqID_109356
aataccatacaacttccagcattctatcatacacaatgggcaccacagtatcccgagtttgttcatctcagatacaatggagccatctacgaaatacgggtcagacaacacaaagaaaaagtgtatttagcagatggactcgaaaaattcaggaaagatttgaaaatctacgagtcaaccaccatcaacttttttgcttgtggccatcactctgtatttgacatacatttcataccaccactggagcagcaaacttgtggcagacataggcattcatccagaaagcatatctggactcttcgacttactcaggaaatgctgggtgctcctgaacccctgaaactcccccgttgtacagaagttcctcttaaagcttgcggtaatcacatgacagtcttaaggcgacatggctacccattgcaatggaaagttgaaactcagaatcctgctattgggggaaaaggcgttgtccaaccatggtacgattttcttgaagaaatggactttgatgatggagatgaaatctctatttactatagacattatgaaaaaatttgggatatcataattaggaagcaggagattgggaggatagtgataacaattagactgcctttagttccaacaaactctgttaatgtttactcatggcctcaaaatcaagggcctagcctttatgagagaacaaccaagctggatgagactttggctcagttcatgcaggttactatgtctaatcacaagagcacagagtctgccataaagaacttggagattcatgtacgacagttagccaagcaaatagctgagaattcttctggaagtttcagagccaacactgagaaaaatcctaaggaagaatgcaaagttgtcatgactagaggcaagaaggcaatcatagtggaaaatgaagggaggaatgtggatgagcaagagttaggagctgaagaagaaaaagaaaaagaaaaagaaaaagattag

SEQ ID NO: 17672 - DNA, 183 bp, Glycine max
  Peptide Sequence Number=SeqID_109357
atgggcccggggccagccctagctaggggtcgcggaagtcttctagaaggtggtggtgggcccggggaggggatgggttggggaatggcgttgttgggtgcgaaaagaaaagagacgaatgacccaaacgcgacgatggtggtggttgttgttgatggcggagagtctgcactgtcttggtga

SEQ ID NO: 17673 - DNA, 394 bp, Glycine max
  Peptide Sequence Number=SeqID_109358
aagtgctaaagttgatatctcgctaagcgagctcaatgcgcttagcgagtgtcatccgctaagcgaggcaccagcgcgcttagcggataggaggaatctggaagggaatctgtcacgcaggcacgtgctcagcgcgtcattagctcactcggcgagtcatttgtcaccatccaggcttaacgcgagtttggcgcggagcgaaaattcacttactcgcgctaagcgcgagaatgacgctaagcgcgacgtcgagcactttattattgcacgcttgtggcttgatcacccatatgtgtgtactgttaggggctttagcattgaaagatgtattgtctcctcagaacttgataaagcaggattaggttaccgtatgtctggacacggaatgcagtaa

SEQ ID NO: 17674 - DNA, 163 bp, Glycine max
  Peptide Sequence Number=SeqID_109359
atggccgagtggtttaaggcaacggtcttgaaaaccgtcgagtgtaacagctcccagagtcaccagttcgattccggtagccggcaccatgacagaggccccagcagcgatgctggggctttttgttatgagctttacacttccgcaggaacaaacagtatag

SEQ ID NO: 17675 - DNA, 209 bp, Glycine max
  Peptide Sequence Number=SeqID_109360
atgaatgaaagtcgcatgagccttactgtcgcaacctacccttcggcgggagggcgacgcgtgactcgcgggatgcgtgttccacgaaaggaatacgcgcagagtcgccaccaacgtttatttgaggaaaacgtcggaaaaaccggaaaagacgcgatctacgaacttttaagtgaaaggttcgggagttgtatttacgcgcggggaag

SEQ ID NO: 17676 - DNA, 1104 bp, Glycine max
  Peptide Sequence Number=SeqID_109361
aaggtcgacgtgcccgccgctgatgatcacgcccacgcgcgcgccgcgcaccggcaccacgccctgcagcacggccgcggacgacaggcagccggtcggttccaccaccatcttcatgcgctcggcgaagaacttcatggtcgagaccagctggtcatccgtcaccgtgacgatgtcgcgcacgtgcttctggatgagcgggaaggtcaggtggcccaggtgggtggtggcggcgccgtcggccagggtcttgggcgcggggatgcggacgacttcgcccttgcgcagcgattgctggccgtcgttgccggcctcgggctcgacgccgtagaccaggcagcgcgggctgagcgcgtacgccgacagcgccgaccccgacagcaggccgccgccgcccaggcacacgaacaggtaatccagttcgccgacgtcctcgaacagttccttggccgcggtgccctgccccgcgatcacgtcctcgtggtcgtagggcgggatcagcgtggcgccggtctcggcctggatgcggcgcgcgatctcttcgcgatcttcggtgtagcggtcgtaggtgacgatctggccgccatagccttcggtggcggcgcgcttggccgccggcgcgtccagcggcatgatgatggtggccttgacgccctgcagcttggaggccagcgcgatcgcctgcgcgtggttgcccgacgagaacgtgaccacgccggcggcgcgctgctcgggcgtcaggcgcgcgatggcgttgaagccgccgcggaacttgaacgcccccatgcgctggaagttctcgcacttgaagaacagcgaggcgccggcgatggcagtcggccgtggtcgaggtcagcaccggcgtgcggtgcgcgtggccggccaggcgctcgctggcgcgcgcgacatcgtcgaaagtgggcagttcgggcaacatggaaacagtcctttgaacgcggaaagagtcggaagcgaaacctccggatcataaacccgtggcggcgttcccgccgccgccacgcccggacggtttacttgccgaacagctcgccgctggtgctggcggcgccggcgggcggcgtcaggcccaggtggcgccaggtg

SEQ ID NO: 17677 - DNA, 330 bp, Glycine max
  Peptide Sequence Number=SeqID_109362
atgatagattctggcgatgatgattatatgatatctaattcatattttgaggactcgttggatgaggaggaagatatcgatgatatatttgacacagatgaagaagttgcctacatgatccaaccccttacaatcatgcaaccaagagaaggtggaagtgagactacattttgggaatccgcttctaattatagtaacattaattggagtcatcccgatgaagaagacatccgtggttttgatatggcatcaaccttcaatattggtcaagaattattttttggcatggaatttgaaagcaaaaaagcagtgaaaaatgcactgcaatag

SEQ ID NO: 17678 - DNA, 414 bp, Glycine max
  Peptide Sequence Number=SeqID_109363
atgagcagcgccgcccattaccaaactaaatcaatcggaggtatgtgcatcttaatccaattgtgggcatggaaacgatgcacaactttggctccaaagaggactcctcccgtaatagaaaataaaccccttgaacacaggtggttgcgacgtggaaatcagcatattggcaatgatgatctgatagtttttcatcgcaaattggatatcatgaaacgacatgagtttctgtgggagtcttacacaacaactgttatgtcagcgctgccttcaatttgtttgattggaagtgtagcatggtgtgcagtggtgccactcatttgtttccatgttgttgagtggcatcaacccgatcgagttttgagacaatttggaatgcaacaacctattctcgggtgtccttcgcaaccgtga

SEQ ID NO: 17679 - DNA, 246 bp, Glycine max
  Peptide Sequence Number=SeqID_109364
atgcaatcagagggactcgcactgcctcctgagcctgagaaaatcctccccgcctggttgccctatgaggggtcgacaaccattcacaacatccatttaggcaatgatcaagtcaaggttggtgttgaggaagttagagatgcaaatgctcacattcttgtacccactcaagaggttcaattagtggggcaaacacttaacatcttcattgcttggctgatacatcttgtcaagcatttatcataa

SEQ ID NO: 17680 - DNA, 210 bp, Glycine max
  Peptide Sequence Number=SeqID_109365
atgtctaatcctaaggtaaacattggatcattgcttaatcttgacagttcaaccttttctcaatactttgactctctagggggctatgcaacttcgaattgggtgaaaccaacggaaaatagcacatgcttaaaacaattgattttcactaagcacaagcgtgctctcatcaagcacggtcgtgctttgcgaaaaacttccatttcatga

SEQ ID NO: 17681 - DNA, 201 bp, Glycine max
  Peptide Sequence Number=SeqID_109366
atgaaagatgaccgatcgaggcttaaaaaagaagcgtcaccggatgacgccgatcgaacattacctaatagacatcatccaaataatattcagggattgaatagaaagctaaaggcccaagcggagaaggacgaaggcccaagtggagaaggacaaagcccccgagtggagaaggatgaaggcccaagtggagaaggatga

SEQ ID NO: 17682 - DNA, 722 bp, Glycine max
  Peptide Sequence Number=SeqID_109367
tacctattgccttcagaggactgcacgtcctcgctttcagagggctacacgccctcacctttagagggcttcacgccctcgcctgcacagggctacacgccctcaccttcagagggctacaggtccttgccttcagaggactgcaggtcttcgctttcagagggctacacgtcctcaccttcagaggacctcacgtcctcgccttcagaggcctacatgtcctcaccttcagaggactacacgtcctcgccttcaaaggactgcaggtcctcgctttcagaggactacacttccccagcttcagaggaccgcatgcccttgccttcagagggctacacaccctcaccttcagaggactacacgtcctcgacttcaaaggattgcaagtcctcaccttcagagggctacacgccctcctcttcaaaggactacatgtcctcgccttcagaggactgcacgtccttgcctgtagagggctacacgccctcgccttcagagggctgcacgccctcgacttcaaaggacttcacatcctcgcctttggagggccacacgtcctcgactttagaggactacacgtcctcgccttcagagggctgaacatcctcctcttcagagggctgcacgccatcgccttcagaggactgcatgtcctcgcctttagagggctgcacatcctcgtcttcagagggctgcacgctatcgccttcagagaactacat

SEQ ID NO: 17683 - DNA, 593 bp, Glycine max
  Peptide Sequence Number=SeqID_109368
atggcttctaggaaaagaaagacaccctctacacctacccaagtcaaatttgatagatccagattcacttcccaagaggcttgggaaagatacacagatgttattgtgcctaggaagcttttgcctgagaggaacgtggatgaggaattgactgatttcattgacgacaacatcgatgttgccattgtgaaagagttctatgccaacctctatgaccccgaggaaaaatcacctaagcaggtgagggtgagaggtcagtttattaagtttgataaggacactcttaacactttcttgaagacctttgttattatggaagagggggaatcactctgtgcttattctagatttgcactcctgaggcctgatcctcaggagttagctgccaagctctgtatcccagggaggggattcgagcttaatgttgatgggcagcctttgaagattctaaggaagaacatgacctcgctcgctcagacatggagcgttctttctttttctaacctcattcctaccttccacacatctgatgtgactttggatagagccaaattgatttacggcatcattatgaagatggatatgaacctggg

SEQ ID NO: 17684 - DNA, 60 bp, Glycine max
  Peptide Sequence Number=SeqID_109369
atggccaaccagcaggcgaccaagtccaaagccaaaggaaaagagaatcctaagccctag

SEQ ID NO: 17685 - DNA, 585 bp, Glycine max
  Peptide Sequence Number=SeqID_109370
atgttggtgcgcatgacccgcactcctctatttgcagcggcacgggtgaaatcttgccccggtatgcatagtagctgcgcgatagcctcctcctctggttgtgctcacatagttggcgctcttccaggatcagggggtggcccaggaactgaactgataaagggaaactactggcccccgtaccccagagcgcaagtctcggtgcggatatggaacccactgaaagtgaggacgcgtagccctctaaaggcaagggcgtgcagtcctctgagggcgtgtagccctcggaaggtgaggacgtgtagtcctcggaagacgaggacgtgtaatcctctgaaggagaggatgcgtagtcctctgaaggagagggcgtgtagccctctgaaggagagtacatgtagtcctctgatggcgaggacgtgtagtcctctgatggcgaaggcatgcagccctcttacagtgaggacatgtagctctctgatggcgagggttagggcgtgtagccctacaaaggcgaggacgtatagtcttctaaaggcgagggcatgtagccctctgaaggtgagggcgcgtagccctcagaag

SEQ ID NO: 17686 - DNA, 485 bp, Glycine max
  Peptide Sequence Number=SeqID_109371
cgaggaagcggaagagcgcccaatacgcaaaccgcctctccccgcgcgttggccgattcattaatgcagctggcacgacaggtttcccgactggaaagcgggcagtgggagattcagctaaagttgtgatcaaacaagacatgaagggaagaaggcataaatatgggtttaacaacaatgaacgtgagaaggcacaaaagaaaagggtggtggatgatgaaactgttgacaaacatcagctggatgaacaccaagagcggctacgcaagaagtttgcacttgaggagggaaggatatttgcagctaatgaacaaattgttaggggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17687 - DNA, 126 bp, Glycine max
  Peptide Sequence Number=SeqID_109372
atgagattggaggatctatgccaaaaggttccgactctagaaactcgaccactgtccccttcatcttcatatgctaatccttctactgtcccttcatctgtcacttctcatcgcttgaagctcgag

SEQ ID NO: 17688 - DNA, 240 bp, Glycine max
  Peptide Sequence Number=SeqID_109373
agtgaggttgggcaggttcatttgcggatgaggaagatgttgctggttgaggttcttgaccctgctttcccgacctcaatgattcgaccatataaggttgggatgattcctccacccgggattttacctgttgctggagaggtcataattgttttgttgtggctgattttgctactgaggttgaggagattgttgcacagaagggcaaaggtctgtgtggtggtcgatagaggagcataa

SEQ ID NO: 17689 - DNA, 366 bp, Glycine max
  Peptide Sequence Number=SeqID_109374
atggcacgcgccgacaaattatggtcatctgtacaccttttctatccagacacatgcaagtctgatggcacgcagagacaaattatggtcatctgcccctttttgaagatgacaatgtcttcagtcattgcatgctttcaaaaggcaacaataactctcatttacatttcgaagacgacaatgtcttcattcattgcatgctttcaaaaggtgacaatgaccttcatttacatttcaaagacaatgtcttcagtcattgcatgctttcaaaaggcgacaatgaccctcatttacattttaaagacgacaatgtcttcagtcattcaatgctttcaaaagtcgacaatatcctcatatgcattttga

SEQ ID NO: 17690 - DNA, 288 bp, Glycine max
  Peptide Sequence Number=SeqID_109375
atgcaacagggacaggcagatattctcatagctaggttccctgaccctaactatggtgtcaaaatggaaaaccacgaaggtcagaccagggcttcattcttaaccgaaaccgcgaggcaagtttggaagattccgcttcggttgaaggattcctctctgtgtggggtttcaatggagaacaacggtggtccgtggtggccaccagtggttatgggtgatggagaaggagcttgggacgttggaaatggttttggaagaaggaaggagaaagaaatggctgttttctaa

SEQ ID NO: 17691 - DNA, 585 bp, Glycine max
  Peptide Sequence Number=SeqID_109376
atgggaacaaatcaaaccgaaaaaagattctatcaagtcaagattaagggcctagatgtcaccacccttaaggagttggggcggttgatgggacctctccaaatgcaagccttccgcaaggcgtacgaaaagattttagatttgaccatagcggagatattcacgaaggtcgttgtatcactcacccaattagtaccaaccgttgaagaatttgaggagattctaggatgtcctctttggggaagaaaaccgtatcttttctccgggtttcttccctccttaagcaagattgcagttgtggtcagggattcggcaagagagtttgatcgtgtaaagcaaactcgaaacggcgtagtgggcctaccacggaagtacttggagggcaaggcaagggatatggtgaatcaagaggattcggtcccgtttattgacgtattagcattgctaatctttggggttgtcctctttccaaacgtgaacggtttggtggacctagccgcgattgatgctttccttgcatatcaccatagcatcgaattcctgcagcccgggggatccactagttctagagcggccgccaccgcg

SEQ ID NO: 17692 - DNA, 456 bp, Glycine max
  Peptide Sequence Number=SeqID_109377
atgctgaaaaccctggtcggcgaactggaagcggataacggtaccgtcaagtggtcggaaaacgcccgtatcggctactacgctcaggatcatgccgaagatttcgagaacgacctgacggtctttgactggatgagccagtggaaacaggaaggcgatgacgagcaggcggtacgcagtatcctcggtcgtctgttgtttagccaggacgatatcaaaaagccggcgaaagtcctctccggtggtgagaaaggtcgcatgctgttcggtaagctgatgatgcagaaaccgaatatcctggtgatggatgaaccgactaaccacctggatatggaatcgatcgaatcgctgaacatggcgctggagatgtatcagggcaccctgattttcgtttctcacgaccgtgagttcgtgagttcgctggcgactcgcgtactggagatcaccccagaacgc

SEQ ID NO: 17693 - DNA, 394 bp, Glycine max
  Peptide Sequence Number=SeqID_109378
atgaagaccaatatggaggccttgaaagatcaaatgacttccatgatggaggccatgttaagcatgaaccgaatgatagaaagcaacatggccgcaatagccgccaccagcgccgccgctgaggtggattcgacccatccccctgccataaaccaagcaaaccaacccatcccgaacgtgttgggtcaaggaggagaggtgttgggaagcaccagcgatccacacgtagggcataataggaatgcttacccttatggcttaccccccaattatacgccacctaccatgcacatgcccaatgagaacgctaatcacgccgttcccgttacctttgagggtcagcaaccccagcctattaggggcgcccgtgaagaacctcaggagcatgctcaag

SEQ ID NO: 17694 - DNA, 711 bp, Glycine max
  Peptide Sequence Number=SeqID_109379
atggcttctcgcaagcgccatgccgtgccctcaccaggggaagcagccaactgggacacttcccgcttcacatctgagatagcttggcaccggtaccaagacaacattcagctccggaacatccttccggaaaggaatgttgaactgggacccaggatgtttgacgagttcctccaggaactcaggaggcgcagatgggaccaggtgctgactcaccttccggagaagcggatcgacgtggctctggtgaaagagttctattcgaacctttatgatccagaggaccacagtcccagattctgcagggtgcgaggacaggtcgttcgttttgatgctgacaccattaacgacttcctcgacaccccggttatcttggaggacggggaggagtatccagcatacactagatacctcagcactcaccccgatcctgacaccatcgcggccacactgtgcactccaggggggcgctttgtccttaatgctgatggtctcccctggaagctgctgaggaaggacatgatgacacttgctcagacatggagtgtcctttcttattacgatcttgcgcccacttctcacacatctgatgttaatcttgacagggcccgcttgatctacggtttgctttatatcacagcagatcagccagattgtccagtccagcacctcgaggctcgggttcccagcgttgattacagcgctgtgtga

SEQ ID NO: 17695 - DNA, 133 bp, Glycine max
  misc_feature (130)..(130): n is a, c, g, or t
  Peptide Sequence Number=SeqID_109380
atgggggtgcaaatagcacccaggcccatttgggccctccagaagattcctccagaaggcggatctcgcaaaggtttgaaccgttcttcgacgttcttcattcgttcttcatcgttcttcgatcttcaancgg

SEQ ID NO: 17696 - DNA, 135 bp, Glycine max
  Peptide Sequence Number=SeqID_109381
caaaggaatccattgatgaagaagatcctaggcctagaagctccaatggagcttgcatcacaaaggcttctttgaatcactctgcaatccttcatacacaggggcatgtgcttgctagaaagactcttgtccaag

SEQ ID NO: 17697 - DNA, 345 bp, Glycine max
  Peptide Sequence Number=SeqID_109382
atggttagaataagaggtttagcacgtgtcgtaggtagtggtacagacagaggcatgggtcgggatgagcatgatgttgatgtttcccggcgttgtaggcctatcgcttttacctgtaggcaacgggttcaggttgatgtcactgaggaagttcctcaggtgactgaggatgttcctcctcaggtgattgaggatattcctgatgtgacaaaggatgttcctcatgtggacgaggacattccgactgtagacgtagatgtcgtggacgtagctactgatggtgatgaggggtcacctgctgatcatggcgagggattccctggtgggccacgagacacattgtaa

SEQ ID NO: 17698 - DNA, 1036 bp, Glycine max
  Peptide Sequence Number=SeqID_109383
aaacttggcaggcaaaggagaatgggtcccgttcatagacattctcgcactgttgatcttcggaggagtcctctttccgaatgtggatgggttggtggacctagcagcgatcaacacttttctcgcctatcatgaccacaaggaaagcccgattgtcgctatgctagccgacctgtatgacaccttcgaccgaaggcatgcttgcccgctggaaagccaccgttcatgcacggagaaaggaggggcaagttgggaccaactcttagcaaacaaagaaggagcgtccgtcaaatggttccctcgatggaaaaaaggaagaaccggagttcttattttgtgtggaggatttccgaatgttcccttgatggggacgaggggttgcatcagttacaatcccattcttgctataaggcaacttggctgccctatgagaggggcgctactagaggaagagctcgcgcctatcatttcacgagaggtgttgcaaaagaaggacaaggaactcaggggcagtaacaatgggcccatcgatggctaccgtaagtggttgaaagcccacgtgcaaggtttggattggatttcgagtttgagaaccgctaaaagggaggaagttgaggcaccagaggaagacgaagaggtgcaggcccttaggatagaactcgagcaagctcaaacagtcaaagaaaggttcaaatcagcagctctaaagatccgaaaggagaatgccaaactgagagatataaatgtagctaccaccaaagccttggaacaggaaaccaagagggctcatagggaagagcacgatcggaacaagttccgaggggctctgtggggcagcaacagcgagcttaagctccgaagaaaggaaagggaccaatcacgagtggacagtttgattttgaaagatgagttgaagaccaacatgttagccatcatcagcaaataccaagaagaactaaatctagccacgtcccacgagcatagagtggcggacgagtatgcccaagtgtacgtggaaaaggaggctagaggaagg

SEQ ID NO: 17699 - DNA, 322 bp, Glycine max
  Peptide Sequence Number=SeqID_109384
atgaccactcttacacagatatggatgatgttgctacttagcaacattccacccgacgaccacaatgccgatctccctcctacggaagtatcagttggtctgtgccatcatgacatagggatcgcgcccacaaggcacccagtgaacccggagaagtccaacagagccctggggtttccagctctggttacgggcctctgtcattcctacagggtgcccgtccccccaacaaggtcatgccatcatgacataggggtcgcgcccataagacaccaagtggacccagagaagtccaacaggggccctggggtttccaactcag

SEQ ID NO: 17700 - DNA, 519 bp, Glycine max
  Peptide Sequence Number=SeqID_109385
atgaaggtcacagccctcaaacaaaccagccacgacatgattgcacacataggaaaagctcgggctgcagtggaagagttgaagaggtttcttgtagctgattcgctggaggaagtgaataaaaagctggataagttctatatggttcttatcttgaggagtcttcattcagattttgatcatgtgcgtgatcaagttcttgctggagatcaagtaccatcgatggattctctcatcactaggctgcttcgggtgccccatgtgctgaaagaagaaaatctagctgacacgatggaaacatcagccatggttgcaactcgtgggagagggggaggccgtaacagtagaggaggtcggagtggtagaggtggacgtcctcaatgctcttattgcaagaggatgggccacactcaagagaattgctattctctacatggctttcctgataaagtagccaggtggctcagacagaaaaatcagagtccaagttctctgatgaagagtaccaagagtatttga

SEQ ID NO: 17701 - DNA, 285 bp, Glycine max
  Peptide Sequence Number=SeqID_109386
atgaccctacagcagtggttattctcaattaaaggccgtattggccgccgggatttctggatttggatcgttatctgggtgttgaccatgagcgcgctgtttaccctcgcgggcagcaatttgctgagtttacagaccgcggcgtttattctcgtctgcctgctctggccgacggcggcggtggtggtgaagcgtctgcacgatcgcgggagatccggcctctgggcgctgctgatgattctggcgtggatgctgctggcgggcaactgggcgatgttgccgcag

SEQ ID NO: 17702 - DNA, 627 bp, Glycine max
  Peptide Sequence Number=SeqID_109387
gcctattgggtctgtacgttgattgaagagtccgatctgctggaagcccaggcggcggaagccacctgggaagagctcaaactggcgctgccggaacttaatatcggcctcgtccacgggcggatgaaaccagcggaaaagcagacagtgatgcaggccttcaagcagggcgagatgcacctgctggtcgccaccacggtgattgaagtcggcgttgacgtccctaactcaagcctgatgattattgaaaacccggagcgtctgggtctggcgcagctgcaccagctacgcgggcgcgttgggcgcggcgccgtcgcctcccactgcgtgctactctataaatcgccgctttccaaaacggcgcagaagcgcctgcaggtgctgcgcgacagcaacgacggtttcgtcatcgcccagaaagacctggaaatccgcggccccggcgagcttctcggcacccgccagaccggcaacgccgaatttaaagtagcggacttgctgcgcgatcaggccatgatccccgatgttcagcgcattgctcgccatattcacgaacgctatccgctgcaggcacaggcgctgattgagcgctggatgccggaaaccgaacgctattccaacgcgtag

SEQ ID NO: 17703 - DNA, 320 bp, Glycine max
  Peptide Sequence Number=SeqID_109388
atggaatataagggcaaagaacttaagatcaacttggttagagttagtctatctgcaaatgaaagcgttctagctttccaagctgacaaacgttgttgcaccttatcaacaacatggctatcagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 17704 - DNA, 291 bp, Glycine max
  Peptide Sequence Number=SeqID_109389
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggtcatcaagatctaccttctcttgttctgattctgactcttcagaagttgtatcatccatcagacataggttggcttccccttctactttttcattaaagggggtgttgtccatgtcctcccaactgctcatgagacttttggacttgtaa

SEQ ID NO: 17705 - DNA, 441 bp, Glycine max
  Peptide Sequence Number=SeqID_109390
accaacatcctggcgctcaacgcctcggtggaagcggcgcgtgccggtgaacaggggcgcggttttgccgtggttgccaacgaagtgcgcaccctggccgggcgcagcgccagcgccgccaaagagattcgtgagttgatcagcgaatcacagacgcgggtcaaagagggcagcgacatggccacgcgcgctggcgaaaccatggatgagatctccagcgaagtgatgcgggtcaccgcgctgatgaaggagatctccatagcctcggaagagcagagccgcggcattgaacaggttaaccaggcggtgacgcagatggatgaagccgcgcagcaaaacgccgcgctggtggagcaggccagcgccgctacgcagtcgctggaagcgcagtcgcagcagttgcaggcatctatggcacagttccgcgtggcgacagcataa

SEQ ID NO: 17706 - DNA, 300 bp, Glycine max
  Peptide Sequence Number=SeqID_109391
atgttctatagttatgcctcatttgcgcttcaagggctcgtaccgaatttggcaacggcgaagcgtattacatctgttcaggagttaaacagcatgaagatcttccagcgctataatccgctgcaaattgcgaaatatgtaaagacgctatttaaaggaaggttgtacatcaaggatgttggcgcgtttgagttcgacaaaggcaaagtcatgttgccgcgcgtcaaggataaacagcacctcagcgtgatgtcagaaatcaaccgccaggtgctgcggctgcaagccgagtacaactaa

SEQ ID NO: 17707 - DNA, 366 bp, Glycine max
  Peptide Sequence Number=SeqID_109392
atggcacagcaaaaccctatcgatcagcagctcaatcaatgcctgaataaagagtccagcaccgccggcatgtcgcagtgctacagctcggccaataaggcgtgggacaaagagatgaatgcgcaatatagccagctgatgaagaaattaaccggtgagcccaaagacaaactgcgcaatgcgcagcgcgcctggctggcgtatcgcgatagctggaccgaggccagccgcagctatttcctcagcagtcagggctccatggcggcgctgtcagtgggcgcgcagggcgtcagtctggtgcgcaaccaggcgctgatgctgcaatcaatcaacaaaggcagttgcgccaatcccgatgattgttga

SEQ ID NO: 17708 - DNA, 546 bp, Glycine max
  Peptide Sequence Number=SeqID_109393
atgaaggaaagccagatgagtttgaaccaggtgcctgcaggtaaagatctgccagaagatatctatgtcgtcatcgagatcccggccaacgccgatccgatcaaatatgaagtggacaaagagtctggcgccctgtttgtagaccgtttcatgtctaccgccatgttctatccgtgcaactacggttacatcaaccacacgctgtctctggatggtgacccggttgacgtactggtgccaaccccgtatccgctgcagccaggttcagtcatccgctgccgtccagtgggcgtgctgaagatgaccgacgaatcaggtgaagatgccaaactggtagcggttccgcacaccaagctgagcaaagagtacgatcacattaaagatgtgaacgacctgccagaactgctgaaagcgcagatcacccacttcttcgagcactacaaagatctggaaaaaggcaaatgggtgaaggttgacggctgggacaacgcggaagcggctaaagctgaaatcatctcctctttcgagcgcgcacagaagaagtaa

SEQ ID NO: 17709 - DNA, 1344 bp, Glycine max
  Peptide Sequence Number=SeqID_109394
atgcttgatagcctgcttgtcattcttttactgatcgtaatcagttcatttttttctctgtcggagatctcgctggcggctgcccgcaagatcaaactgaaactgctggccgatgaaggcaacatcaacgcgcagcgcgtgctgaagatgcaggaacagccgggcatgttcttcaccgtggtacagattggcctcaacgccgtcgcgattctcggcggtatcgtcggcgatgcggcgttttcgcccgccttcagcagcctgttcaaccgctttatggagccggaactggcggatcagctcagctttatctgctccttcaccatcgtcaccagcctgtttattctgtttgccgacctgacgccaaaacgcgtcggcatgatcgcgccggaagccatcgcgctgcgcatcatcaatccgatgcgcttctgcctgctggttttccgcccgctggtgtggctgttcaatggcctggccaacgtgttctttcgcatctttaagctgccgatggtgcgtaaagatgacatcacctcggatgacatttacgcggtggtagaagcgggcgcgctggccggcgtgctgcgcaagcaggagcacgagctgatcgagaacgtgtttgagctggaatcacgcaccgtgccttcgtccatgacctcgcgtgaaaatatcgtgtggttcgatctgcacgaagacgaaaccagcctgaaaaccaaaatcgcgcaacacccgcattcgaagtttctggtgtgcgacggcgatatcgaccatatcgtcggttacgttgattccaaagagctgctgctgcgcgtgctgggcaaccagagcatgacgctcaacagcggcgtgcagattcgttcggcgctgattgtgccggatacgctgacgctgtcagaggcgctggagagttttaaaaccgccggcgaagacttcgcggtgatcatgaacgaatatgcgctggtggtcgggattatcacgcttaacgacgtgatgaccacgctgatgggcgatctggtcggtcaggggctcgaagagcagattgtggcgcgtgacgagaactcctggctggtggaaggcggtacgccgattgatgacgtgatgcgcgtgctggatatcgacgagttcccgcagtccggcaactacgagaccatcggcggctttatgatgtatatgctgcgtaagatccccaaacgcaccgatttcgtcaaattctccggctacaaattcgaggtggtggatatcgacagctaccgcatcgaccagctgctggtgacgcgcattgatgaccgcccgccggtgctgaatgtgtcgaagaatacgctggatgagtctgaagggcctgccgcgtag

SEQ ID NO: 17710 - DNA, 2404 bp, Glycine max
  Peptide Sequence Number=SeqID_109395
atgatgaaaaacacctcctggctggccgcggcgggcctgattgccctgacgctcaccggctgtgcccaaccgcaaaaacagcaggctcagcagcaacttggtcagcagtcggtgctggcagtcaactggttccagcagtctggcgagtatcaggcgctgagctggcaggcgttcaacacggcacgcatggcgtttgataacgctccttcgctcaccggcaaacccaaagcggtgattgttgatctggatgaaaccatgatcgataacagcgcttacagcgcgtggcaggcaaaaaacggccagccgttctccggtaaaacctggtcagcgtggacgcaggcgcgtcaggcgaccgcggtgcccggtgccgtcgaatttgccaactacgtgaatagccacggcggcaccatgttctacgtctcgaaccgcgatcagaaagactacgcggctacggtcgataatctcaacaagctgggcttcagcggcgtaagcgacaaaaccgtgcgtctcagcaccggtaactccaataaacaggcgcgtttcgacgcaattaaaaatgccggctacaacgtggtgctgtatatcggcgataacctgaatgacttcggcggcgccacctggcatcagggtaacgcgcagcgccagcagtttgtcacgctcaaccatcagcgttttggcacccagttcattgtgctgccaaatccactgtacggcgactgggagagcggcatggctgaaaactacaataagttaaccccggaacagcagctgcaggtgcgtgaatcccgcatgaaagcctggaacgattactttgaacaatatctgcatcagcagaaaccccactccctgtggattggctgttccgacagtcgcgtaccggcagaagtgctgaccggctcgcatccgggcgagctattcgtgcaccgcaatatcgccaatatggtactacccgatgatgacaactttatcagcgtgctgcagtacgcgattttttatctcggcgtcgagcgcattgtgctgtgcggtcactacggctgcggcggcgtgcaggcggcgctgggtctgcctgccagcccgttagcgcaggaggattcggcgcttgccaggcgcattgccgcgctgcgccgcgcgttgcagcagggattagtggcgtatcacgccagtcccgcgcaggaagaggagagcagcaagcttaaccggctggttgaagccaatgttatcgcccagtttagccagctggtgcgctgcgagccggtgcaacaggcgtggcaggccggacagcaactggataggaatcctcatcatgaatctgcaaacgcttcgtcaggatattcctgctggtctggtggtgtttctggtggcgctgccactgtgtctgggcatcgcgcaggccagcggtctgccgccctttgccggtctgctcaccggggtgatcggcggtctgctggttaccgcgctcagtccctcgcgctttgccgtgagcggcccggcggcggggctggtgaccattgttgtggcctcaatccagacgctcggcagcttttccgcgtttctcaccgcgctgattctggctggcgtgctgcagtgcatgctcggcctgctgcgcgccggtcgttttatctcgctgcaagcgatgccggtctgcagtcgctggtcagcggggagttttcgttttcgctcagcgcgatgctggtggccggtagcgggctgctgattctgtggctgtggaccacgcccgcgatcaaagcggttaaagcgctgagctggatgcccggcccgctggtggcggtgctgtttggctgcctcgccacggtgttgggcgatcgcctgtttcccagcctcggcgaaggcctgccgcgtatcgtactgccggcgtttgacagtatgtcggcgctggtggcggagctggaaaccccagactggctggcgtggcagaatccgtcggtgtgggtagtagcgattacgctggcgctggtggccagccttgaaacgctgctcagccaggaggcgctgaaaaaactgcgtccgcagcacccggcgccgtcaccgaataaagagatgttcgcgcagggcatcggtaacctgaccgccggcttgctcggtgcgatgcctattaccgcggtgattgtgcgcagctcggtcaacgtcagcgtgggtgcccaaaccaaactgtcgattctgctgcacggcgtgctgctgctgatttgtggcttgtggttcagcgctctgcttaacgcaattccgctcgccagcctggcggcggtgctgctgtataccggctataagctggcaacgccgcgcctgttcgtcgaacagattcgcatgggcgcgcagcagtacgtgccatttctcgccaccatcggcggcatcattgtgtttggcatgctggccgggattggtatcg

SEQ ID NO: 17711 - DNA, 3225 bp, Glycine max
  Peptide Sequence Number=SeqID_109396
atggagagtccggcgattgtcaaaatggtgctgagcgccggcgttaagggctttattggaaaaagccacaatatgcaggagatcgtccaggcgattcgccaggtggcgcaggggcggctattcctgtcgcaggaagtggcgtacgaggtggaaaacctctacgtgatgaatgaagacgccatcaacgaaaacctcgatctctccagcaaaggcaatatgtacgagaaggtcaaaaccctcagtccgcgcgaagtagaagtggtgcgctgttttctggatggacttagtgtgtcgcaaattgccgtgaagtttaaacgcagccgcaaaactgtgagcggacaaaagcaggatggccgccgtctgcttttccgcctctctgcatcacgttcccgcactgaaggggctacaatgaacattgaaacgcaatcctgcgtcattaccggcaaaaaacaggtcagcgtcgcacagcagcaggtgcagtgggacggcaccggcacgctggtgcgcatcacgcgcggcggcatctgcgggtccgatctgcactactatcaggaaggtaaagtcggcagctttgaagtgaagatgccgatgatcctcggccatgaagtgatcggctacgtggtggagagcgacgatccgcagctccagcccaatcaaaaagtggcggtcaatccctcaaagccgtgcggcagctgtaaatactgcctgcgcgagcagcaaaatcagtgcacctctatgcgctttttcggcagcgccatgtatctgccgcacgtggatggcggcttcacgcaatacaaagtggtcgatagcgcgcagtgcgtgccgtttccgcaggaggccgatgacagcgtaatggtgtttgctgaaccgctggccgtgtgcatccacgccacgcagcaggcgggcgatctgagcggcaaaaccgtgttcatttccggcgtcggaccgattggctgtctgattgccgccgcagccaaagcccgcggagccgccgagattatttgcagcgatatcagcgaacgctcgctcagcctggcgcagcagatgggcgcgaccggcgtgatccacgcggctgacggtgatttcacgccttaccttgcagataaaggctttttcgatgtcgctttcgaggcttccggccatccgtcttcgctgcagcgctgtctcgacgtggtgtgcgccaaaggcacgctggtacaggttggcatgggcggtacgattccggatttcccgctgatgacgctgatcgccaaagagatcaatctggtcggttctttccgtttcacccacgaattcaacacggcggttgactggctggcacgcggcgtggttaatccgctgccgctgttcagcggggagtatgacttacaggatatcgacgcggcgctgcagtttgccggtgataaaacccgggcggcgaaagcgggcgcggaagtgatcatcaacgccaccaccgagggcggcgcagagcagggcgcggcgaaactgcgcgagctgggttatcacgcacgggcgaaggcctttgacgtcacgcagtcggcgcaggttcagcaggcggtggaggagattgaaagtcagtggggcgcgattgatatcctggtgaacaatgccggcattcagcgccgccggccgtttctcgagtttcccgagcaggactggaacgacgtgattgccgtcaaccagacagcggtgtttctggtgtcacaaaccgtggcgaaaagaatggtgcagcgtcagcgcggaaaaatcatcaacatcggctcgatgcagagcgaactgggccgcgacaccatcacgccgtatgccgcctccaagggcgcggtcaccatgctgacgcgcggcatgtgcgtggagctggcgcgccacaatattcaggttaacgccatagcaccgggctatttcgtcaccgagatgacccagacgctggctgacgatccggccttcaccggctggctgaccaaacgtacgccggccgcacgctggggcaagccggaagagctgattggcgcggcggtgttcctggcgtcgggcgcatctgatttcgtcaatggccatctgctgtttgttgatggcggtatcgccgaaggcatgacgccactcaatgtgatggcctcgattcagaaaggcattggttccacgcttggtggcctggcgatgatcctcggctttggtgccatgctcgggcggctggtgtccgataccggcgctgcccagcgggtggccaccacgctgattgccgcgttcggtaaacagcggctgcagtgggcagctggtggtcaccggactgatcgtcggtctggcgatgttctacgaagtcggcttcgtactgttgctgccgctgcgctgtcggtgacgcactgcttcctgccgccgcatcccggcccaaccgccattgccactatttttggtgcgaatctcggcaccacgctgctgtacggcttaatcattaccatcccgacggtgatcattgccggcccgatcttctcaaaattcctcaaaagcttcgaaaagtcgccgccggaagggctgtataaccctaaaattttcaccgaagaggagatgccgggcttctttatcagcatctttgccgcggtgattccggtagtgctgatggcgattgcggcagtctgcgaactgacgatgccgaaagagaatgcgctgcgccagttctttgaatttatcggcaacccggcggtggcgctgtttatcgccgtggtaattgcggtgttcaccctcggtctgcgcaacgggcgcaaaatggagcaggtgatggatatgtgtggcgattcgattgccgccatcgccatgatcgtctttatcattgccggcggcggcgcctttaagcaggtgctggtggatagcggtgtcggtaattacatcgccgatctgatgaaaggatcgtcgctgtcaccgctgctgatgtgctggacggtggcggcaatgctgcgcatcgcgctgggatcggccaccgtcgcggcgatcaccaccgccggcatcgtaacgccgatcattgccgccacccataccgatccggcgctgatggtgctggcggttggttcaggcagcgtgatcgcttcgcacgtgaacgatccgggtttctggctgttcaaaggctatttcaacctgagcgtggttgaaaccctgaaaacctggacggtaatggaaacgctgatctccatcctcggcctcgccggtgtgctggcgctcaacgccatcattcactaa

SEQ ID NO: 17712 - DNA, 1696 bp, Glycine max
  Peptide Sequence Number=SeqID_109397
atggcgcattggcgtcaggcggaaccgccgtttctctccggctcgtggaaaaactataagcaaacgattctgctgattgtttcggtatcgctgggattgattctgctgatcctgctgtggaaccaccatctgcgcaaagtgattcagcagcgtatgcaggctgagaatgcgctgaaaaatcagctcaattttacccacacgctgtttaatgactcgccggtggcgatgtacattcgcgataagcaaacgcggctggtggattgtaataatgcctatctgcgctttttgcacatcaaacgcgacgaggtaattggcaaacgactgtcggacgtgttcaacaccaataacgccagcattcacactatcgaagatggttaccagcagacgctgctggatggtgaagcggtaatgcgcgacgtccagctgatgtttggccagcaggccttccatctgtaccactggacgctgccgtttcgcgatcggctgggggaagttgccggggtgatcggcggctgggtcgatgttaccgagcgtaacgcgctgctgcaggagctgcagctggccaaggacaccgcagacaaagccaaccgctccaaaagtgagtttctcgccagcatgagtcatgagatccgcacgccgctgcacgccatcattggtctgctggagctggaaacccgctcgcagccgtgtgagacgctgtccgaaaatattcgcgtcgcctacagctcggcgcgcgcgctgctgtcgctgatcggcgatatcctcgatctatcgaagatcgaatctggccagtatcaacccacgccggaaaccgtttacctgccggatgtgatcgatcaggcggtgacgctgtttcgcaacaaggccgaaagcaaagggatcgatctgcgcgtagagatggacatcgcggcctactgggtacaaaccgatccgctgatgatcaaccagatcctgtctaacctgttgagtaacgccattaaatttaccgatcgcggcagcgtaaccgtggtgctgatgcaggggattggccaggaagaagaaggttgtgagttcgtcattgaagtgagcgatgacggctgcggcatgaccgaggagcagcagcaggcgatctttgagccgtttgtccaggtcggtgaacgtcagcagcagcagattggcaccggtcttggcctgagcatctgccgcaatctggcagagctgctggatggcgaactgattgtggagagtacgccaggtgaaggatcggtgttctccttctacttccgcgcgccggccggcgaaccgcgcgatcaaacccaaccgcatctgtcacagccgctggtcaccgacaaactgtcagtgctggtgattgatgatcatgcgcctaatcgcctgctgctgggtaaacagctggagctggcgggccatcaggtggtggtgagcgaaagcgccgtcgaagcgctgaagctgtggcagcaggatccgctgcgctttgacctgatcattaccgactgcaatatgcccggcatgaacgggtttgaatttgcccaggcgctgcgccagcatgaacgccagcatcatctgccgccgatcatgctatacggcctgaccgcctccgccgagcagcacatcatgcagcgctgcctgcaggctggcatgaacgactgtctgtttaagccgctgaatctggatacgctgctggcacaaatcacccact

SEQ ID NO: 17713 - DNA, 1800 bp, Glycine max
  Peptide Sequence Number=SeqID_109398
atgcgggttgagcagctgatcatccccggcgcggcgctgcagccggcggaatcggtcgggcaggcgctggcggtgagttcactcaagcgcgagcgctacgtctacgtcattaatcaggccggtcagtttctcggcgtagtatcaattcatgacatttcgcgcaaagtgctggcacaggagatcacgctggattcgccggtcagcagcgtgatggatgataatttcccctgcatttaccagcaccagagcatgcgtgaaggctgggaggcgtttgcacgcgtgacgctggagcgtttaccggtgcgccagttcgtgtaccacgatcatgcgcagaaagggttccggcgcgaggcggaaaaaggtcgagatgcgaatttcggccttggctttcaggttaccgccctgcacgcgggaaatggcggtgtgcaggccaagcgcatgcttcatcactttgattttattatcccagatgaccttgctcaccggcggcgcgctgcgcatatagcggtttttcagcgcctgcgtgtagtcatagagcgccggtcgctgacgacgtcgtgtgtatcgggatacgctgctgcaaaaaggcggctaatcgctgattatcaatcagcacttgcacctgttcgaggatgttttcaggggcgaaaatcgcgcaaagtgtaccacgccggagattccatgagccaacttgaactgaccgatcgcacgctgacgcttcagcgcttcccgccgatgcgcgaagagagcccgctacaggcgtgggacgccgcagatgaatatttgctgcagcaggcgctgccggcaggcccggtgctggtattcaatgacagctttggcgcgctgacctgcgggctgaacgatcgggaaatctggcacgtcagcgactcgtggctcagccagcaggcggcccggcagaatctgcgtctcaacggtctggatgaagcgtcggtacactttcttgatagcctggcgccgttgccggctgccccggcggcggtactgattaagctgcccaaagcgctggcgctgcttgagcaccagctgcgcgcgctgcggacggtcgtcacgccggataccctgattctggcggccggtaaagccaaagacatccataattccacgctgcagctgtttgaacgcattctcggtgagagtaaaacctcactggcgtggaaaaaagcgcgtctgatttacagccatttcagcgcgccggcgctggcggacgtgccggcgaccaccgtgtggccgctcgacgagacgccgtatcatatccacaatcacgccaatgtgttcgcccgcgcggcgctggatattggcgcgcgcttctttctgcaacacctgccgcacgatattgagggcgaaatcgtcgatctcggctgcggtaacggcgtgattggcctgcaggcgctggaacagaatccgcaggccgaggtgctgttcgtcgatgaatcttacatggcggtggcctccagccagctcaacgttgagctcaaccgaccgcaggatctggcgcgctgccagtttcgggttaacaacgtgctgagcggttttccgtcggaccgactgcatgcggtgctgtgcaatccgccgttccatcagcagcacgcggtcaccgaccacctggcgtggcagatgctgcgtgacgccaaacgctgcctgcagtatggcggcgagctgcgcatcgtcggcaaccgccaccttggctatcatcagaaaatgaagaagctgtttggcaactgcgaactggtggcctctaacgccaaatttgtggtactgcgttcggtcaagctgcgttaa

SEQ ID NO: 17714 - DNA, 2347 bp, Glycine max
  Peptide Sequence Number=SeqID_109399
gatcaaatttcgcctgcctgcgccgccagggaacatgctactctgccgctttcaaagtgcaggagagccagccgtgatacgttttgccattgtgggaaccaactggatcacccgccagtttatcgacgccgcgcatgagagcggcaaaatgaaactgagcgccgtctattcacgcagccagcagcaggccgacgcctttgtcgcggattatccctgtccgctgacctttacctcactggaggcgctggcggcaagtgcggaaatcgacgcggtgtatatcgccagccccaatgcgctgcactgtgagcaggcgctgctgttcatgtcgcacggcaaacacgtcatctgcgaaaaaccgctggcctctaacctgcgtgaagctgaggcgatgattggctgtgcgcgtcagcatcaggtggtgctgtttgaggcgttcaaaaccgccagtctgccgacgttcctgcgcctgcaacaggcgctgccgcagctgggcacactgcgcaaagcgctgttcaactactgtcagtactcgtcacgctatcagcgctatctcgacggtgagaacccgaataccttcaacccgcgctggtccaacggttcgatcatggacattggctactactgtctcgccgctgccgttactctgtggggcgcgccgcagcaggcgaaagctgaggcctcgctgctggcaagcggcgtcgatgcgcacggcgtggtagtgctggactacggcgatttcgacgtcacgctgctgcactcgaaagtcagtgattccctgattcccagcgaaatccagggcgaagccggctcgctggtgatagaaaaaatttctgagtgccagcagttgcgcctgattccgcgcggcggcgagagccagaacctgacgcagccacagcacatcaatactatgctgtatgaagcagagaccttcgcccggctggtggaaacgcgccaggtggagcaccctgcgctggaggtttcacgcataaccgcccggttgctgacagagattcgtcgccagaccggcgtggtgtttccggcggatcggaaagaagatacgactatgcactctgtaggcacaccgttactctggggcagcttcgctgtcgtcgtgctcatcatgctggcgatcgatctcttcttacagggacgacgcggcgcacaaaccatgtcattcaaacaggctgccgtctggtcgctggtatggatctccgtttctctgctgtttgccgccgcgttctggtggtatctcgacggcagcgccgggcgcgaagtggcaaccgcgcaaaccctggctttcctgacgggttacgtactggaaaaagcgctggcggtcgataacgtcttcgtctggctgatgctgttcagctacttcgccattccgtctaatcttcagcgccgtgtgctgatttacggcgtgctgggcgcgattgtgctgcgtaccatcatgatctttgccggcagctggctggtcacacagttcagctggatcctctacatcttcggcgctttcctgctgtttaccggcatcaaaatggccttcgctaaagagggcgatgacgctgccgtcggcgataagccggtggtgcgctggctgcgtaagcatctgcgcatgaccgatgaactgcacggcgaaaagttcttcacccgcaaaaacggcgtgctgtttgccacaccgctgctgctggtgctgattatggtggagctgagcgatgtaattttcgctgtcgacagtattccggctatttttgccgtcactaccgacccgttcatcgtgctgacctctaacctgttcgccatccttggcctgcgcgctatgtacttcctgctggccaacgtggcagagcgcttctcgatgctgaagtacggtctggcgatcgtgctggtgtttatcggtatcaagatgctgatcgtcgagttctaccacattccggtggcgatctcgctgacggtggtcggcgtgattctcggcggtacgctgctgataatgcctgggaagcctggtaaaacaaatcatgatcggcctgattgccggcgtggcgctggcgtggctttcacgcgatgccgcgctggccgtgggcctgctggccgtggcaccgctgctggtactggtgctggtgatctcctcgattgccaaccatcagcaggggcaaaaaaccaatattcgcccgatcattatgctgtacctgctcagtaccttcttcgcggcggtggtcgcggtgattttcagccatctgttcccgcagacgctgtcgatggacgtcggcgcgaccgaaattaccccgccgtccggcatcaccgaagtgctgcacggcctgctgatgagcatggtcgccaatccgattga

SEQ ID NO: 17715 - DNA, 753 bp, Glycine max
  Peptide Sequence Number=SeqID_109400
atggacctgaacgaatcccgccgcctctaccagcaactcgccagcgaactcaagcagcgcatcgaagcgggcagttatgccgtgggggcaaagttaccggcagagcggatgattgcggaggcgcaccaggtgagccgtaccgtggtaagggaagcgatcatcatgctggaggtggaaggctacgtcgaggtgcgcaaagggtcgggcattcatgtgatcagcgaccagccacaaccgcgcgacagcgccgccgatcagctggagtttgccagctatggcccctttgaactgctgcaggcgcgccagctgattgagagcaatgtcgccgaatttgccgccacgcagatccgtccacaggacattgtggcgctgctgacgattcaggaaaaagcccggcaggaagatcacgcgcgcgattcgacatgggatatggagtttcacgtgcgcattgcgcagtccacccaaaacagcgcgctggccgccatcgtagagaaaatgtggcggcaccggctgcataatccttactggctcaagctgcacgagcacattgacgcacgccatatcaccagctggtgtgacgatcacgaccagattttaaaagcgctgatgcgcaaagatcccgccgccagcaaactggcgatgtggcagcatctggaaaatactaaacagatgctgttcgacgccaccgccgatgatttcgaattcaacgtcgaccgctacatgttcgcagaaaatccggtgatcctgccctga

SEQ ID NO: 17716 - DNA, 792 bp, Glycine max
  Peptide Sequence Number=SeqID_109401
atggagaacaccatggctaaagacaccacatctgaacatctgcgtgcggaactgaaaaaccttgccgacaccctggaagaagtgctgagcagctcggctgataagtcgaaaagcgagctggataaactgcgtcacaaagcacgcggtgccattgagagttcacgcgagcggctgggcgaatccggcgaacgcatcgcgcagaccacgcgtgaagcggcggagaaagcggacgtctacgtgcgtgaaaatccgtggcacggcgtggcgcgtggtgacaacgctggttggcatggtcgagacacgcgtgcggctggccgttgccgagctggaagaggaaaaggccaatctgatccagatgctgatcatgataggcctgaccatgctgtttaccgccttcggattgatgagcctgatggtgctgattatctgggcggtggatgcgcagtaccggctgatggcgattgccatcaccaccggcgtgctattcgcgctggcgctgatttttggtttatggaccgtgaacgtgaagcacgcattcatgaattgcttaatcaggtacagcagcagcggctggatctcagcgctgcccgccgcgactggctggaaagcaccgcgcagtacgatcgcggctggctgacgtttctcagcctgcgccgctatctggcgattggcagcagcgcgctggccatctggtcgatccgcagccccaaccgcatcatgcgctgggccaaacgcggactcggcctgtggagcacctggcgcatgatcaaatcggcgatgccgccacgctaa

SEQ ID NO: 17717 - DNA, 3669 bp, Glycine max
  Peptide Sequence Number=SeqID_109402
atgtcttcgatttatgagaaatatgacctaaaacaggtgatcaacgcctccggccgtatgaccattctcggcgtgtcgacgccgtccgccgacgtggtggataccgtcagctacggccttaatcactactttgagatcaaagatctggtcaacaaaaccggtgcctacatcgcgcgcctgctggaagtcgaaaacgcggtggtggtgtcctgcgcctcggccggtattgcccagtgcgtagcggcggtgatcgtcaaagataacgactggctgctggataacctgcacgccgcgccgctcagcgtgccgcacgacatcgtggtgccgaaaggccataacgtgaactacggcgcgccagtgggcagcatggtggcgctgggcggcggacgcctgattgaggccggctacagtaatgagtgctcgccagaacagctggcggcggccatcacgccgaccaccgcggcgctgctgtacgtcaagtcgcatcactgtgtgcagaaaagccatctcagcgtcgaacaggcggcggtggtcgcgcgcaaacacggtattccgctgattgtcgatgcggcggccgaagaggatttgcagtgctattaccagatgggggccgacctggtgatctacagcggtgccaaagccatcgaagggccaaccagcggcctggtgattggccgcagccagtacgtcgagtgggtgaaacgccagagcaacggcattggccgcgcgatgaaagtcggcaaagagggcattctcggtctgactcaggcgattgaaaactacctgctgcagagcaaaaccagcggtgctgacatggtggcgaagatgacgccctttatcgataacctcaacacgctgaacggcgtcagcgcgcgcgtggtgtgggatgccgctggtcgtgacatcgcccgcgctgagatcaaatttgatgaagcggtgacgggctggccgaccggcgagctggtgcaggcgctgaaaaacggcgacatcgccatctatttccgcggctataaagccaacgaaggcattatcgaagcggatccgcatccaggcgctgctcagcggaggaaaacgcgcatgaatcttaacgccaatttctatcagggccgtctgtgcctcaacgtgctggccggttcaaagcagaatgcgcaggcgatctggcaggcggcagaagggcatgtgctggtcggcgttttgtcgaaaaactacgcctcgaatgaggccgcgattgccgatatgcgcgagtacgcggcgctgattgataatgcgctgtcggtcgggctgggcgcgggcgacccgaaccagtcggcgatggtcagtgaaatctcggcggaactgcagccgcagcacgttaatcaggtctttaccggcgtggccaccagccgcgcgctgctcggacagtcacacaccatcgtgaacggtctggtttcaccaaccggcacgccgggcaaggtgaaaatctccaccggtccgcgcagttcgcaggcggcggacggtattgtgccgatcgccacggcgattgccatgctgcaggatatgggcggcagttcggtcaagtatttcccgatgggcggcctgaaagcggtggaggagtatcgcgcggtggcggatgcctgtgcgcgccatgatttctggctggagccgaccggcggtatcgatctcaataatttcgaagagatcgtacggattgctctggaggccggggtcagtaaagtcatcccgcacgtttacagctcaattattgatagcgccagcggcgacacgcgcattgacgatcgtttagctcaactcttcgcggcgctgcaaagcgaaacgctgccacaggatgagctggcgcggcgtttttccgtttcaacgcgcacggtgcgcaccgacatcaccgcgctcaatgcgctgctggaacagcacggcgctcagttcgtgctggcgcgcggcgcgggctatcagctaaaaatcgacgacgcggtgcgcttcggccgcctgcagcaggagagtgcggcaccgctgcgggtgccgcgcacctcgcaggatcgggtgcgctatttgctgagccgctttctcaccgccgcgtattcgctcaagctggaagatctgtcggaagagtggttcgtcagccgcgccacgctgcagagcgatatggcggaagtgcgcgagtggctgggccgatatcatctcaacatcgaaaccaagccgcgctacggtatgaaactgtttggtagcgaggcggcgattcgcacctgcctgaccgatctgctgtggcaaatcgaccagcagacgccggacagcccgctgctgacggtcgaggcgctgcacagcggcatgctggcgcagctgcagccgctgctggcgcagtgcttcacgcagcacgccatccggctgagcgatgaaggcgagcgctacctgctgatttactgcgcggtggcggtgcgtcgcatcagcgaaggcttcccgctcagcgatcccggcgcggaggatgtcggcgaggagatacgcgaggcggcgcacgatctggttaatctgatgcgtccgctggtgggtaaaggcatctcgcaggcggaagagaactggctgcgcgttaacattgcggcgcggcagattcaggcgctggcccccagcaccatcaatgcggatgacgcggatgcgctggtggattacctgcttaactacatcaacactcattacaactatcggctgcagcaggatgagcagctgcgcgccgatctgctcacgcacatcaaaaccatgattacccgcgtgcgctatcagatccacattcccaatccgctgctgagtaacatcaagcagcactatccgatggcctacgatgtgacgctggcggccgtcaccagctggggcaaatacacgccgtataccatcagcgaaaacgaaattggctttctggtgctgcacatcggcgtcgggctggagcgacattacgatgtcggctaccagcgacacccgcaggtgttgctggtttgcgacagcggcaactccacgctgcgcatgatcgaggcgctgctgctgcgcaaatacccgcagctggtggtgacggcgcggctgtcgcagcgtgactacgaagtgcgtgcgcacattgatgaagattttgttatttcaaccgcgcggctcagcgagaagaacaagccggtagtgatgatgtcgccgttccctacggagtttcagctggaacagctcggcaagctggtgctggtggaccgcacccggccttacatgctggagaagtacttcgacgcgcagcatttcatggtgctcgaccggccaatgagccagtcggcgctgttccgcctgctgtgcgatcggctcgaggcggagggctatgtcgatgctgatttttatccttcagtcgaagagcgtgaagcgattgtcagtaccatgctgggcgaagggattgcgctgccacactcgctgggattactggctaaaaaaaccgtggtttataccgtgctggcaccgcacggcgtgagctggggcgatgagacggcctcagtgattttcctgctggcgatcagtaagagtgaatatgaggaggcgatggcgatttacgatctgtttgtcaccttcctgcgcgaaagggcggtgacaagattgcgcgactgcgctgatttcgtcagctttaaagcggtggcaatggattgtctgagccggttgtga

SEQ ID NO: 17718 - DNA, 981 bp, Glycine max
  Peptide Sequence Number=SeqID_109403
atgcgttcggtggacgaaggggtaaccgccatcgacgaaagcgcctccgtgctcggttttggcttcatggataaagaagagctgggtgagcgtctgggcaaaggcgacagcaaagcaaaagccttcgccgatgcgctcagcaaggtgcagcagcaggtgctgcgcaccagccagaaaattctgttgcgcattgaaccgcttgatgtgcggcgtggagctggaaattaccgtcagcgtcactgtgatcgacaccgagagcgtgaccttcacagcaattcgttgatcataggtggattagtcggcgtgggcgttggagcgggcgcggcgcgcatgttccacgcgcctgtcacgcaggggatgggtgccttccgtacgctgggcgagctcaactcctgcgagggcgatccggcttcgcacttctcctttggtctcggcttcttctttaacgcctgggcatcctccgttgccgcgggctccttcacgcaggatgtggatcaccgcattctgccgaactggggcgcggccgcactgatggtaaagaaccgcaacgtcgcggaaacgctgcataacccgaaacgcatggcgattgcctgcggcatcatcggcatgatcgtggtggccttcctgaacagtaccgcttctgccgtaccggctgcgctgcaggtgactgcggtaaaagtgctggtgccggcggcgaatctgctggtgaacacggtgatgccggtgatcttctggctggcggcgatgatgccgttgatcatgggtaacgccgtgccgggtctggtgctgggcattctgatcggtaaaggcgtggaagagagcggctggaacaaagtcaccaaagtgatgatggctgcgattgtcctgctgtttgtgctgagcggcttcttccgtggcttcgatgtgaaactgctgcaatccttccagctcggcatccctggctggctcgacatgatccacaacagcctgagcggcaaataa

SEQ ID NO: 17719 - DNA, 1362 bp, Glycine max
  Peptide Sequence Number=SeqID_109404
atgtctttattgtccggcgattttcatctccggcagcagcaccgatccgcattgtatattgctgcgcgtttcaatgtcgttaccgaccgttaccatattgagccacatatctttgaggttgcccgcaattgtgatctcgctcacagggtattgaatttcaccgttttcaacccagaagcccgccgcaccgcgcgagtagtcgccggtcatggcgctgacgctggaacccatcatctcggtaacgatcaaaccgcgtcccatctgcttcaccagatcgtcaaagctgtggccctgaccggcgatgcgccagttatgaatgccgcccgcgtggccggtgctttgcaggccgagcttacgcgccgaatagctggtcagcagccagttctgcagcacgccatctttcacgatttcgcgcgcttcggtgcgtacgccttcgctgtcgaacggcgtcgacgccagccctttcagcaggtgcggcttctcttcaatcgtcagccacgacggcagaatctgctggcccagcgcgtcgagcaggaaggtggatttgcggtaaacgctgctgccgctgatcatgcccaccagatggccgaacaggccagtggccacttccggcgcaaacagcaccggcgctttcatggttggcagcttacgcggcgaaagacgtgccagcacgcggcgcgcgcactccgcgcccacccagtcggcgctttgcagatcgcccatcgcgcggccaatggtataggcgtagtcgcgctccatgtcaccattgtgctcggcaatgacgcagctcgacagcgaatgccggctcgagcagtagctctgcagcatgccgtggctgttaccaaagactttgatgccgacgtggctgttaaagctgccaccttcggtattggtgatgcgcttatcagcctgcagcgcggcctgctcggcctgcgcggccagctcaatggcgcgatcggcgtcgatctcccacgggtgatagagatcgagatccggcgcctcgaacgccagcagatcgcgctcggccggcgcagcacagggatcgggcgaggtgtagcgcgcgatatcgatcgccgcctgcacggtgcgcttaatcgcgtccgggctgagatcggtcgaggaagcactgcctttgcggttttggtgatagacggtgatgccaagcgcgccatcgctgttgaattcgacgttttccacttcgccgtagcgggtactgacaccgattccggtggttttggtgaccgccacttctgctccgtcggtgctggcttgcgccagttccagcgcctgcgcgacagcctgttccaacactttacgttgttctgcaacctgagtagatacgttcatcgacctgccgtctaa

SEQ ID NO: 17720 - DNA, 327 bp, Glycine max
  Peptide Sequence Number=SeqID_109405
atgacatacaagacttggaagcaagtccctgctgctcagaaggattggatatgggaggatattcaggcacttgcagccgacaaggacagtgtcgatgacactatatgcaaaaaatacgacattagcaaggagaaatggacccaattttgtcagagccgcagagacccctcgtgggaggatgtgtggaaaaagacacaggccatccagaagcaaaacattgtcccccatgtgttgtctcgtaggggttatgaatatttagaaaacaagatgatggatgagaagagaaataaaaaaaacaggaggaagctgctcaatccgaaagcatag

SEQ ID NO: 17721 - DNA, 396 bp, Glycine max
  Peptide Sequence Number=SeqID_109406
acttatcaaggtaatccttgtggcgtctacccagacttatcttccttcattggaagtggcgtctacccagacttatcttccttaaccggaagtggcgtctacccagacttatcttccttcaccggaagtggcgtctacccagacttatcttccttaaccggaagtggcgtctacccagacttatcttccttcaccggaagtggcgtctacccagacttatcttccttaaccggaagtggcgtctacccagacttatcttccttcactggaagtggcgtctaccctgacttatcttccttcactggaagtagcgtcatccaaatctccgtaacctgtatcaaacgatccgctcctactcaggttcacatcatctggtatcagagcttcggctcttga

SEQ ID NO: 17722 - DNA, 369 bp, Glycine max
  Peptide Sequence Number=SeqID_109407
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgtgatggagaacttgttgtgatcctacgaaggatcctctag

SEQ ID NO: 17723 - DNA, 282 bp, Glycine max
  Peptide Sequence Number=SeqID_109408
atgtatgacacgttcgaccgaggatgtgaaaagagcggcgcaagaattgtttgttgtgcactggctctctatgtgtgggctggtttcacacccttttttctccaagaaggtaggcccgtctatccgctacaaggtcaccgctcgagtcaagaacttccccgattgctagccaaggacaaagcagtggcggacacctactccgcccccgaggagatccacggacttctcagctattgtcagcatatgatagacttaatggaccatatgattggaaaccgctag

SEQ ID NO: 17724 - DNA, 294 bp, Glycine max
  Peptide Sequence Number=SeqID_109409
atgacatcaagctcagggataacaggtaaaatcaaggatgctacaggtgtgtcgggtgttgacaagtatcccctaagcgtgcagaatatcaaatttggatctaaattgtatgtcaacgctgatattacagagatacacgaatttcgtcaaagtttgtctgtcccattttattctggtgggataatcaatgataaagatggttctcagtcccaatctagccagagtaatgtggtggaaaaatttctgcagaatgctcaagtggtcagtataggtgaaatcaacaatctcagataa

SEQ ID NO: 17725 - DNA, 276 bp, Glycine max
  Peptide Sequence Number=SeqID_109410
atgacaaaagagcctgaccagaggattacccttgaggattactcaagtagttcagtaccacaatttttcaccagcattgcacgtcctgaagtgcaagctaacaacatcaactacccacattctttaattcagttaatacatgggaacttatttcaagaattacctaatgaagacccccatgcacacttggaaatgttcattgaaatatgtaacattgttaagattgccagtgtaccagacgaagctattaggctcagccttttctcattctcattg

SEQ ID NO: 17726 - DNA, 192 bp, Glycine max
  Peptide Sequence Number=SeqID_109411
atgaagcacttctctgacaccctcatcagtgccaacatagtaagccaggtacacttcgctagcgcccaatacgcaaaccgcctctccccgcgcgttggccgattcattaatgcagctggcccgacaggtttcccgaccggaaagcgggcagtgggcgcaacagcaattaatgtgcgatcataccagcattaa

SEQ ID NO: 17727 - DNA, 399 bp, Glycine max
  Peptide Sequence Number=SeqID_109412
atgaaagataagagggatgaggaagaaaaactagaaaaacaaaagaaaaagaaggatagtaaggcattgtcttcaaaggccaatgggaaggaaaaagaggaaaaggattcctctaagaagattgttaagaaggaaaatcattttgcaacaaaaggtgatatcaaaagagcactccttcttgaacaatctttcaactttctcctatcaagggaaacatcccttagcactgtcatacctcttgagcttgaggttattcctcaagtaaaggagttattggatgagggtttggttcgtgttgagggaagaagcccagagtttcaagaacctctggatttgaggtcaaatccttttcaagggggagggaatgatgcaatcctactccccaagggcattggatag

SEQ ID NO: 17728 - DNA, 384 bp, Glycine max
  Peptide Sequence Number=SeqID_109413
atgttgaagggagagccgcctgacgccgtctcttttgcgataggctcgattaatcggcgcctcgatgaatcgataagacgccaagccgcacacgatcgtcagcagcaaagccagaacacctgtgatgagcaccgacacgatacccgacaaccccgttaccccgacagccttcattgcaatttgaatcaccagattgtggacgagatagatggaatagctggcatttcccagatggatcagcagccaatgccttgcaacataaccgttctgttcaaggaagacgcagccggaaaccaacagcagtcccgaaacgccccaggtcagaggccgcacaatgttgttgttatagagctcgaatcccgagcttgtcgcgagaatgactga

SEQ ID NO: 17729 - DNA, 72 bp, Glycine max
  Peptide Sequence Number=SeqID_109414
ggaattggaaaggaggattggtggcatccattgaagaatttcagtcaagaagcaaggggccaaccatcttaa

SEQ ID NO: 17730 - DNA, 766 bp, Glycine max
  Peptide Sequence Number=SeqID_109415
atgggggcatttgcgctgttagcagggatttgtcaggcacaggaagtaaatgtatttgtttcaggcgaagaaggctataagagctaccgtatccctgctattgtaaaggataaaacgggacagctaatcgcctttgcagaaggcagggtagatcataccggagattttggtaatgtggatattgtttataaaatcagtcaagataatgggaaaacatggggtccactgcatgttgccgttgacaacgataatttgcaagtcggcaacccagcacccgtagttgatctgctagacccggcatatcccaaaggacgcctgttacttttttataatacgggcaataatcacgaaggcgaagtacgcaaaggcaatggcttgagagaatgttggtccattagctcggccgacggcggaaaaacctggtctaatccacagaatattacgcttgagacgcatcgccccaatcagccttcggtaaatgcgcagtataactttcaggaggattggcgaacttatgcgaatacaccaggacatgcattacaatttgattccggtaaatataaaggacgtatatacattccagctaatcactccgaaggaaatccgaagtcagatggcaaagattattttgcgcattcttattattcggacgaccatggaaaaacattcaaaatcggtgcgagtgtaaaatttgaaggatcaaatgaaacaatggccgcacaaatatcggggacaggattatacatgaattcccgcaatcagcaag

SEQ ID NO: 17731 - DNA, 53 bp, Glycine max
  Peptide Sequence Number=SeqID_109416
aaatgggataagatatcccgacacagtgccggtgttgataccccccaagaacg

SEQ ID NO: 17732 - DNA, 375 bp, Glycine max
  Peptide Sequence Number=SeqID_109417
atgcaaatatccataagggatgtaccctcccttgttctctttgaacaacctagcggatgtacctccacaagaactgatccacaagagatgtaccctctcttattctcagtcacaacaacccaagtagatgtaccctctacttgtaccacaaaggatgtaccctccaatgtgttaagacaaagttctcagacgggaagaatcaaaagaattctcagactgtgtcgttttgaattctttgacaagggagaagggagacacaaaagaattcagacggttagtcctttgttcttttggaaaagggagaagagagacacaaaaagaattcaggcgattagttcttggcaaattctttttggcaaagggagaagagaatga

SEQ ID NO: 17733 - DNA, 120 bp, Glycine max
  Peptide Sequence Number=SeqID_109418
atgccacttcaaggagaagatgagtcaagaagaagctcaccaccacaagaagccatggataaaagcttgaagcccactaatccaagatcaagtccaagattctccactaactgtgattag

SEQ ID NO: 17734 - DNA, 531 bp, Glycine max
  Peptide Sequence Number=SeqID_109419
gtgcgagaacaaatgaaggccgatatggaggccttgaaggatcaagtagcttccatgatggaagccatgttaagcatgaagaggaagccatgttaagcatgaagagaataatggaaagcaacgcggccgcagttaccgccgccagcgccaccgccgaggcagatcctacccatccgtttgccacgaaccaagcgcaccaacccacctcggacatggtgggacaaaaaggagaggtgttgggcaacaccggtggtccacagatcgggtataatagaaatgcttatccctatggcttaccccccaattatacgctgcccaccatgcacatgcccaatgagaacgctaatcatgtcgttctcattaccttagagggaggcgcccgtgaagaacctcaggagcatgctcaaggtgacttcgacccatatcccacattcaccaccgaggggatgccgtttaatgttgtgcctcaacctaataccgtaggagctcctcaaccccaccctttgcaaccactgcatttctctgtagggg

SEQ ID NO: 17735 - DNA, 147 bp, Glycine max
  Peptide Sequence Number=SeqID_109420
atgtttgctaaatttctcattttcttctgcaatgcttcaatttttagaatagcttgtacgtcttccatggtggcaacgacgaatgattctaccagaaaatgtagaagaactgtcacttgcagacatggagaaatcaaagcccactag

SEQ ID NO: 17736 - DNA, 447 bp, Glycine max
  Peptide Sequence Number=SeqID_109421
atgccctcctttcgcgatttggagcagaaatgggcaccaaaggttgaagctttgttgggcaacaatggtggaggaagaaatgggatcaacataggcttaaaggagcactcaaaccaggtgtatttacccccaaggcctacactccaaagagtccatcaaggcctctccctcctgattcaggatgaaaagacaattattgctgatatgaacaagtcaatggtgaaatcaagaaacattctgctaacgttgaaggagcacaatgccaatagttgtacaacaatcaaagaaatatacacgatttcattgacaacattgtggatgtcaaaggtgacggtatgggtgaagattcttggtcgttggtttgcaaccatttccttaaagaacttgccaaatggtcagatgactatatcaagctcttcggtggcacagacagattcaaggaattaa

SEQ ID NO: 17737 - DNA, 291 bp, Glycine max
  Peptide Sequence Number=SeqID_109422
atgacaaaagaatggagaaggaagagagagaggatatgccacttcaaggagaagatgagtctagaagaagctcaccaccataggaggccatggataagagcttggaggaagaaggagatgaatgaagggagaggaagagaagagcacgaaattttatgctctaaaagagctctgaaatctgaaatatggttcagcccactaatccaagatcaagtccaagattctccactaagtgtgggtgtcatgaggcatgtaaagcatgaaggacatgcacaaagtgtgactatatga

SEQ ID NO: 17738 - DNA, 222 bp, Glycine max
  Peptide Sequence Number=SeqID_109423
atggacgggttagtggacctagcggcaattgacgctttcctcggctttcacaacagcaaggaaagtccggttgtcgccctcttggccgatatgttaatgaggaaagtttgtgaagtgttgattttcatcctctcgctaagccaatctgctggcttagcgagccatccactaaacgcaacactcctttggtttagcacgaggaagaatttggaagaaggatga

SEQ ID NO: 17739 - DNA, 318 bp, Glycine max
  Peptide Sequence Number=SeqID_109424
atggtcctctgtttaccattaccggcgccttttggcgttgttggggtgcagtgccccggggatttctacgtctgtggactgcatgcagacgtgctgctcatcctcgctcttattactgacctcgagcctgccaaggtatcccccttactcccactgcggggaaccacacctgcctcttacagggcttcaaagataaaccctcttcaggctaccacgtcttccaaatgcttaggccgcagcgacccacatacatccacggcattcacggtgaagcagtgctcgattgagtgccccgcggtccctccgtggtacgcatag

SEQ ID NO: 17740 - DNA, 414 bp, Glycine max
  Peptide Sequence Number=SeqID_109425
cggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcccagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtaactgaacaagagggacagctgatagaaacagaagccactggagcacctcaaaaacaccatcatacactaaatcagtaa

SEQ ID NO: 17741 - DNA, 454 bp, Glycine max
  Peptide Sequence Number=SeqID_109426
gcatctcactgaaacatgtatgcgagcgaggaattttgatatctatggattcttcgagcctcagtccattcagaggtctgggcaatcgcaatttgaatctgaaagttacataaagagttggatgcaaagttcacaacgcgatgtgtatcttggagcctacctaaatgggttccactgcagcggacattggcagatggtggtcatcctgcccaaggaacacttagttttctgtgctatcaagggtcttgatgatgctccacagcctaaatcaaaggcttttgctaggtggattgtcatcaagtgtaatagacaaaaaggaagtactgagtgcggctactatgtgatgtactggatgtccaccatcattttaggaacttttaggaataattgggaagcgtattttaacgatcctagaccattggagccagagagattaaaagcattgcggatctag

SEQ ID NO: 17742 - DNA, 313 bp, Glycine max
  Peptide Sequence Number=SeqID_109427
atgactagaggcaatccatctaacttacaaccctttgatcctgagatagataggacatttcatagattagttagacgtcatttaattccttttgagcatcctgagcattctgttattggtgattttgagcattatagttttgaacattctgagaatatggcacaacctccaccccgtgagaggactctaagggaaatggctgcacctgatttcacctacgaaagcttgtgcatccaataccatgatgaggatgtcccatatattcttaaaacaggactgatccatttgcttccaaagtttcatggccttgcag

SEQ ID NO: 17743 - DNA, 308 bp, Glycine max
  Peptide Sequence Number=SeqID_109428
ggattgtgcccacaaggcacccagtggactcgaagaaagccaacagggtcttggagttgccaactctgattacgggcctctgtcagttctacggagtgcccgtcacccccaacaaggtcatcaggccccctactaatcgtgctttcatcaagaggtactgcgcccctaggcaggcgcaaggcgaaacaccacaacggcctggggatggccagcaacagacaacaaatgcaccgccgccacctccaaagcccctcagctcatccacaaaaaggttagagtattgcctacgacacatggccgaccaatag

SEQ ID NO: 17744 - DNA, 594 bp, Glycine max
  Peptide Sequence Number=SeqID_109429
atggtagtctattatacagagtttgatgagttcaaggaggaactcgagagacgccattgggatgagaagctgactgatttttctgatagcagtatagacatcgccattgtgaaggagttttatgccaacctctatgaccccgaagataaatcatctaagcctgatcctcaggagttggctgctaagctttgtatcccagggaggggattcgagcttaatgctgatgggcaacctttgaagattctaaggaagaacatgactatgctcgctcagacatggagcgttctttctctttctaacctcattcgtacctcccacaaatctgatgtgacattggatagagccaaattgatttatgggattattatgaagatggacatgaacctgggctacctcatctcccaccagatctctcggattgcacaacatgacaaatccagacttggattccttgctgtcgcaacatgcccttttgcgggcgagcgaggcgagcctcacgggtgtgctttccaaaggaggaaagatgcgcggagtcaccaccaacgtttatttgtgggaaacatcggaaaaatcgaaggaaaccggtcaaaataa

SEQ ID NO: 17745 - DNA, 438 bp, Glycine max
  Peptide Sequence Number=SeqID_109430
atgactaagaatttggagcactgtgatatgactaagatggattttctcagtttttgctttctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17746 - DNA, 858 bp, Glycine max
  Peptide Sequence Number=SeqID_109431
atgtccttgccatcagagggtcgcgtaccctcaccttcagaggactacctgtccttgccttcagaggactacatgtcctcaccttcagaggactacacgtcctcaccttcagaggactacacgtcctcgccatcagaggactacacgtcatcgccatcagaggactacacgtcctcgccattagaggactgcatgtcctcgccttcagggttacacgccctcacctttagagggttacacgacccttaccttcagaggactacacgccctttcagagggctacgcgtcctcgccttcagaggactacacgtcctcgccatcagagggctatacgtcctcaccttcagaggactgcacgtcctcaccttcagaggactatgcgtcctcacctttagaggactacacgtcctcgccatcagagggctacacgtcctcaccttcagaggactgcatgccctcaccttcaaaggattacacgtcctcctttttagagggctacacgccctcgccttaagaggactacacgtcctcgccttcagaggactacatgtcctcgccttcagaggactacacgtcctcaccttcagaggactacacgtcctcgccatcagagggttgcacgccctcaccttcaaagggttacacgccctcacctttagagggttacacgccctcaccttcagaggattacacaccctcgccttcagaggactacacattctcaccttcagagcactgcacgtcctcaccattagagggttgcacgccctcgccttcagaggactacacattctcaccttcagaggactgcacgtcctcaccatcagagggctgcacgccctcgccttcaaagggtga

SEQ ID NO: 17747 - DNA, 351 bp, Glycine max
  Peptide Sequence Number=SeqID_109432
atgcattcacatcctcgactctctagtgaagaagatgttgcaaatatgtgcttgatggcggattcaatggatgattcttcaaccattgaagacattgaggtaaattttaaatttgaagaagttttggaagcaattaatgaaatgcatgatgaagcgcaaaggcttgctatttcaaacaataagctgagaagcgatctaaaactgcaaatcactaaattggcttcgatacaaagtgaactggataaattgagacaagaaaatgaaaaacttgtttcaagctataaagcctctggttgtgtttgtgcatctactagtcttaatatgaatgattacaaatctttgcaaatttag

SEQ ID NO: 17748 - DNA, 764 bp, Glycine max
  Peptide Sequence Number=SeqID_109433
ttggaacctcttacgtgcccgatcaacgtctcatttcgccaaaagttgggcccagggcttcccggtatcaacagggacaccagggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcaatcggtgcgggcctcttcgctattacgccagctggcgaaagggggatgtgctgcaaggcgattaagttggaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17749 - DNA, 168 bp, Glycine max
  Peptide Sequence Number=SeqID_109434
atggttgaaactagccaaataaacactaaaagaggtgtgaaagataagctctttaggtggttggccccttgcttcttgactcaaattcttcaagatatggcaccaatcctccttcccaattccctatatggcaactcacaagcaaggaaacaaagagacaagcaataa

SEQ ID NO: 17750 - DNA, 836 bp, Glycine max
  Peptide Sequence Number=SeqID_109435
gaaggcaaggaaggagttcttttctcgtgtggggactaccctaatgttccattgatagggactaggggttgtattaattataatcccgcactcgccataagacagctagggtaccccatgaggggagcgccaacagaagaaagtctctcgcctttccttgtgagggatctaggcgcgcaaagtctcaaggtgatacaaagagtccacaaggcgtggagaagtccgttgaggaaagacaaggagcttagaggcatccgaaatggcgtcatcgatggttatcatggatggctaagagttcacacgcgagggttagattggctctccaaattgaaggttatcaatgaggagaacttcgaagctccggaggaagatgaagaagtccaagctctaaaattagagctagggaaggcgagactcgccaaagagaagttcaaatcagccgctacccacatccggaaagaatgcaccgacaacaatgagctcaagctccgaagagaggaaagagaccggtcacgggtgcatggcatgatcttaaaagaagagttagctgagctcaagctccgaagagaggaaagagaccggtcacgggtgcatggcatgatcttaaaagaagagttagctgcgagcgcaaggtccaagaggagtttggctcaacacgtggaagccacggagcaaagcatgctagctatcatagggcaatacaaggaagagttgaaccagtctgtgacccatgaacaaaagctagcggaggattttgcacaagtgtacgccgaaaaagaagcaagagggagggtgattgatgcattgcatcaagaagcgactatgtggatggatag

SEQ ID NO: 17751 - DNA, 741 bp, Glycine max
  Peptide Sequence Number=SeqID_109436
atgacaccggtaaaccgaaaggcaggaacaggagagcgcacgagggagccgccagggggaaacgcctggtatcttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17752 - DNA, 132 bp, Glycine max
  Peptide Sequence Number=SeqID_109437
gaggtttctggactatggaaagctaaattctctgttggatcttcccttgggaactggtctgattctaaagtccttgatagtacaggactaagttgttgtgctatcacgagggatcggggtacaagaacttag

SEQ ID NO: 17753 - DNA, 456 bp, Glycine max
  Peptide Sequence Number=SeqID_109438
atgactaggagcaatccaagtgatttacaaccctttgatcctgaaatagatagaacctttcatagattacttgggcatagtgtgcatcctaatcattctgtgcattttgagcattctaagtattttgttgctggtgattctaaacattctgattttgagcattcgactactaattttcatactgagaacatggctcaacctccacctcgtgagaggactcttagggagatggttgcacctgatttcacttatgaaagcttgtgcattcaatatcctgataaggatgtttcatatgttctcaagactagactaatacatttgctgcccaagtttcatggtcttgcaggtgaagatcctcataagcatcttaaggagttccatattgtctgttccaccatgaaacccccagatgtccaggaagatcattgttggatcaagtggtctcggaataattaa

SEQ ID NO: 17754 - DNA, 428 bp, Glycine max
  Peptide Sequence Number=SeqID_109439
ctctcgatgagtcgatctcttgctttctcataagggtggacccttgggtacttgtacctatcacctttagaggactacacgtcctcgccttgagaggactacatgtcctcgccatcagaggactacatgtcctcgccatcagaggacttcatgtccttgccatcagagggctgcacgccctcacctccagaggactacctgtcctcgccttgagagggctacacgccttcaccttagttaccctcaccgttgagaggactacacgtcctcgccttgagaggactacatgtcctcaccttcagagggctacatgtcctcgccatcagaggacttcatgtcctcgccatcagagggctgcacgccctcacctccagaggactacctgtcctcgccttgagagggctacacgccttcaccttgggtactag

SEQ ID NO: 17755 - DNA, 123 bp, Glycine max
  Peptide Sequence Number=SeqID_109440
atgtcgcaacctaccctcggcgggagggcgacgcgagggctcacgggtgcatcttccaaggaaggaaaatgtgcggagtcgccaccaacatttattcgaggaaaacgtcggaaaaccggaaag

SEQ ID NO: 17756 - DNA, 498 bp, Glycine max
  Peptide Sequence Number=SeqID_109441
atggatttcaacaagctggacacaagggaaatgctaggtgcacccagcaatattgctgacactgtttgttcgaacaacttcttcttctctcccggaaaacctgcttcttcttctcttctctgtgaaccttcttctccgcgaggcgcgcccaaggttttcttcttcttctccgcgaacagaggggagaagacgagagtacgccagaaaaaatggggaaaaaggctgacggcggagtcttccggaagacccgttaggggttctgttcttccggaagtaaccaaacgtcttctggaagaacacttcttccggaagactcccggaacacctcttccggaagtttcggaagaaccttttccggaaagtttccggaagaagtggttcttccggaagaattccggaagacgtgctcttccggaagaactttcaaatttccggaagaactttccgaaagaagtggttcttccggaaaaattccagaagaaccacttcttccgaaaa

SEQ ID NO: 17757 - DNA, 345 bp, Glycine max
  Peptide Sequence Number=SeqID_109442
atgttagtctctgcgcgtcaacgagctcgtttgcccctggttgacaaaaggtgcgggaccataaggttcccccgcatgtcacttgacttcacgggtcaggacgacaaaaggcttgttggccgcgattgtcaaagggtgcagaagacgacgttagtttatgcatgctatcatgcgttgagtcttagagatagaaaaagaaagtttgcgggttaccgtcaggtgtctccgcatgccaccggactcttgggtcacggtaacaaacgtggggtgatcgacaaaagcagggcttttgctcctatgtatcctcaatttgtgatgaggaactatgacctacgtagttcttga

SEQ ID NO: 17758 - DNA, 120 bp, Glycine max
  Peptide Sequence Number=SeqID_109443
atggatccttcttctcatcactctgattcagattggcccattgacatcaggaaagctaaaatcactaccgttcgtctgtttcttgctatggctgccatgcgtcactggcccctccattag

SEQ ID NO: 17759 - DNA, 1045 bp, Glycine max
  Peptide Sequence Number=SeqID_109444
atgggagcattaatcgccggagcaaaatataaaggagaatttgaagagcgtttgaagtctgtcgttaatgaggtaataaaatctgacggacaaattattcttttcattgatgaaatccacacattagtaggagctggtggtggtgaaggcgctatggacgctgcaaatattttaaaacctgccttggcaagaggagaattgagagcaataggtgccactaccctgaatgaatatcaaaaatattttgaaaaggacaaagcccttgaaagacgttttcagaaagtaatggtggaagagccggatacagaatctgcgatctctattttacgtggaattaaagataaatacgaagctcatcataaagtaaggattaaagatgaggctattattgcagcagttgaaatgtctcagagatacatctcagaccgattcttaccggataaagcaattgaccttattgatgaggcttctgccaagttgagaatggaaatcaactccaaacccgaagaacttgatgtcctggatagaaagcttatgcagatggaaattgagctagctgctatctcaagagaaggcaatcagactaaaatagaccatttaaaagaagatatttcaaaaatttccgaacaacggaatgagattaatgcaaaatggttgaaagaaaaacaaaaaagtgaagatcttacacagattaaaaaagatattgaatctttaaaactagaagcggaaagagcttccagagctggagattatgctaaagtagcagaaatccaatatggaaaaatcaaagaaaaagaagatgacttgcagaagctggaacttgaaatgcaaaatcatcagaacgagttaataaaagaagaggtaactgcagaaaatatctccgaagtaattgctaagtggacaggaattcctgtaacaaaacttttacaatcggaaagggagaaattgctgcaccttgaaacagaacttcatcacagggttgtgggacaagaagaagccattcaggctgtttctgatgcgatcagaagaaaccgtgcaggattga

SEQ ID NO: 17760 - DNA, 588 bp, Glycine max
  Peptide Sequence Number=SeqID_109445
atgtccaaatcttgtggatttgggatgaccggccctctcgatgagtcgatctcttgctttctcataagggtggacccttgggtacttgtacctatcgccttcagaggactgcacgtcctcaccttgagaggactacacgtcctcgccttgagaggactacacgtcctcaccatcagaaggctgcacgccctcacctccagaggactacacgtcctcgccttgagagggctacccgccctcgccttggggctacacgccctcgccatcagaggactgcatgtcctcaccttcgtagggctacacgccctcacctttagaggactacacgtcctcgccaacagagggttgcacgccctcaccttgagaggactacacgtcctcaccatcagagggctgcacgccctcaactccagaggactacacgtcctcgccttgagagggctacccgccctcgccttgggtactagttaccctcaccttcagaggactacacgtcctcaccttcagagggctacacgccctcgccatcagaggactgcatgtcctcaccttcgtagggctacacgccctcaccttagaggaccacac

SEQ ID NO: 17761 - DNA, 759 bp, Glycine max
  Peptide Sequence Number=SeqID_109446
atgaggggagcgccaacagaagaaagtctctcgcctttccttgtgagggatctaggcgcgcaaagtctcaaggtgatacaaagagtccacaaggcgtggagaagtccgttgaggaaagacaaggagcttagaggcatccgaaatggcgtcatcggtggttatcatggatggctaagagttcacacgcgagggttagattggctctccaaattgaaactagggaaggcgagactcgccaaggagaagttcaaatcagccgctacacacatccagaaagagtgcatcgagttacaagaggaaaacgcggccactgcaagagcccttgaacaagaaactaaaagggcccgcaaggaggaatatggccgagagaaattccgaggagcattgtggggtagcaacaatgagctcaagctccgaagagaggaaagagaccggtcacgggtgcatggcatgatcttaaaagaagagttagctgcgtgcgcaagatccaagaggagtttggctcaacacttggaagccacagagcaaagcatgctagctatcatagggaaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgacctggaatggaagtcaagacctcccgcgtcttttagccaaagaaaaagccatggccgaa

SEQ ID NO: 17762 - DNA, 736 bp, Glycine max
  Peptide Sequence Number=SeqID_109447
gggtgaaggtcaaggtattggacccagcagtcctcagggatcgagtcagagaagttcatctgaagaacacttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacaaaaaaacgcgaaaatggcgccagactggatgcccagaaacaggcacatatccttctgctcgagaaagcccgagctgctcaacatgaagtcgaacgtctcaccaaagaggcgaaagaaggatcttctgagatcaaagcctgtgatgataacatctcctcctgggaggcaactattacggatttgctgtctcaggtcgatgatctaaggcaaaaaattgtgacggagcaggccaaacgcaaggaactccaggagaaggccgctaactcgattcagaaacaggttgctgaaaaagggagagaaggcctgaaggcctttagcgcatctcaagctgtagcagatgaggcgagagttatggagagtgctgaccaggtcttaactaaagagatggccaccttgaagaaactatatgaggacttggtcatgcattag

SEQ ID NO: 17763 - DNA, 648 bp, Glycine max
  Peptide Sequence Number=SeqID_109448
atggctacctcaccaaaagatactgcagctcctggttcacccgctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccaccccagatgttgctgtgcctgatgttgataaagatgttccaacatcctccgctccaaatgctgaagccctcccttcacccagtgaagaggaatcaacagaagaagaggatcaagcctcagaggagactcctgcaccacgggcaccagaacctgctccaggtgacctcattgacctggaagaagtcgaatctgatgaagaacccattgccaacaggttggcacctggcattgcgaaaagacttcaaaacagaaagggaaaaaccccccttaagaggtctggacgaatcaagaccatggcacagaagaagagtaatccaatcattcctgccacatccagaagaagcaag

SEQ ID NO: 17764 - DNA, 423 bp, Glycine max
  Peptide Sequence Number=SeqID_109449
atgaccctttcatcatggcagaacaagctaaacatgtattttatgtgcacgacccttgtgatgaaaggtggttcgtggttctacaaaggaaaacaattggtgttaatgcccaaggctactccacctgccacgcctcctccttctcctcctcctcctccttctcctgcagtagcattagcgtcttcttctaccttgaagtggacaagcaaagacacacggctacgatccttggccactagaccaccaagggcagagagaccggtggtccacgtcaatcctgcaaccaggaaggccgacgatccctacaagaagaaattaagaacatatttggggattgtcgctcgtgataaggtcgacgtgacatacaagacttggaaggaagtccttgcttctcagaaggatttgatatgggaggatattcag

SEQ ID NO: 17765 - DNA, 252 bp, Glycine max
  Peptide Sequence Number=SeqID_109450
atgcctcagcaacctatgctattctgtgaggtgtttgatgtctggggcatagatttcatgggcccttttcctgtctcttttggtttggagtacctaaagcaattgttagtgatcaaggaacccatttttgcaacagaacaatgcatgccctgcttaaaaagtacggagtggtacacagggtatccacaccataccatccccagaccaatggacaggcagaaatttctaacagggaaatcaagagaattctag

SEQ ID NO: 17766 - DNA, 539 bp, Glycine max
  Peptide Sequence Number=SeqID_109451
ctaccaccaaagccttggaacaagaaaccaagagggctcgtagggaagagcacggtcggaacaagttccgaggggctctgtggggcagcaacaacgagcttaagctccggagagaggaaagggaccaatcacgagtagacagtttgatcttgaaagatgagttgaaggtttgctcaaggtccaaaagaaacttgtctcaacggttatgcaaaacagaaaccaacatactagccatcgtcagccggtaccaagaagaactaaatctagccacggcccacgagcacagagtggcggacgagtatgcccaagtgtatgcggaaaaggaggctagaggaagggtgatcgactcgttacatcaagaggaaacaatgtggatggaccgatttgctcttaccttgaatgggagtcaagaacttccccgattgctagccacggccaaagcgatggtggacacctactccgcccccgaggagatccacagacttctcagctattgtcagcatatgatagacttgatggtccatatgattagatcttga

SEQ ID NO: 17767 - DNA, 396 bp, Glycine max
  Peptide Sequence Number=SeqID_109452
agtggtgatgagatcaaggtgttccctgcgtgtgttgatcaattgttgggtaaaacttgggttgtcagattcaaacaccgtatacagatgcaccaatcatatgcgttggattttagtgaacaggaacatcatatacagtcagtgatatccacgctaggtctacaagatgaacaatgtataagcaacaagtctgccgctgttggtgttgcatcttcatcacaacaagattaccatcctacaccttcattgtcacagtcatctgaatatgatcctggaaatgttgcctttgtaacttctgcaaaaagaacgtccgatcagcaaggaagtagtcagtttgatagtgacgacttcacaacatatgaactatcgaccaacaagcatataaaagttgagtaa

SEQ ID NO: 17768 - DNA, 98 bp, Glycine max
  Peptide Sequence Number=SeqID_109453
gagttactaggcaaataattttggaaaaagttaaaaatatatcgacagttgaagtaaaagggtacattgaacaagatgagttcaaggaattaccataa

SEQ ID NO: 17769 - DNA, 423 bp, Glycine max
  Peptide Sequence Number=SeqID_109454
atggatcaactccaacgtcaagccttctgcaagacatatggaaagatctgggatttggctatgatagaagtgtttgttgaagccattgcatccctcattcaatattatgaccagccgctaagagtcttcctctttccaaacgtggatgggctagtagatctagtagtgatcgatgcttttcttgcttatcaccacaacaaggaaagttcggtcgttgctatgttggtcaatgcctatgacacattgaccgaagatgcgagaagagtggagcaaggattgtctgtggcacacccgctttgtatgtatggctggcttctcacatttttcgccatgaaagtagacatgcatgtcccctacaaggtcaccgcatgtgtgccgagaaagggaaagcaaattgggagcagctcttggctggtacggtag

SEQ ID NO: 17770 - DNA, 315 bp, Glycine max
  Peptide Sequence Number=SeqID_109455
atgtggatgttgttttacacaaatgagcatatcttaaaagcttactccgcacaatggtggcctcttgggaatgaagcgacaattcctccttctgatgacgcatggacacttatccctggtccaactacaattcatgcgaaagaagaacacaacaagcgtcgattgatggaagcttgcttgtggggcttctatggaggctggatctttgagcttcaatgggatcctttaatggtgattttccaccatggagatgcagcggaagacaatggttgcaccactcaaaacattcatcataccacctattttagggacttg

SEQ ID NO: 17771 - DNA, 464 bp, Glycine max
  Peptide Sequence Number=SeqID_109456
gactctgccagtcgttcggagtccccgtcgcacctagcaaggtgattcggccgcccatcacccaagcttttgttgagaagtattgcacgcagagacaggcccagggggatgctccgcaggccacagacgtgccgccacctcatcaggctggcccagctggatcaattgatacggagcagtatttacggcatttggttcgccagcaggcggccaaccaccgagcgaatgtacagacccatgatggtctttaccagttgagcctcagcctgcagagccagggttttacttcttttccatgccctactccggatcactttagggcagaggtcgcatggcccggagattggcctgaggcccgggcaggagaggcaccagcagaggctcccgacgaggcagatgaggcccgcgaggacgaggagatgaccgatttgtttgatttcttgggagggagcgaggccacatga

SEQ ID NO: 17772 - DNA, 441 bp, Glycine max
  Peptide Sequence Number=SeqID_109457
gcgaggctcacgggtgcgctttccaaaggaggaaagatgcgcggagtcgccaccaacgtttatttgtggaaaacgtcggaaaaaccgaaggaaaccggtacttacccgttgaagaacgaagaacggatgaagaacggggaggagcttgccacccagctcgcccaggcgagctcagctcacccaggcaagcaaggttgcttcctccagaagcaaccgccttctggaggaagaaactggaaggcccaaaagttacggaaactcacggattgcgcaaaaacacctcctttcgatttccgtcacattactaaaattggattgtctactttagtgccacgttggatagtctacgtggcactaaaattgccaacaatgcacctcactaacggtgttactttcaaatttaacagcaaggactattttgcaacactgatgcaaagatag

SEQ ID NO: 17773 - DNA, 533 bp, Glycine max
  Peptide Sequence Number=SeqID_109458
atgaccaccaatcttgctaagtcgattactttcatactcaagaaattaagaaatatggcaataggcatgctagaagtactaaacaaggtcatcgaagacgcacttagaaaggcaaacactcacaatattcttgagttcgatcgacgcgacacacggttcttggtgaaagagacaataaacctgagagaggttcaacccgttggagatttcacggtcaagttggatgaaagaggattctgggcattttcttacttaaggtggaagcaacctagctcgcctgggcgagctgggcagcaaccacctcccccggttgcttctggaggaagcaacctagctcgtctgggcgagctgtgcggcaacctcctccccctttttcctataaaaaggcaaaagggggttgttccaatgaaccctgatccccctggctatgcatttcagctccaaggtgcttccgtaacgcttctgagacgtttccgtgagcaaatccgtgaaggttttccgtcgttcttcatccgttcttccttcttcaacgg

SEQ ID NO: 17774 - DNA, 270 bp, Glycine max
  Peptide Sequence Number=SeqID_109459
atgaccctcaaaccgaatgaatgcgagaagttatgctccattggagcttgtaggcctaggattttcttcatcaatggattcctttgcttcttggaagatgaatggcagcggaatgaagaaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 17775 - DNA, 279 bp, Glycine max
  Peptide Sequence Number=SeqID_109460
atgcatgcaaacatagagaacaattccgagacgtctcagaaatcaaaaggaagcaggcttgtgcgatccgtgaaattccgtaatgtggcggaagtcgaaaagaggttttttgcgcaatccgtgagtttccgtagcttcttcgcaagaagattcctccagaaggctgttgcttctggaggaagcaaccttgctcgcctgggcgagctgggcggcaagctcctcccctattttgctataaataggggaagaagtggagaagaaaagggttcagccccttag

SEQ ID NO: 17776 - DNA, 734 bp, Glycine max
  Peptide Sequence Number=SeqID_109461
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggatttgtaagctttggggctggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17777 - DNA, 153 bp, Glycine max
  Peptide Sequence Number=SeqID_109462
atggataagagcttgaaggtaggagaagatgagtggagggagagggagagaaggggcacgaaatttatgcctcaaatgagcccactaatccaagatcaagttcaagattctccaataagtgtgcttaggtgtcatgagacatgtaaaacatga

SEQ ID NO: 17778 - DNA, 258 bp, Glycine max
  misc_feature (44)..(44): n is a, c, g, or t
  Peptide Sequence Number=SeqID_109463
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 17779 - DNA, 465 bp, Glycine max
  Peptide Sequence Number=SeqID_109464
atggctccattgccgtcactccaaaatggtcaaaggactacacgtcctcgccttgagaggactacatgtcctcgccatcagaggactacaagtcctcgccttgagaggactacacgtcctcgccatcagaggactacatgtcctcgccatcagaggactacaagtcctcgccttgagaggactacacgtcctcaccatcagagggctgcacgcccttacctccagaggactacatttaccctcaccgtcagagggctacacgccctcaccttgagaggactacacgtcctcaccatcagagggctgcacgccctcacctctagaggactacatgtcctcgccttgagagggctacacgccctcaccttgggtactagttaccctcaccgtcagagggctacacgccctcaccttgagaggactacacgtcctcaccatcagagggctgcacgccctcacctctag

SEQ ID NO: 17780 - DNA, 927 bp, Glycine max
  Peptide Sequence Number=SeqID_109465
gaattagaccacaggaagcaagtcgaaaatggggtggttggaataccgagaaaatatttggaggcaaaagccagaatcttggcaggcaaaggcaaatgggccccgttcatagacattcttgcactattgatcttcagaggagtcctttttctgaatgtggatgggctcgtggacctagcagtgatcgacgcttttctcgcctatcatgaccacaaggaaagcccggttgtcgctatgctagccgacctatatgacacctttgaccgaagatgtgagaagagtagtacgaggattgtttgttgtactccagctctttatgtatggttggtttcgcacctttttcgccaagaggtaaggcatgcttgcccgctagaaagccaccactcaaacacagagaaaggagacacaaattgggaccaactcttagcaaacaaagaaggagcgtctatcaactggttccctcgatggaaagaaggaagagtcagagttcttatttcgtgcagagggtttccgaatgttcccttgatggggacgaggggttgcattagttacaatctcgttcttgctataaggcaacttggctaccctatgagaggggcaccactagaggaagagctcgcacctgtcatttcgcgaggtttcaataagaccaacatggagacacttcagaaggtccgcaaggcatgggaggttgtgcaaaagaaggacaaagaactcaggggaagtaacaatgggcccatcggtggctaccgtaagcggttgaaagcctacgtgcaaggtttggattggctcccgagtttgagaaacgctaaaaaggaggaagttgaggcaccggagaaaaatgaagaggtgcaagcccttaggacggaactcaagcaagctcaaacagtcaaagaaaggttcaaatcagctgcattgctgaggtga

SEQ ID NO: 17781 - DNA, 270 bp, Glycine max
  Peptide Sequence Number=SeqID_109466
atggagtcaagtgacatgcgggggtaccgtatggttacccgcacttttcgtcaactaggggcaaacgagcccattgccgcgcagagactaacgtcgtcttctgcaccttttgtcatcctgacccatggagtctggtggcacgcggagataccttatggtcatccgcacctttcatcaagctggggtgaaattctgatgctggggacagatgtcgaacaggatgtcacgacatcacgcttcagaacatgcagattgtgtgtgactgtatga

SEQ ID NO: 17782 - DNA, 342 bp, Glycine max
  Peptide Sequence Number=SeqID_109467
atgtaccctctacttgtaccacaaaggatgtaccctccaatggaatgggaagaatcaaaagaattctcagactgtatcgttttgaattctttgacaagggagaagagagacacaaaagaattcaggcggttagtcccttgttcttttggaaaagagagaagagagacacaaaaagaattcaggcggttagtccttggcgaattctttttggcaaagggagaagagaatgaaaagatgaatagcacaagttttcaaggtttagaaaaccagaaaacttcagaaagcttttggtacaaaagaagaagaagaagaagaacttcaaagagatttcaaggcttctaa

SEQ ID NO: 17783 - DNA, 216 bp, Glycine max
  Peptide Sequence Number=SeqID_109468
gctggagaggaaaggaagttgcaactaagtgagctagatgagatctatttagaagcctatgagaattccaaattctacaaggagaagaccaagaagtttcatgatagtttgatagctaagaaggacttcatgttgagatcaaaagggagcccacagataagagcttcaaggtcaagggacacgggcggaaacctttcgtcacaaatccctccttag

SEQ ID NO: 17784 - DNA, 228 bp, Glycine max
  Peptide Sequence Number=SeqID_109469
atgtttggaacgggatggtgcgtagcagttgggagagctgggtctgcctcgacagccgtgctagcgacagccgcggtggccgcattgctctccattagtcatttcattcccagcatggcctccatcatagaagccattggttctttcaaagcctacatgtcggctttcatctgttcctgcacttcctctaggtcacccatcgtcctagatttggatctggtgcgatag

SEQ ID NO: 17785 - DNA, 420 bp, Glycine max
  Peptide Sequence Number=SeqID_109470
atggaagccgttgtatcactcacccaatactatgaccagcctttgagatgcttcacgtttggagacttccaattagtaccgactgttgaagaatttgaggagattctaggatgtcctcttgggggaaggaaaccgtatcttttctccgggtttcttccctccttgagcaagattgtagttgtgcaaagagagcccggtggtagttatcttggcggacttagtgtatggttggttttgcacctattcaatcatgatataaggcatccatgtccgctccgaagccatcgctcgtgtgtcgaaaagagaagagtagattgggaccaacacttggctgggataagaggaaggaaaggagggagttctcttctcatgtggggaatacccaaacatcccattgatagggacgaggggttgcattaa

SEQ ID NO: 17786 - DNA, 95 bp, Glycine max
  Peptide Sequence Number=SeqID_109471
atgacttgctcgatcgagaacagcgcgatcaacacgccggacagggccgcggggatgtacttccagccggtggagattcccaggttggggatcct

SEQ ID NO: 17787 - DNA, 117 bp, Glycine max
  Peptide Sequence Number=SeqID_109472
atggagttgcagcggaagataaagaagaagagcctaggtagcttccttgagaagcttccttgggaagcaagtgttacacccctccagctaagctcacccccatgccaaaatacatga

SEQ ID NO: 17788 - DNA, 495 bp, Glycine max
  Peptide Sequence Number=SeqID_109473
atgtggatggatagcaaaaccataaaggataaagccaccgcaaccgcctccagtacagttagggaagcggagtcggtgctgcagcccgccttgaatccgggcctagacagaaacacgaccgtgttcggtcgaaggtatagtccgcaagcttatccttatggcctgactccggacttcatcccccgtgccaccccagaagatttaagccaagcccctactttcgaggggcaactcccaccttatgaagactatcccgggcaagacgatggggaaggagatacccatcttggcaccctgctccacctcaaagatctgtccccacatgaactaccccaaccgaacatagtccgccataccccggcctcacccacacccgtaaaagaatctgttccctttgcggaagataagggaaagattgaggcgcatgaagagaggttgagagcagtcgagggcctcggcaattacccattctcggatttagcggatttatgtctc

SEQ ID NO: 17789 - DNA, 843 bp, Glycine max
  Peptide Sequence Number=SeqID_109474
atggaaatctttattcaatcaattgatcctggtgcatggaatgccatcattaaaggtcctttcattcctactaaagaactgaatggtgaattaatacctaaagaatggaatggtgaattaatacctaaagaaatgagaaaagatgagaaaagaaaagttcaagatgatcaaaaagctaaaaatatttttacttctggaaaaaagtttgaagatgaagagctgaacatcaagattttgaattgtctcacaagaacttttgaaccaaagattacaacaatcaaggaatccaagaatctagctacaataatgatggaagctctcttcggtaaattgctagcctatgaacatgaactgactcaacaatcttatgaagaagaaatagaaaagaaaatgaaaggaattgcgttgaaagtaaactcctcaagggaagaatacaaagatagttccagcagtgaggtagatgcagagaacttcaacttgatggtaagaaaatttggaaaaattctcaagaaatccaaggacaaaaaattctccaaatcctctaagaaaattgagaacaacaataactacacattctttgaatgtgaaaacatggtgaaaagaaaggaaagaatgacaaaaaaacaaaagagaccctacatagcatgggaagatagtgcatcaacaacttccaactcttctgatgaagaaattgcaaacgtatgcttaatggcaaaatccatgaatgatccatcaacaagtgaaaaagttgaggtgtcataccctaatttcgtccggggacctttgcttgatgacatgcgacctttctttggtccttgtgaggtgcttggcacccatcattag

SEQ ID NO: 17790 - DNA, 315 bp, Glycine max
  Peptide Sequence Number=SeqID_109475
atggcagatcaagaaagtgcacatgaagaaacaactcatggtcctaactatactccttcatattctccttctgctcatgctccttcagcaacaccaaatgaatccatagtagcacctgaagtagaagaaacaaccgataatctggaggggacaatagaaaaaggaaaaagtaggcttaaaagttctttgaaatctaaaattcttgaacaaagtagtactttggtaaatgagatagcttcagatgatgaaggtgaaacatcaatttatgcaagtgaaatgatgggaagtggccttactacccacttggagcaatga

SEQ ID NO: 17791 - DNA, 279 bp, Glycine max
  Peptide Sequence Number=SeqID_109476
atgactaagcttccaaagaatgttccttcaagggaaaatacaagcaaacctattgagaagaagaccaccagtgaggaactgaaggatcttagtgaaattgatgatggtggttcaatcatccaaataaagagaaaggctaaagatcaacaacagatacatgctatccaaaagaagcaaaaggttgctaaaaggtccacttttgaagatcctattctacactccaaggtgccaacgaaaatgaaaaccaaggcaacgagattgaacaaagccattcgataa

SEQ ID NO: 17792 - DNA, 418 bp, Glycine max
  Peptide Sequence Number=SeqID_109477
atggctccgataaagctttccgtgaaaagatctaggagtgacactgtggctgaagggaccagtgccgcccccgagtttgatagccaccgtttcaggagcgccgagcaccaacagcgtttcgagcccatcaaaggatggtcgttccaccgagagagacgcgtccagctcagggatgatgagtacaccgactttcaggaagagatagctcgccgacgttggatgtcgctggtcacccccatggctaagtttgacccagagatagtcctggaattttatgtcaatgcttggcccacagaagagggagtgcgggatatgcgatcatgggtgaggggtcagtggattccctttgatgcagatgccctcagccagttcctaggtgacctgttggtgttagaggaaggccaggagtgcgagttta

SEQ ID NO: 17793 - DNA, 420 bp, Glycine max
  Peptide Sequence Number=SeqID_109478
atgtcatctattatttgtaggggtagcgcccacaagacacccagtggacccggaggagcccaacagggccctggggtttccaactctagttacgggcctctgtcagtcctacagggcgcccgtccccccagaaagtcatgccatcgtgacatagggatcacgcccgcaagacacttagtggacccggagaagtccaacagggtcctggggtttctagctctgattatgggcctctgtcagttctacggagtgcctatcactcccagcaaggtcatcaagccccctactaaccgagctttcatcaagaagtactgcgctcccaggcaggcgcagggcgagacaccacagcagcctgggatggccggcagcaggcaacagacgcaccgccgccacctccaaagcccctcagctcatctataa

SEQ ID NO: 17794 - DNA, 543 bp, Glycine max
  Peptide Sequence Number=SeqID_109479
atgaagcacttcactgacaccctcatcagtgccaacatactggtaccgggccccccctcgaggtcgacggtatcgataagcttgatacatccagccactgccgcagatcgaccagcggcagcgtgtgcgaacggcggtcgagcacggcacggccatcgaaccagcccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17795 - DNA, 694 bp, Glycine max
  Peptide Sequence Number=SeqID_109480
atgtcttatcgcatcaccaaaggtgaagacctgcgcgagcagaactacatgggcattcacaccgtgggtcgtggctctgagcgtccaccggtgctgctggcgctggactacaacccaaccggcgataaagacgcgccagtatttgcctgcctggtcgggaaaggtatcaccttcgacaccggtggctacagcctgaagcagagcgcgttcatggactccatgaaatccgacatgggcggggcggcaaccatcactggtgcgctggcgtttgcgattacccgtggcctgaaaaaacgcgtgaagctgtacctgtgctgcgcggacaacatggtaagcggtaacgccttcaagctgggcgacatcattcgctaccgcaacggcaaaaatgttgaagtgatgaacaccgatgcagaaggccgtctggtgctggctgatggcctgatcgacgcttctgcccagaagccagagttgattatcgatatggccaccctgaccggcgcggcaaaaacggcgctgggtaacgactaccatgcgctgttcagcttcgacgacaagctggcggcccgcctgctggcaagcgctgcggcagaaaacgaaccgttctggcgtctgccgctggcggagttccaccgcagccagctgccgtctaattttgccgaactgaataacaccgcgagcgcggcatacccggcgg

SEQ ID NO: 17796 - DNA, 138 bp, Glycine max
  Peptide Sequence Number=SeqID_109481
atgggtttgtcaggcttaaaggagcactcaaacccggtgacccccaaggcctacactccgaagagtccgttagggtctctccctcctgattcaggtccaacccctaaaatcattttagcacgcagacactgctcgtga

SEQ ID NO: 17797 - DNA, 115 bp, Glycine max
  Peptide Sequence Number=SeqID_109482
gggacaaattccccggacccccgcattcctagattgcatctgtgtctgtcatactcctaatttcgtccggggacctttgcttgatgacgtgcgaccattctttggtcctcgtgag

SEQ ID NO: 17798 - DNA, 55 bp, Glycine max
  Peptide Sequence Number=SeqID_109483
atgccaccctttaactctactgctctgcaagtctgccaaacctccatatttggag

SEQ ID NO: 17799 - DNA, 693 bp, Glycine max
  Peptide Sequence Number=SeqID_109484
atggtgaaagttggaacctcttacgtgccgatcaacgtctcattttcgccaaaagttgagcccagggcttcccggtatcaacgacaccttattatcaccacttctgcgaatgtctatgcttcctttgtcacaggctgctcccattcgccattcgggaaacctgtcggcaactgtaatgaggaacgcgcgggcgatcgaggcgggcctttgcgtattacgccggcgctaaagggcggatgtgtgatactggcttactatgttggcactgtgccagggtgttcagtcgaagtgcttcgtggagaaaaaaaggcgaccggtgcgtcagcagaatatgtgaatacgactcactataggccgcttcccgctcctgactcctaccgctcggtcgtcatgcggcgacggaaggctctagaacggggcggattcccccggaagctgcaggaattcgatatcttaacggacagtgagagccgccaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttcccgg

SEQ ID NO: 17800 - DNA, 562 bp, Glycine max
  Peptide Sequence Number=SeqID_109485
atgaatattcgtgatcttgaatacctggtagcgttagccgagcatcgtcactttcgccgcgcggcagattcctgccacgtcagccagcccacgctgagcggtcagatccgcaagctggaagacgagctgggcgtgatgttgctggagcgcaccagtcgtaaggtactgttcacacaggcaggtctactgctggtggatcaggcgcgcaccgtgctgcgcgaggtcaaagtgctcaaggaaatggcaagccagcagggagaggcgatgtctggcccactgcatattggcctgatcccaaccgttggtccgtacctgctaccgcacatcattccgatgctgcaccagacgttcccgaaactcgaaatgtacctgcatgaagcgcaaacccatcagctgctggcacagctggacagcggcaagctcgactgcgccattctggcgctggtgaaagagagtgaagcctttattgaagtgccgctgttcgatgagccaatgatgctggcgatctacgaagatcacccgtgggcgaaccgcgatcgtgtgccgatggccgatctcgccg

SEQ ID NO: 17801 - DNA, 927 bp, Glycine max
  Peptide Sequence Number=SeqID_109486
atgaccataaccgctttgactgtgtcagcgcaaagcaatgatgcgggaaagttaatttccgatttgcatccgcaacttaagggcatggttgatctgcctttgcagcccatgtctgacatcagcgagttcaccgacggcgtcgacgttgtgtttttagccaccgcgcatgaggtcagccacgacctggcgccgcagttcctggcggctggctgcgtggtgtttgacctctccggcgcgttccgtgttaacgacggcgcgttttacgaaaaatattacggcttcactcaccagcatccggatctgcttgaaaaagcggtgtatggcctggcggagtggagcgcagacaagctgaaagaagcggatctgattgccgttccgggttgctacccgacggcggcgcagctctctttgaaaccgctgatcgacgccgggctgctggatctgaaccagtggccggtgatcaacgccaccagcggcgtgagcggagccgggcgcaaggccgctatctccaacagcttctgcgaagtgagccttcagccgtatggtgtgtttaatcaccgccatcaccctgaaatcaccacgcatttgggcgcggacgtgattttcacgccgcatctgggcagcttcccgcgtgggatcctcgaaaccattacctgccgcctgaaaccaggtgtgaccagtgaacaggtgaaggcggtcttcacgcaggcgtatgcagataaaccgctcgtgcgtctgtatgacaaaggcgtgccggcgctgaaaaatgtggtcggtctgccgttctgcgatatcggctttgccgttcagggcgagcatctgatcgtggtggccgcagaagacaacttactcaaaggcgctgccgctcaggcaatgcaatgtgcaaatattcgtttcggtttcccggaaacgcaggctcttatttaa

SEQ ID NO: 17802 - DNA, 180 bp, Glycine max
  Peptide Sequence Number=SeqID_109487
atgcacctcccccaactgatttctgatgtcatctattgtttgcagggattgtgcccggagtgcctgtcgcccccagcaaggtcatcaggcccccctactaatcaagctttcatcaagaagtactgcgcccccaggcaggcgcagggcgaaacaccacagcagcattgggatggccggtag

SEQ ID NO: 17803 - DNA, 271 bp, Glycine max
  Peptide Sequence Number=SeqID_109488
acatggttacggcgcgcttacctcgacggtggacggtgacgaagctccctcgacggtggacgatgacgttgctcttcacggaaacctcctcaatacacctcacggcaagctccccttcacggcaacaatggtgattgaagaagaagaaaaacctcttcccagcaacctcctcttaactgcaacaatggtgacaaatgaaaacgccggtgaggcgagcaagaagaagacaaaaacagctgaggtgaggaagaagaagaacaaatctggctga

SEQ ID NO: 17804 - DNA, 438 bp, Glycine max
  Peptide Sequence Number=SeqID_109489
atgccaatctccccctgcagatgtatcggttgggatcgcgcccataagacgcccagtggacccgaagaagtccaacagggccctggggtttctagctctggtcacgggcctctggagtcctacaaggtgcccgtccccccagcgaggtcatgccatcgtgacataggtaagaatcacacccacaaagacactcagtggacccggagaagtccaatagggccctgtggtttccagctctggttacgggcctctgtagtcctacagggtgcccattccccccggcaaggtcacatcatcatagggatcgcgcctgcaagacacccagtggactcgaagaagtccaacagggtcttggagttgtcatgctctaattacgggtctctgtcagttctatggagtacctgtcacctccagcaagggcatcaggccccctactaa

SEQ ID NO: 17805 - DNA, 342 bp, Glycine max
  Peptide Sequence Number=SeqID_109490
atgccgatttccccctgtggaaggattgcatccacaagacacccagtggacccggaaaagtccaacagggccctggggtttccagctctggttacgggcctctatcagtcctacaggttgcccataccccccccccccgcagcaagggatcgcgcccgcaggacacccggtggacccaaagaagtccaacagggtcctggggtttccagctctgattacgggcctctgtcagttctacagagtgcccgtcgccccaacaaggtcattaggccccgcattaaccgggctttcatcaagaagtactgcgcccccagacgggcgcagggcgagacaccacagtag

SEQ ID NO: 17806 - DNA, 426 bp, Glycine max
  Peptide Sequence Number=SeqID_109491
atgaagcacttcactgacaccctcatcagtgccaacataggtgttttcggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17807 - DNA, 588 bp, Glycine max
  Peptide Sequence Number=SeqID_109492
gctagttatgactcatccagattggtatcaagggatgcctgggactgttacgtagataacatccttgaccggaatattcttccagagaggaatgtgaagctatacattactgagtttgatgaattcataagagaagtcaagaggaggaattggcacagggagctcactaatttttttgaaggaagcatagatgtggcagttgttaaaaaattctatgcaaacctatattaccctgaggacaaagcaccaaagcaagttagggttcaagggcacctgattaagttcgatgcggactccctcaacaccttcttgaagactctagtggttgaggccagacccttaagagctgggcttgccgtggaagctcttgaggaaggatcttacaactctgtaatgaagatggacatgaacataggagcatttatatctggacagatctcgctcattgctcagtccaactcctcgaggcttggatttccagccctcatcattgccttgtgcaaggcccgaggagtcacctcagattctctcacttatgagtcactcagcccagccattaatttggcttatattaagaagaattgctag

SEQ ID NO: 17808 - DNA, 315 bp, Glycine max
  Peptide Sequence Number=SeqID_109493
cttgggaggattgatggggacccggtgttgagagaaacgaggatatgggctacgtgggagtacgtgagctcagttggaggtgggctacaggggatgagtggtacctggggatatgtcgcgggggtcaggagaccttggggacgtcaggcgagctcctggcagtcaacagataaaaggaaaacaagaccacaaagcaaggaggcttgtggtggctggccagctgaggctaagatggtctctggtaatcgattaccaagggggtgtaatcgattaccaggcttgaaaaacgaagtcaggaaacttagggagcctctg

SEQ ID NO: 17809 - DNA, 333 bp, Glycine max
  Peptide Sequence Number=SeqID_109494
atgtacaaagataagtgggctcatactgagcctatgggcccaaaatctaccctaagactcatgagaacccaagggccttctcctgcatctttggcccaatcttcttggagtcttctatccaatgcccttgggggcaatgtcttccaaggttattttgatgatgccaaagaatcaagagttaagaaaaatccaaagattcaagaatcaagtttcaataatcaagattcaagattcaagaaaaatcaagatcaagattcaagactcaagattcaagaatcaagagaagaatcaatcaagataagtattaaaaaagtttttcaaaacattgagtag

SEQ ID NO: 17810 - DNA, 513 bp, Glycine max
  Peptide Sequence Number=SeqID_109495
atgactgattatgctagagtgaaaaagaagaagaaaggaaaaggtattaagaagagcaaggttgatccaaaagacatatgtaattactgcaaagaacccagtcattggaagaaagattgttcaaagaaaagaaagactttgttgctgccattgtttagaataattcctcatcagaaaataatttgtttttgggtgttggtgaacaactataagattattcttaaaaatggatactcgactcaagctgttcttatcatatgtgtctacacaaaagttgtgcttaagaaaattctagtctctacagtgccatggattcaaaaggtttttcttatcgggttgaaggtggagttatgcaaatcagaaggaaagggaagtatatgttatctaaaggcgttgggtcctcttactgagcaaattgatgcaattaatgatgtttctctaattaaagatgtttctatgttctatgctgaaggctcaagtactaaacaccgatgtctcatgagtttagcctaa

SEQ ID NO: 17811 - DNA, 237 bp, Glycine max
  Peptide Sequence Number=SeqID_109496
atggttgttttgacttctggaatgttgcgaaactttatggattacgcaaaaatgcttgttttgagggtcccaaagggaacaaacaaggttcgaaagtcgatagcaaagcaacctcgacgagtgaccttggaagattactcaagtacttcggtgccgcaatatttctcaagtgttgcactaccagaggttcaggcacaaaacttaacttacccaccttcattgatacagctaatatag

SEQ ID NO: 17812 - DNA, 364 bp, Glycine max
  Peptide Sequence Number=SeqID_109497
atgaaggccgacacgaaggccttgaaagagcaaatggccacaatgatggaggccatgataaacataaaggagataagggaggtcaatgcggctgcaataaccgctaccagcaccattgctgaggtggacctgacccccccatatggcctcaaccaaataaatcatccaacctcggatatggtaggtctggaaggcaaagagttgggaggggagacacatgaaatgccccaccataatctagtcgacttcgagccttgcctcggatatgccactgaagggcaagcagttggtgatatacccctgcaaaacactttggagggccctcagtatcacccacaaccacacctcttgcattccacaacag

SEQ ID NO: 17813 - DNA, 855 bp, Glycine max
  Peptide Sequence Number=SeqID_109498
atggcgaagaagttcagcgaggaaggcgacgatcatcttacggcgagcggcgccgtgcagggcgaaggtttccttggcgaacaccagaacgatgccggcggaaaccagagccagcgcccagcgtgcgatcacctggttgtgcagcagccaactggacacggcgatcaacgccacgatgccaaccagcaccatcagcagtttcggcagatgcagcggcttgaagtcaggcttggaaccgttttccttcacccacttgcggcacatcataaagttgaccagggtgatcagcatgccgaccacgctcagcgagaatgccacgctccagccgtatttcgccgccagccacggagtggccagcatagagaagaaggagccgatgttcaccgacatgtaatacatggtgaaggcaccgtcgagacgcggatcgtctttctcatagcaggtggacaacagggaggacgggttggccttgaacaggccgctgcccacggcgatggtcgccatgcccatgtagacccagaagatgtcgtggccggagtaggccaccatggcgtaaccggcggccagcaccagcgcgccgagcacgatcacgcgtttggcgcccagcactttgtcgcccagccagccgccgatggcgacgaagccgtataccagggcgctgaaggaagagaacagggtgatggagtcggcttcgctcatgccgagcatcttgaccagataaaccgccatgatgccctgcaggccgtagtagccgaaacgctcccacagttcgatcgagaagatcagatagaacgctttcggctgtttgaacgcgttaaggctaacgctctccggatgttggttgtttgctgttga

SEQ ID NO: 17814 - DNA, 225 bp, Glycine max
  Peptide Sequence Number=SeqID_109499
atggttaggaccagaggattaggtcgtgccttaggtcaggttactggcagaggtgtgggcagaggagatcgtgatgattctggtgatgctccgcagcgtcgacggcatactgcatctgcacagaggcagcgggtcgctgtgactgcgacgcacgatgagccagtcatccctgcgccagatgttcaggatgacccgatggaggcaccaactgctgcagaggacatt

SEQ ID NO: 17815 - DNA, 355 bp, Glycine max
  Peptide Sequence Number=SeqID_109500
atgactaggggcaatccaggtgatttacaaccctttgatcctaaaatagatagaacctttcatagattagttaggcatagtgtgcatcctggtcattctgtgcattttgagcattttgagcattctaagcattttgttgctggttattttgaatattttgatttcgagcattcgactactaattttcatactgagaacatggctcaacctccacctcgtgagaggacttttagggagatggctatacctaatttcacttatgaaagcttgtgcattcaatatcctgatgagggtgttccatatgttctcaagactggactaatacatttgctgcccaagtttcatggtcttgctg

SEQ ID NO: 17816 - DNA, 345 bp, Glycine max
  Peptide Sequence Number=SeqID_109501
ttggaactcttacgtgccgatcaacgtctcattttcgccaaaagttggcccagggcttcccggtatcaacagagacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 17817 - DNA, 374 bp, Glycine max
  Peptide Sequence Number=SeqID_109502
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttactctcggttcaaagagttggtagctcagagaactcttcgaaaaatctgctctgcaaggcg

SEQ ID NO: 17818 - DNA, 108 bp, Glycine max
  Peptide Sequence Number=SeqID_109503
atggccgaccagcaggcgaccaagtccaaagccaaaggtagcaagataccttggatatgtgtgtatatagcaaaaatacctcacaaaaatatacacatgtttaggtag

SEQ ID NO: 17819 - DNA, 195 bp, Glycine max
  Peptide Sequence Number=SeqID_109504
atgatggcacatcaacagacaacaaagatttggatgacgccacttccgatgaaggaagttaagtcagggattctcatcacaatcttttgtaagaggttgtcacaacctatccttcgacgggagggcgacgtgagactcacggatgcgtcttccaagaaaggaaaatgcgtggagtcgccaccaacgtttatttga

SEQ ID NO: 17820 - DNA, 165 bp, Glycine max
  Peptide Sequence Number=SeqID_109505
atggataagagcttgaaggtaggagaagatgagtggagggagagggagaaaggggggcacgaaatttatgcctcaaaggagctatggttcagcccactaattcaagatcaagtccaagattctccactaagtgtgcttaggtgtcatgaggcatgtaaaacatga

SEQ ID NO: 17821 - DNA, 750 bp, Glycine max
  Peptide Sequence Number=SeqID_109506
atggtgtggtataggcgtaaaacaaagatgtttgtcgatccgaacaaggcaaacacagctgcattgggtgaagttgtggagactttacaatatatggtgtcaccacaagggaggaacacgtggacggttgatgatctcatgccttacgtggataagttagcgattatatctaaagagcaagagagaatcactgagccaatatcacatggtccagcatcagagcgtgaattcccagcacaagagtttcacattcttcagtcaagtgttgaaactcagggcataggcagacgaagggatcctgttgaagcagaacaatattcccaacaaatgatggagcgtggtcatggaatgtattacacgccagcaacattttccgaatatccttcacagatgtatcagtatccttttacaggtcatcatactgatacttctgagacctcacattcgttcggtggtgttgcggaaacacagcctcatttttcatggcccactatgactccttcacagcagcatgatgcccccatggcaacacctaacgccctatttgctccacaatggaatgtacccggagcaatacctgatatgggcgacttattaggtgttgatttgcgtcaagagttttctgtagaggctgaccaagcagaagcggggagacaacgcggcgacagaagaaatccttatcgtcaagcgcgaagatgggatcgaccatgtggcacatcttcacgacatcacggacaccataatgactga

SEQ ID NO: 17822 - DNA, 417 bp, Glycine max
  Peptide Sequence Number=SeqID_109507
atgtacgatcatttaaatgacgtgtccaagagcacggcgaagcaacttgcaggatatatcactctgttacagtgttggatctacgagcattttctgtccgttgctgccagtgttcctgccgaggattacgaccagaggagaccacgtgcatgttgttggacctctggcaaggcacttcaaattttgaggtattggaggcgcctagatagactgacccttgacgcagtgtgttggattgcgtacggtgaccatagagcatttagagaatttgaggtcacttcattattttccggccatatcagatggggtccatacatggtcattcatcggtcggagaaggttatttggcagttcggctacatccagattattctgccacaccctgccgttccttcgctatcatatgatgaaatttga

SEQ ID NO: 17823 - DNA, 210 bp, Glycine max
  Peptide Sequence Number=SeqID_109508
atggcaggagtgggtgacaatggtggtgtatatcatcaactggacggatctcaacgcttattactggatgcaatgactacacaaatgcaacgtttgttgaaccgtaacaatgaagagctctataggcgaatagccaaatcttccttgtttattcttaaacctctatcccctagagaagtgtgtgatgaccaaatcagaatgagagaatag

SEQ ID NO: 17824 - DNA, 1244 bp, Glycine max
  Peptide Sequence Number=SeqID_109509
ggctacatgccctcgccatcagaggaccacacgtcctcaccttcgtaaggctacacgccctcacctttagaggaccacacgtcctcaccttcagagggctacacgccctcgccatcagaggactgcatgtcctcacctccgtagggctacacgcccttacctttagaggactacacgtcctcgccaatagagggctgcacgccctcaccttgagaggactacacgtcctcaccaacagagggctgcacaccctcaccttgagaggactacacgtcctcggcaacagacggctgcacgccctcaccttggagagggctacacgactacacgtcctcaccatcagagggctgcacgccctcacctcatcttcagaggactacatggctacgcgccctcgccttcgtaggactacacgccctcaccatcagaggactgcatctcctcaccttcagagggctacaggccctcgccatcagaggaccacacgaccacacgtcctcaccttcagagggctacacgcccttgccaacagagggctacacgtcctcgccaacagagggctacacgccctcacctttagaggactacacgtcctcgccaacagagggctgcacgcgctcaccttggagagggctacacgtcctctccaacagaggactgcatgtcctcaccttgagaggactacacgtcgtcgccttgagaggactacacgtcctcaccatcagagggctgcacgccctcacctcatcttcagaggactacatgtcctcaccttcagagggctacgcgccctcgccttcgtagggctacacgccctcaccttccgaggactacatgtcctcacctttagagggctacgcgccctcgccttcgtagggctacacgccctcaccatcagagggctgcatgtcctcaccttcagagggctacaccccctcgccatcagagcaccacacgtcctcaccttcgtagggctacacgccctcacctttagaggaccacacgccctcaccttcagagggctacacgccctcgccatcagaggactgcatgtcctcacctccgtagggctgcacgccctcacctttagaggactacacgtcctcgccaacagagggctgcacgccctcacctttagaggactacacgtcctcgccaacaaagggctgcacgccctcacctttagaggactacacatcctcgccaacagagggctgcatgccctcacctttagaggactacac

SEQ ID NO: 17825 - DNA, 195 bp, Glycine max
  Peptide Sequence Number=SeqID_109510
atgaaagctataccaagcaagccaacaagaaaaggaaggaagtggcaaatgttttccaagaaggagggaatgatgagaatcctgaaattggccaaatacaggctaaaggcccaagttgagaaggatgaaggcccaagtggagaaggacaaagctcccgagtggagaaggatgagagcccatgtggagaaggatga

SEQ ID NO: 17826 - DNA, 564 bp, Glycine max
  Peptide Sequence Number=SeqID_109511
atggcggaaccatcaaagaagcgcaagggatcctcgagtcgaagccaacgacatttcgagactcaggaaacgcatattccctcctccatttcctcttcctcactgttctcaacggaagaacaacggatacggtacacaaatttgttctcttctcgttccattatcgatccaaaattcattgacatggatttcttttccaatgagagttttgaatgcattcaggcatttgaaaactccaatctctttcctttcatgtctttaaaattgcctgtttacactgaattagttaaagccttctattctaacctagaaattcaagaaggcactttgatttctgaagtttatgggattaaaatggtcattgaccaatccctattctatgacttgacccaattatccagtgaaggtgtaccatttgaaggtacactgaatgatgattggaaatttgatttctctgtgcatgatgcccgccgattggtttgcaccaaccaagcggatatgaccggaaggcttcttgccggttcattggcttttgaaagccgcatccttcaggggatcctctag

SEQ ID NO: 17827 - DNA, 507 bp, Glycine max
  Peptide Sequence Number=SeqID_109512
atcataggttctccacctgcctccactcctcctcctcctcctcctcctcctcctcctcctcctacttctcctcctcctcctcctcctccggacgcatcggcttcgccgtctgccatgaagcggacacgcaaagcctcacgtctacgatcgttgtccactataccacctagtgctgagagaccagtggtgcatgttgatcctgctaccgggaaggccgacgatccccacaagaagaaattaagaacatatttggggattgtggcgcgtgataaggtggatgtcacctacgagaactggaaggaggtccctactgctcagaaggacctgatttgggaggatattcaggcggaatttgatatcctagaggcttctgacaccgatcaggatggtgtcgaggacactgtctgtgagaaatatggcatcagcaaggaaaagtgggcccagttttgccagactcgtagagacccttcttgggaggatgtgcgcaagaaggcacataccatctag

SEQ ID NO: 17828 - DNA, 281 bp, Glycine max
  Peptide Sequence Number=SeqID_109513
atctcgtcttttccggtttttccgacgttttcctcaaataaacgttggtggcgactccgcgcgtattcctttcgtggaacacgcatcccgcaagtcacgcgtcgccctcccgccgaaggagttcatattcatgggtcagtgcattaatcctagatctcttaacatcagttgtgccttcatgtgtgagttaaagtgtgtcccacatctccttagcactcaccatttctctctaggtttttctattgttgtgcctgttgatgtgcttccatctactatggtgg

SEQ ID NO: 17829 - DNA, 270 bp, Glycine max
  Peptide Sequence Number=SeqID_109514
agacaggttcagggtgatgctccacaggccgcaagcgcgccaccaccacctcatcaggctggcccagctgggtcgtttgacatggagcagtatttacggcatgtggttcgccaggaggcggccaaccatagggcccatgtgcggaccaatgagaccctttaccagctgagcctcagcatgcagagccagggcttcgcttctttttcatgccctactccagatcagttcagggcagaggtcgcatggcccggggattggcccaaggcctag

SEQ ID NO: 17830 - DNA, 849 bp, Glycine max
  Peptide Sequence Number=SeqID_109515
gtcgactctagaggatccccggtagagccatcgaagaagagaaagggatcatcctccaccgccgctatgcttcccatcaccgccacggaccatccggagcacccacagcacctattcatccatctttgtcttctccaagatcatccacattgttttcttccgattatcagcgtctacgtgtttcaaaattctggccttgttgatttcatgtcattaaaattgccacattatcctgaacttgtaaaggtcttctacttcaatttaaaaattcaagatggcattattacctctgaggtgctttgtattcctatggtcattgatcagtcattgttcttttctttgactcatttaccctgtcaaggtgcaccttttgagggcaccattgttgatgactggaaatttgattattctggtcatgatgctcgccgtatggcattacaggccaatgcacctctaccttacccacagttgataactttgtttctgcgtcattttcaaattccgcttgatgatgaaccatttgttcaagtcaagcgttcttttgcaattggtgctggtgcagtgacttcctttggataccgtaaggattggaatggtcaatggctgaagaaagatgcactccctcctcaagatgagcgtactccttcacctcctcctcagcaagatgattcagcactcatgaatgaagtcctttccgaattacgaggtcttcgttcttatgttggtgaacgtttcgactcattggatacacgctttgccgacatggatattcgcctcacacagcttgaagaggatgtgggttacattcgtcagagtttcgatcttccaccgccacctccaccttcttag

SEQ ID NO: 17831 - DNA, 353 bp, Glycine max
  Peptide Sequence Number=SeqID_109516
gtacgacctcgatcaaatttggcaccgttgccggggagcagtgtccaaagaaaaaagtttcccatgctgtggcagcttgccttaggccggatgagtgtatgactagaggcaatccatctaacttacaaccctttgatcctgagatagataggacatttcatagattagttagacatcatttagtaccttttgagcatcctgagcattctgttattggtgattttgagcattatagttttgaacattctgattttgaacattctgagaacatggcacaacctccacctcgtgagaggactctaagggaaatggctacacctgatttcacctatgaaagattgtgcgtccagtaa

SEQ ID NO: 17832 - DNA, 447 bp, Glycine max
  Peptide Sequence Number=SeqID_109517
atggccccgaggaagcttgcctcaaagaggtccaggaaggacaaggcggccgaaggaactagttccgccccggagtacgacagtcaccgctttaggagcgttgtacaccaacagcgcttcgaagccatcaagggatggtcgtttctccgggagcgacgcgtccagctcagggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgagatcctgggttaggggattttgcccggactgctgcagggaggcgagtgcgaatcatgcgcaccaatatgaccaccctgacccagatatggatgacgttgctcctcagcaacatcctgcccaccgatcataa

SEQ ID NO: 17833 - DNA, 62 bp, Glycine max
  Peptide Sequence Number=SeqID_109518
atgccgatggttcaaggcgatatcatctggaactgctatatagtagagctttttgttcgagg

SEQ ID NO: 17834 - DNA, 318 bp, Glycine max
  Peptide Sequence Number=SeqID_109519
gtctctaagatctccttttctgcttcttccatttttttgtttggaattgctctaggtgggaatggaagagggataggaggctactgtgtaaaaggaagcttgacaggttcaagtgcaggtgctactactgactctgaatggaggctcttgtctcttgctgaaattgcatattctagatggttatttgcctcactaactcttctaaggaaggttgaggaggagcctcagttgcttgttgtctttgttgtgactgttgttgtattggaggaggaacataagggttgcttgggccaacaacattctgaaaaggagggatag

SEQ ID NO: 17835 - DNA, 414 bp, Glycine max
  Peptide Sequence Number=SeqID_109520
atgatcctgactatattgctaccgagactatggaagacagaaagaaacggctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17836 - DNA, 418 bp, Glycine max
  Peptide Sequence Number=SeqID_109521
atgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttcccgg

SEQ ID NO: 17837 - DNA, 375 bp, Glycine max
  Peptide Sequence Number=SeqID_109522
atggaagaagaaaaagcagcggcgtactacaacgagctgacccgtaagggcgagagagctgcaaggttcaagcaaggtctcgacttttcctctttagcaccaaatgacgatgttgcaaaaccctcctcatccttcctctccaaatttgtcaaagcctcctccgagtcgaagaagcaagcgcaactccaatccatccacaacaagcgctcaaggaaaagccttctttcgagtctagggtttcgagcagggaaaggtacagcaatagaagtagaagacgaagtaggagcagagaaaaacgtaggaaaaggagcggaagcggtgatagatacagggaaacatgaagatgaagcaggagtagagagagacatagggata

SEQ ID NO: 17838 - DNA, 159 bp, Glycine max
  Peptide Sequence Number=SeqID_109523
atggcctctagtaatcgattaccaaggggtgtaatcgattacaaggctaagaaatggagacaggatgttgaggtggcctctggtaatcgattaccaatgttgtgtaatcgattacacagagtaacaggacactggtttccatgtgctgaagctgtgtaa

SEQ ID NO: 17839 - DNA, 303 bp, Glycine max
  Peptide Sequence Number=SeqID_109524
atggagtggtggtagattagaatatagggccacaccgcatggtgacttagtcggatataggtatcgtatagatcatatggagagccatgaggtgaagctacagtttggactacaacaagatatccctgttgatcccatgaatcttgatctatttcaccaaattgacatgcgagacaatcattacactgattggatggaatatcatgcggagtggattaatatctggaaaaacaaacacaacaatattttagttgggcaatgggttgaaggaatagtgacacatagaccagcgtacatggaatg

SEQ ID NO: 17840 - DNA, 686 bp, Glycine max
  Peptide Sequence Number=SeqID_109525
ttggccccagggcttcccggtatcaacagggacacccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17841 - DNA, 252 bp, Glycine max
  Peptide Sequence Number=SeqID_109526
atgaagctgggtgacgtcctgaaagcggaaaacgcgcagctgggcatctctttttgcggcagcggcggcgcctgcgcgattaccgcgcaaaccaaacacggctacaaagccaaatacggcatgcgttcggtggaagaaggcgtgacggcaattaacgaaggctgcaacgtgctgggcttcggctttatggataaagaagagttgggccagaaattggtggaagcctacatcaaaaaacatggcaatccataa

SEQ ID NO: 17842 - DNA, 764 bp, Glycine max
  Peptide Sequence Number=SeqID_109527
cgccgatgccaggcaggtcattggacagctgcggctcacacatatcttcttcatcttctgggttgcactctgtttgctaacaagagtgcaaccaatgtccatgttgtctacttggaggcccttcgtgacctcagtatgacggagaggaacgcctggggagtggctgctttggtgcatatgtacgaccagctgaacgatgcatttatgagccacagccgacagcttggcggttacatcacactactgcagtgctggatttacgagcactttccgtcagtcgcggactccactactaatcaggagtacgacgaggattctccgcgtgcgtggagtgcctggaccgactccggattccggatgtctgttggatcccgtatggggagcactgatcagtccgggacttccacgtcagatcatgctattccggtctcttgcgctggggacctgttgctgtttattaccgaccagagagggtcgtgcggcagtttggatacacgtgaggtatgcgttgtgtcaggccagtgttccagtgactacatggactggttcttccgcatcttgcatcctttcatgacaccaggccacgcattagatcctctgcctcatggtcacgcctcgcagccccgagtcgtccctcaggccccgcggacggatatctctcacgaagtttgtgatgacattgctgagaggttggagcgccatctgagtctaagggtgatcacgcctggctcatcgacacatgaggtgatcgaagaatgcctcag

SEQ ID NO: 17843 - DNA, 216 bp, Glycine max
  Peptide Sequence Number=SeqID_109528
atgtggataggccgatttgctcttaccttgaacgggagtcaagaacttccccgattgctagccaaggccaaagcaatggcggacacctactccgcccccgaggagatccatggacttctcgactattggaaaaacaccataactaaacgcgccccaaggcatccctatcgcaccagatccaaatctagaacgatgggtgatcaagaggagacatag

SEQ ID NO: 17844 - DNA, 621 bp, Glycine max
  Peptide Sequence Number=SeqID_109529
atggcatcggtgctatgtataggaggactagttggagttggagttgatgctgaaagtggaggggcatgtgctggtgtgggaattggagctggggctgaagttgaagcattagaaggggccctagccctggccttgcgggacccaggaaatgccaagttaatggctggactgagagactcgaaggtaagtgactcggatactactcctctggcgatgcacaaagatgtgataagtgcaggaaagcccaacctagaggagggtgaggttggagtaagaaaggacactgcaagtctacatgtgagtggtcagggtccggatgagtatgacagaaacgtcatagaggatatcataaaactccttgaccaaggcgaggtcaatgcgattatccatctgcctggtcaggttcctgtgccattagcgtctctccagctccctgaggaactcaccataatgggagctcctatggtcgagaggatgaagcacgtctcttctttgaggccatctgcaccaaaacacaacaaaggaatgaagttagacaggatgctcgctaagccttattctatgatagaaaggtatttgcgcttaacgggaatgcctcgcttagcgcatgaacaaacataa

SEQ ID NO: 17845 - DNA, 516 bp, Glycine max
  Peptide Sequence Number=SeqID_109530
atgacctatgccctctatgttaaactcaacccgaaactgcatcccatctgttcttcacttgcgataaagtgctgccactgtggtgggaattcttcacttgggttaaggaaggcacaattctacataatagtcccatggctaattttcttcacacctcaactacaactggaggaaagaatattactagaagaaggaagacttggtggttggctgctacaaagattagaccaaacatacctacgtgaggtggcgaaggagaagaagcacagacttctgacgatgctcgacttcaaggtagatggagaacaaagagagcaagaaagcttagatggagaagaagacagagagaaggacaagacaacgcgaaggagacgaaacatacctaggtatggtggcgaaggagaagaagcagagacttgtggcgatgctcgagtgcgacgaacacgatgctcagatgcacacagggacggtttcgctagacggagattagaagaagaagagagcgcaaaagcttag

SEQ ID NO: 17846 - DNA, 333 bp, Glycine max
  Peptide Sequence Number=SeqID_109531
atggaagatatttataaaaggtggactaagtatcttgacagtacgcgatcaagggtcaatcacccaccgccgataaattgtgctttttgtggaggagagcatttcaatgacaactgtcatctctactctatgaaaaattcttggtgggtacaggagatacacccttacaatcaatatgaagaagaaaagactcctaccctcgaaagtgtgttcgcggaattcacggcataccatgctacctctacagccaatcaaaactcaatgcaaaaccaggaaattcaagttggcaagagctactccgtggaaaattatcagtgggagcaagagttataa

SEQ ID NO: 17847 - DNA, 453 bp, Glycine max
  Peptide Sequence Number=SeqID_109532
atggctacacacctcaccttaagaggactacatgccctcgcctttagaggactacacggtcctcgcctttatagggctgcacgccctcggccttcagaggactacacgacctcccctttcagagggatacacgccctcgccttgaggcctccaggactacacgtctcccttatagctcacacccttcagaggactacgtgtcgcctttcagaggactacatgtcctccttcatagggaactacatgtcctcaccttcagaagactacacgtcctcggcttcagaggactatcacgtcctcaccttcagacgactagacatcctgccttcaaaggactacacgtacctcaccttcagaggactacacgtcctcgccttcagagggccacacgccctcgccttcgtagggcctacacgccctcactttagaggactacatcgtcatccatcatag

SEQ ID NO: 17848 - DNA, 272 bp, Glycine max
  Peptide Sequence Number=SeqID_109533
atggttacgcgatctgtgaaattccgtaatgtggcggaaaccaaaaggaagtattgttacgcaatccgtgagtttctgcccacatgggccttccagattcttcctccagaaggcggttgcttctggaggaagcaacctggctcgcctgggcgagctggaagaaaatccaagccgaggcgcttccgtaacgtttctgtgggtaattacgcgaagattttcaaccgttcttcgacattcatcgttcgttcttcgttttcttcggtcttcaactg

SEQ ID NO: 17849 - DNA, 258 bp, Glycine max
  Peptide Sequence Number=SeqID_109534
gcgcagggggatgcacctcaagacgcagacgcaccaccgccacctcatcaggccgatcccgctgggtcactaggcatagagcattatctacagcacttggttcgccagcaggctgccaaccaccgggggcaggtacagatacatgagtgtctctaccgcttcaaccttagtcagcaggggcagggtttcgctctttttgcgtgccctactccagagcagtttagggctgaggtcgcgtggcccggagattggccctag

SEQ ID NO: 17850 - DNA, 432 bp, Glycine max
  Peptide Sequence Number=SeqID_109535
atggtgaaagttggaacctcttacgtgccgatcaacgtctcattttcgccaaaagttggcgccagggccttcccgatcaacgggcaccaggactactgtcgttcgtggaggagtggaacggcctgccgggcgcgcccattgccattcggtgcgcaactgttcgggaagcctgatcggtgcgggcctttcgctattaatgaatcgccaagcggcaagggggagtgctgcaagttgcgattaagttgggctaacgccggagtgttcatcactgcttactatgttggtaaaactgagacgggtgaaattcgatctggcgagcctcggctccctgaccgggcacgactacggtcgttcgactgcggcgagacggaaatggcttacgaacggggcggagatttcctggaagatgccaggaagatacttaacagggaa

SEQ ID NO: 17851 - DNA, 686 bp, Glycine max
  Peptide Sequence Number=SeqID_109536
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagaattgaagccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17852 - DNA, 333 bp, Glycine max
  Peptide Sequence Number=SeqID_109537
atggcttgcacccacattccagtggaagcaaagatacttaaaaatcctgatgagtcattagagacatctaacaacagctttcaaaattgccccatgtgtggtgtcgcttgtcaatccggcccgcatcaattagactttacaccttatgcttcagggtcatacagtgctcaatggaattccctagggcacctccatgatatgcacatgttgtgttcaagtcgtatccttagaaaaatggaggttgaggaaaccaagcaggggttatggctatcattgaattatcgaatagatataagagcaagtttagcatatgacactggaatttgggggtga

SEQ ID NO: 17853 - DNA, 501 bp, Glycine max
  Peptide Sequence Number=SeqID_109538
atgagtgaaatagaggaggtgcaagagcagatgaaggctgacatggagcccatgaaaaagcaaatgaccacaatgatggaagccatgatgagtatgagaaggatgatggaggtcaatgtggctacagttgttgctgtaagtaccgccatagaattggatccgactcacccacctggtttcaatcaagtaaatcatccagcctcggatatggtaggtcagggaggcaaagcgttgggaagtatgggtggcccccattttgtacaggtccagagcaagcattccttcccaccatatggcttgcctcccaacaatacaccactcaatactacacacactcccgatgagaatgtcgaccactctgctcccatacccattgagaaccaacatccccaatctggtcatgcgcaggtctctcaacccatgggggagacacatgaagcaccccgagaccacaatctagtcgacttcgagcctcatgtcggatatgccactgaggggtag

SEQ ID NO: 17854 - DNA, 279 bp, Glycine max
  Peptide Sequence Number=SeqID_109539
atggagagacgccataacttcgacaatgggaagagatctcaagaaggttccccaacacttaaatgctataagtgtaatcaacccggtcacataaaggcacactgccccacaaatgaatcatggctagaaaagaatgagaaaaaattccatgaagaaagaagatccaagaaggcgtatattgcttgggataacaatgactcatccgatgcttcggagaaggaaatcaactttctatccaaggactatgaaagcgatgagaacatctctcaagaagtttaa

SEQ ID NO: 17855 - DNA, 633 bp, Glycine max
  Peptide Sequence Number=SeqID_109540
atggaaaaatctgaaaagaaaaaccatagtgaaaagaaactgaagaaagcatacatcacatgggatgaaaatgatatgaaatcttctgaagattctgaaaatgaagagataaatctctgccttatggccaaaagttacgaaagtgatgaagaggatcctcagtttatactaacatgcaaggacccatcaaagaagagaaagggatcatcctccaccgctactgctgctgcccatcgccgccacggcccatccggagcacccacaacacctattcctccttctttgtcttctccaagatcatcaacattgttttcctccgatgatcaacgtctacggtacctttctcagttttcttctagaataatcttagaccctaagtacctagacgtagagttctttaatgatgaaacgtttgattgctatcaagtgtttcaaaattctggtcttgttgatttcatgtcattaaaattgccatattatcctgaacttgtaaaggtcttctactgcaatttaaaaattcaggatggtattattatgtttgaggtacatggtacttctatggtcattgatcagtcactattcttttctttgactcatttacccagtcaaggtgcaccttttgagggcaccatt

SEQ ID NO: 17856 - DNA, 237 bp, Glycine max
  Peptide Sequence Number=SeqID_109541
atgtcggtgcgcaactgcattaatgaatcggccaacgcgcggggatcgaggcggctttcgcgtattggacgccagctaggcgaaagagtgtgcaaggcgattaatgttgggtcgccagggtgttccagtcacgaagcgttcgtggcagaaaaagcgacggccagtgaatatgtgaatacgactcatatagggcgaattggagctccaccgtcggttgagcggcacgctcagaactag

SEQ ID NO: 17857 - DNA, 519 bp, Glycine max
  Peptide Sequence Number=SeqID_109542
atggatttgaaggaaggttgtacttatgtgatgcacaattttagagtcagcaagaatgatggaaagtacagagtttgtgatcatccatataaattgacatttattggagttacgattgtcagacagtgtcaattggatgggcttccttttaaaaattatatatttgcagattttttggatgtcattgttggccaattacagtctaacctattagtaggatcctatccatgctcagttagcaattctttgaaggcttctaaattgactattaatgagccagtggcaccaattgaagaattcaataagaagctttcagaattgggcattgagatctgctcagttttgacacgtcgttcccagtggagttcacaaccttcaggttctgctcagttatcatcaagggaaacattcatttccaagtcagaggcaaagaccatttctgagataaacaacttttgtgaagtaattatcttatatatgtttacctgtttatcgcttctttggctgcctcctgcttaa

SEQ ID NO: 17858 - DNA, 348 bp, Glycine max
  Peptide Sequence Number=SeqID_109543
atggaacacgcatcccgcaagtcacgcgtcgccctcccgccgaaggggatcgcacccacaagatgcccaatgcacccgaagaagtccaataggtccctggggtttccagctctggttacgggcctctgtcagtcctatagggtgcccgtccccccagcgaggtcatgccatcgtgacatagggatcgcgcccacaagacaccccgtggacacgaagaagtccaacagggccctggggtttccagctctggttacgggcctctgtcagtcctacagggtgcccgtccccccacctaggtcatgccatcgtgacgtaggaaagtatacatatggttcagctgatttctga

SEQ ID NO: 17859 - DNA, 467 bp, Glycine max
  Peptide Sequence Number=SeqID_109544
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcataatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaaagataccaggcgtttccccctggcggctccatcgtgcgctctccagttcctgcctttcggtttaccggtgtcattccgctgttatggccgcgtttgtctcattccacgcctgacactcagttcccg

SEQ ID NO: 17860 - DNA, 120 bp, Glycine max
  Peptide Sequence Number=SeqID_109545
atggtagagatgatggggagagttaacctagggttaaaagtgagaatggtagtgataaaatgcttgtgcattgttggttatgggaaaggtggtacatattgggttctgggcattttctag

SEQ ID NO: 17861 - DNA, 462 bp, Glycine max
  Peptide Sequence Number=SeqID_109546
atgacattcgaatttgtcgagagcttccgttgttcactttccagcgtcttgatgagttatgtccgcgaatcggacatcctagtgaaaagctatgaccatttgaatttctcagagtgcttccgttgttcaatttcgagcgtctcgaaatattatgtccccgaatcggatatccgtgtgaaaagttacgaccattcgaatttctcgagagcttccgttgttcaatttcgagcgtctcgtataaatatgtccccgaatcggacatccgtgttaaaagttatgaccattcgaatttgtcgagagcttccgttgttcactttcaagcgtcttgatgagttatgtccgcgaatcggacatcctgtgaaaagctatgaccatttgaatttctcaagtgcttccgttgttgaatttcgagcgtctcgaatattatgtcctcgaatcagacatccgagtgaaaagttatga

SEQ ID NO: 17862 - DNA, 758 bp, Glycine max
  Peptide Sequence Number=SeqID_109547
atggtgaaagttggaacctcttacgtgccgatcaacgtctcatttcgccaaaagttggcccagggcttccccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgcagtgagccgagatcgcgccactgcactccagcctgggagacagagggagactttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17863 - DNA, 165 bp, Glycine max
  Peptide Sequence Number=SeqID_109548
aggaaacactgggtccaacaaagataggagaaaatcactcaaagtgtatcaatctcacacagggcaaggattgacattctcaccctgggtcaaggtttatggtaagttgggattttggctcaaggcttatagaacggctggtcatgatatagggtttggccagcg

SEQ ID NO: 17864 - DNA, 699 bp, Glycine max
  Peptide Sequence Number=SeqID_109549
atgaatcatgagagagagagaaagagaaaagaaggtacaggtgcacatggtcaacaagtacaagagatgcacctgatcaggccactctcgttgcaagccgcacacgtgggaatccactgcgggcaagccctcgagaagcttcttgagctcgccactctcgtgcagccacctcaactcctcggccccaccaatgtaccttccgtcaatgaagacacgtggcagggtcaacccggatttgcgacccgtgacccgacggagctccgagagaaaacccgagtccatggacaggtcgcgctcgtccagcgcgacgcggaacccgcgcaggatggaacgcacctttttgcagtcctcgaacgtggcgcggaccacgcgcaggctcgtgaagtagagcaccacgcgttgctccgagcggggaatggacggcggagggagcgagttggcgagtgtgactcggtggaagatggagggtttgggtttggtggtggtggtggagggggaaaggtggggtttttggaggaagaaagaactagaagtggggggagatggagaagtgggggatgttgcattttgagagaagtgaagggggggttggtttattttgcttttagaggaggtttacgagggaaaagggatggattgggagagattgagatggccttattaaatgaggtaattatggtggcaattctcgttctgtga

SEQ ID NO: 17865 - DNA, 3735 bp, Glycine max
  Peptide Sequence Number=SeqID_109550
atgctgcgtgagctagggttagggttttgcatcgtcgttgttccgttactcgtttcgcgatttttgtatatcgcttcttttgacttcgatcctcttcgcgatcgagacgttaattgttggctcttcatcttgattgcttttgttcttgtgctcacgatcgcgtttcgtcgcagctcactactgcactatatgcttccaactaagagaccttgcgaaggactggttgcagaagaagagactcacaacaacaacgacaacaacaacaacagcaacaacaacaacaacaacaacaacaacaacaacaacaataacaacagcaacaacagcagcagcagcagcagttctctcaagaagaatcggatcgccgctgccagaaccgccgattctacggtgaagaactacgaaagcaccgaccagagcttcaacaacaacaacagcaacagcggaaacgcgagtgagggagcgtcggatatggctttgggtgaatcgaaccagccggacatcgatgaggatctccacagtcggcaactcgccgtgtatgggcgagagaccatgcggaggctctttggttccaacgttctcgtctccgggatgcagggtcttggcgttgagattgtcgatccgatttgtgatgatgccttgtttgttggtaaaattctgttaaatgttagttttattggagttggagctttctgcttgatgcttcttgcaaaagaatgccgatcatttgatagtttgttgttcataatgatgcatttcagtggaaatgattaccagcaagctaagaatctcattcttgctggtgtcaagtcagtgaccttgcatgatgaggggactgtggagctgtgggatctatccagtaactttgtgttttcagagaatgatgttggtaaaaacagggcagcagcttctgttagtaagctgcaggagctcaacaatgcagtgattgtacaaagcttgactactcagctgactaaagaacacctttccaatttccaagctgttgtttttactgatatcagtcttgagaaagcctttgagttcaatgattactgccacagtcatcagcctcctattgcctttattaaaactgaagttagaggcctttttggttctgtgttctgtgattttgggcctgagtttactgttgttgatgtggatggtgaagaaccccatactggcattattgcatccataagcaatgacaaccctgctctagtatcctgtgttgatgatgagaggcttgagtttcaggatggagatcttgttgtattctctgaagttcatggtatgaaagaattgaatgatggaaagccaagaaagattaaagatgctagagcatactcttttactcttgaagaagacaccacaaattatggtacgtatgagaaaggtggtattgtgacgcaggtcaaacaaccaaaggtattgaactttaagccactcaaggaagcaatcactgatcctggtgattttcttctgagtgatttttcgaagtttgatcgcccacctctccttcacttagcattccaggctttggataaattcatttctgagttaggtcgcttccctgttgctggttcagaggatgatgcacagaagcttatatctgttgctagtcatattaatgacagcttaagggatgggaaattagaagacataaatccaaaacttttgcgatactttgcctttggttctagggcagtattgaatcctatggctgccatgtttggtggaattgttggacaagaggttgtcaaagcatgctctgggaagttttacccactttttcagttcttctactttgactctgtggagtcactgccttcagagccagtggacccaaatgatttcagaccagtaaatggtcgttatgatgcacagatttcagtatttggacagaaattacagaagaaattagaggattctaaagtgtttgttgttggatctggtgctttgggatgtgaatttttgaaaaatcttgctctcatgggagtttcttgtggaagtcaggggaagctcactattactgatgatgatgtgatagagaagagtaacctaagcagacagttccttttccgtgattggaatattggacaggccaagtccacagttgctgcttcagctgctgcagctataaatcctagttttaatattgaagctctacaaaatcgagttggtactgaaactgagaatgtgtttaatgataccttctgggaaaacttgagtgtcgttgtaaatgcactggacaatgttaatgcaagactatatgttgatcagagatgcttgtatttccaaaagcctcttcttgagtctggaactctgggagccaaatgcaatacgcagatggtaattccccacctgacagaaaactatggtgcatcaagagatccacctgagaagcaggcaccaatgtgtactgtacactcatttccacacaacattgaccattgcttgacatgggcgcgatctgagtttgagggtttgcttgagaaaactccagctgaagtaaatgcatatttgtctaacccaagtgaatatactaatgcaatgaaaaatgctggtgatgctcaagcaagggataacttggagcgtgttcttgagtgcctagaccaggagaagtgtgaaacttttgaagattgtatcacttgggctcggctaaagtttgaggattattttgttaaccgggtgaagcagttgatctatacttttcctgaagatgctgcaactagtactggagctcctttctggtctgcaccaaaaagattccctcgtccactacaattctcagcctctgatttgggtcatctaaattttgtgtcgtcagcttctattttacgggcagaaacatttggtatcccaatccctgactggggtaagaaccctaggaagatggctgaagctgttgatagggtgatagtacctgactttcagcctaagaaagatgtgaaaatagtgacagatgagaaggccaccagtctctctacagcttctatagatgatgcagcggttattaatgatctagtaatcaagttagagaggtgccgggcaaatcttccaccagtgttcatgatgaaaccaattcaatttgagaaggatgatgacacaaactaccatatggatgtgattgctgggcttgccaacatgagggcccgcaattacagcattcctgaggttgacaagcttaaagccaagtttattgctggacggatcattcctgcaattgcaacctcgactgccatggcgactggtcttgtctgcctggagctgtacaaagttttggatggagggcacaaagttgaagactacagaaacacatttgctaacttggcactgcctctcttttcaatggctgaaccagttccaccgaaaattatcaagcatcaagatatgagttggacggtttgggatagatggattctcggagacaatcctaccctcagggaacttctagagtggctgaaggcaaagggcttgaatgcttacagtatttcttgtgggagttgcctgctctataatagcatgttccctcggcataaagatcgaatggacaaaaaggttgcagatctggcaagggaagtagccaagtttgaaattcttgcgtaccgtcgccatttggacgttgttgtggcatgcgaggatgatgaggataatgacatcgacatccctcagatatccatttatttccgtcgctacgttttgtgttggccagggttaataccaattctcatgtaa

SEQ ID NO: 17866 - DNA, 795 bp, Glycine max
  Peptide Sequence Number=SeqID_109551
atgtcacactctgtggacgaacaactctcctttcttcgctccctaatccaagccagaagtttctgcgactctaccctccgatttctcgaatcgctcttggtctccaaggacgtgaaatcgttgatcgaagttcgatccagcttgacgcacctcctcagatctgaatccctgtccgttattcgctccatcgccgcaaaaaccgtccacgacaagcttctcgttctcgattttttcgtccgcgctttctctctcgtcggagatcaacagagttgtttggcgttgagatacgaggctttagttatgagagaacacaaatctgctagttgtcaatggctacaagtttcgcctgcggaatggttaagttttgtggagaacgcggtgcacaacggttttcacgccgttgccgaaaaggcatgtgaaattgcattgtcgtgccttgggaataatgatgatctgaagcacggaagagacccagttccagaaaacttgaaggctgttatcagtgagattacaaggctcaggaactgtgcaatggcatctgttgcttcacgatctgttcaggtgcagacggcagagtatctaaaaaggaaaacaacagagcagcaaaaaccggacttaatctacacagaaaaacgatgtctagcaagcacttctttcagaaacggaattaagagacagaatatacgaaagttacgtgaacaccaaagtctccaacagatcagcagtgaattaaatggaagacatccaaatttgagtttttacacattgaaagagctagttgcttacgccatataa

SEQ ID NO: 17867 - DNA, 276 bp, Glycine max
  Peptide Sequence Number=SeqID_109552
atgagaaaatcgctgaagcactacatctggaaagtcaagcctaatcctccgaggcgcgagaatgatgatctagaagattataacaaacctgatgaaatttttgatcaaaacaatggtgccgagaagatcgataaggagaagaagaggaatgtagatggagaaagagtaagaagaattgaagtaacaagagcaagaagaagagaagatatagcgattcagatgagagtgaagagagtgggagcgatgactctaaatgcagtggaaggaagaagatga

SEQ ID NO: 17868 - DNA, 810 bp, Glycine max
  Peptide Sequence Number=SeqID_109553
atgtacaccctagaagctgccttagagtatacaaatactacaactgtcatgagcttcaatacagcacacttgattactattttttctaccattgacgttgtttcatcatttggcagtccagatgactgggagagtttccttcattacctaggttgtttgctagaagatgagagcatttggtgtgatgagactgttaatgatccagttcatcccccaaagtttgtcaatgaccaagtctcacacttgacagatgaacagtttgacggtcaaatatcaattgcatcagcttgtgtgcagaagttacaagcagataccatcaataacttgataaggtgtccatacctggcaactatagaaattgaaagaagaaagcatttacgtgggaagggaaatgatgacaatttaatggatggtgttgtgcaatacttttgcaggtttggtcacttggcctgctttacttccgatgttgagatgtttgttgaagtcctcactactgataagaaggcagaactcttggagaagttgatgaaaaccagagactctttatcagctccactaaccaagacacttgggctgtctataagctttttcaaaattaaacaattattgctaggggacatgtccaagtcttctgcaagtgatcttgaagtctcttgtgttcaaatgtttgaaatgtattgcaaaaaccttccgctttcaaaagatatggatccacaagagagcatgcatggtgaggagctgctttcaatgatatgtaatattttggtccagggagtgctggagtgggaggagacatacaaagagatatga

SEQ ID NO: 17869 - DNA, 1446 bp, Glycine max
  Peptide Sequence Number=SeqID_109554
atgcttctgccatctgctgccatgccatctgccatatgtatatgcaaatttttgactcgccgccataatctgctgtctgccattgataatactgatggaggcaattctgttagaattctaaattctgaggggaacatggtaattgaatttgtccagttcaaagataggttgcagcactctagtcagtatttagtggctcgagttgaaacatccattttacaactaaagcagaatgcagataacattgaagaagaggagggtgtccttcaaagcttgaaatgtggtattcagttccttgagctgtctaaggagaccaaagatagggaaacaagtttaaagagagtcattgaaaagaaatccctacttccacggatgatatatctttcgattcaaagtgcttcagcatcaatcaaggagcatgttgaggtcaatggttctgttaccccagacatcatttcagagctgaaattgttgctggagtgctatgcacaattgttgggcttttctctcactgaagcaatagaagtggtcatgggtttctccaatggtgaaagatcttgtgtggtttctgactccaacttgattgactggttgaatttcactgtatttttaaatgcatggagcttgagctcccatgaacttgtgcagccagacggaaatggatgtaggcctcgaatttggaatatcttagattctatgctggagaagtatatcttagagaaggttaggttccaagagcctcagctctgctctccttggagtggcatggaacttctgatgcagttagttacagaacctttggcgtggcatggacttgtaatccaatcttgtctgagatcctgttttccatctggtaaaaagaaaaagaaaagtggattagcttatcagtctagcatgaatctgactaaagcaatcacagattctgtcgtgcatttatctcacgtattagaggatgttttgacatggataactgaatggaacaaaagacctgaagatgagcatttggagaatattcttttacttcttcggaaagacgggcataatgatggaccgggggaggtctttcacattttagaaacattcatttcctctatgaatgatgcagaacttggtgatcgcatctcccaatctctaaagtcttggagtcctgctgacgttttcaggaaaatgatgactgggaagctaaaagggttgagaaaatgtgcttctgtttctgctgttattttcatcttcaacaataccttgtcggaacagtcatcacagtttgttgctaggttattgttggctctagtttttgttggtcattttcctgacatgaatggttttgaggggtgtgagagagagacaaggagagaagtgaggtttgagagttggaagaagatggtggtggcgatgcgactggtagtgccagtggtggttggtggctgggttgatggtgatccttga

SEQ ID NO: 17870 - DNA, 2460 bp, Glycine max
  Peptide Sequence Number=SeqID_109555
atgtctcataaccactctcatgcatctccaatatcgatgaaagtaggccaggacgacaacctcattcacaatgccatgcatgctggaattaccaaggcagaaacgttgtttggaggttctttcatatgccacagtacagctaatcaaatcaactccaagggaatctggtttggagatgaccctcttgcatattatctccctgtcttcttgctccaactttgcctcatattcatctttacccatttcattcatcttattctcaagccatttggtcaaccgtcttttgtttctcagattattggtggtgtgactttaggtccttctattctggggcgcaacacagcattcattgacaaggttttcccatcaaaaggaagaaatgtgattgataccatgggctttttcggttttatgttatttgtcttcttaactggggtaaagatagatccaaccatcacttttagatcaggcaaaaggacttttgccataggaattttaggctactttgttccttacacttttgccaaaacggttgtctttatgctcacacgctttgcaacattggatagtgatgtctctaaggtgcttcctattgtgatagaaattcaatgtatctcagcctttccagtaattactcgttttcttgttgagcttcagatcctcaattcagagattgggcgattggccacttcttcttcattagtgtgtgatatttgtttcctttttgttatgacaataaagtttgttgcaaggttatcctccacaaagtcaataggaacatctattggatctttcttgtcccccacgctatttcttatattcatcatctttgtagttcacccagctgcaatatgggcaattcgacaatcaccagaagggaaacctgttcaagaaatttatatatgtggtgtttttctaacactaatattttgtggattcttaggtgaagtttttggcctaaatgcgattgttgtatctttctttgtggggctggctataccagatggtccaccattaggagcggcattggtaaataagcttgattcctttgtttcagtggtgttcgtgcctatcctttttataatagttggattaaggacagatgtgtacgccatacagaagatgaagaacatagctacaattcaattcattatctgcattgctttttgtgggaaagttttaggggctttattacctctcatcttccttaggatgccattccgagatgcctttgctcttggtcttataatgaactgcaaaggcactattgaattgtacttgttgattagcttgaaattaaaaaaagccatgaatgatgaatgctttacaattttggttcttactttagtgcttgtagccgggattgtgtcacctattgtgaaaactctatatgatccttctaagaggtttcttgcttacaaaaggaggacaattatgcatcacagaaaggatgaagaactacgcatactagcttgtattcatagacatgataatgttttggctattatgaacctccttgcagcttccaaccccactaaagcaagccctattaacttagttgtgcttcagcttattaagcttgtggggagatcttcctctcttcttgttgcacacgtgccgcgaaaaatgcttagtcaccattctactcaaactgaaaagattttcaactcattcaacaagtttgaagatgtatacaagggcaaggtcacactacattcctataagggcatttctccttatgctacaatgcacaatgatgtgtgctacttggcacttgaaaagagaacaacttttatcatcataccttttcataagcaatggatacttggagggacaactgagtcatcttttgcttttaagcagctcaataagaatgtcctagagaaagctccttgctcagttggtgtcctcattgatcgtggtaaccaaaagatgttttggtgtggcttcaaaaagggatcaatatatcaagtagctatgctcttctttggtggtgcagatgatcgagaagcactttcatatgcgagacgcatgttagatcaaccttatgtacatattactctttttcatttctcatctccaactgagattgttggaggaacagaaaggagcaaaatgcttgacacacagatcttgagtgagtttaggcttaaggcttttcggaatgagagagtttcttacaaagaggagatggtaatggatggaaaggatgtactttcagttattgaatacatggagagttgttatgaccttgtcatggttgggaggaagcacgcagattcaaaattaatgtcagaaattggaaaatggaagcatggagaattgggaattataggagagattcttgcctctttaaatataggagccaaaacatcaattttagttgtgcaacaacaaaccagattttggggatcacgtgatccagaagaatccacacatttgagaaaagaagatatatag

SEQ ID NO: 17871 - DNA, 1143 bp, Glycine max
  Peptide Sequence Number=SeqID_109556
atgaggttgccgttttaccctccaaaccagactcaattttcaaaccatacccctctctcactcgctaagaactctttcttcttcttccgtggttacaccgcatcaatccatggaaccacccgcagcgaaacacggctccctgcggaacattgtggtttgtctcttctccttcgccgtcctcaacttcgccgcgcggttcgccatcatcgtcaccgtccgtggctgaacctacgactccgccgacttctgcttcttctccgaaaacctcactctcaccgccccctcccgcatctccgacgccggagatccgttttccggcaagaactggcgccgctccgtcgaacactacgccgctatcttccaggacctcatcgccgagggcttcctctccccgaactcccgcgctccctgcttcgacactccggcgaggacgtcctcgcgctgaaagaggtcggcgtcgtcgactctgtcggaatcttcaagaaaccgtcgccgccgatgatcctccacggcgacgctcgccggcatccgttctccggcgatgcattcgacttcgagttctcctgcaacggcggcctggagcagtccccgcggtcggcggagttcgccgccgagatctgccgcacgctgcgtcccggcggcttcgcggcggtccacgtggcggtgagagacgcttacagcttcgaatctttccttgaactgttcgattgctttgaattgatcagaactggagaaatcaacagtgttgattcatctccggcattgatagaggaagagccattgaaaccatggattatactaaagaaaaatgtggagaacataaagtacttaacttctttggttgacataagctttaagaataggtatgtgtatgttgatgttggagctagaagctatggttcaaacattggaagttggtttaggaaacagtacccaaagcagagtagaacctttgaggtttatgcaattgaggctgataaagcatttcatgaagagtatagggcaaagagaggggtcacattgttgccctatgcagcatgggtgaggaatgagacattgttctttgagatcaccagagacccaagcaagaaggtgatgatgagagggagagggagagggatggggaggatcaaccctgtgtag

SEQ ID NO: 17872 - DNA, 696 bp, Glycine max
  Peptide Sequence Number=SeqID_109557
atggctgaagcgctccatgtgcaaaactccccctcgaaccaaggtgttatcgaaggtaatttcgatgcttctattgtggatgggaaaggtacaggacttggggttatttttagaaatgagtttggtgaagtcaaggctgctgctacaaagtttttgcccatttgtgttgaggttcatattgctgaagcactggtgtttcgatgggctattgaatctgctgcttacctaatgctaaatccagtggtttttgagtctgattgtcttcgcttagtttctgcttggtcctctagaaactccaattctaacagctactttgcgggtatcatcaaagattgtgcagttctgctttcaaattcttcttttaaggttttaacccatatgaatagatctgctaatagggcagctgacggtgctaagttagcttttttggcttttgaatcctattggattggggatgtccctcctcagatcggtgattttgttcaggatggtgtaaggcctgatggccatttttcgttcttcatatactcatcccaccacaaaggcagaagagaaagtaagactgaatggagtggcgtgcatggttcacctggtgaaattcttgccatgttaggtcaatctggaagtggcaaaacatctttgctagcagcattgggaagccagcttggagagaaactcaagcataacttacaatag

SEQ ID NO: 17873 - DNA, 219 bp, Glycine max
  Peptide Sequence Number=SeqID_109558
atggataaagttgtcggtaaggatctcttcacaaggatgcaatcagttgtggagaaggttgggtttgtgacctgcatcgagggttgtgaatgtagaatgcatggccaagaccttgacgattgtaacaccacggtcaacgaagcgccaacagtggcttcggtggttgtggtggacatggtggtgggtgtgacggcgggcgtcaacgccagtgagaggtag

SEQ ID NO: 17874 - DNA, 3060 bp, Glycine max
  Peptide Sequence Number=SeqID_109559
atggctgatgaaactagaaagaggcttgggtttcttttgggtgagaagggtgttggtcctgcacccaaattggcccactcctatgagcaccagcaaaatcatagaactggagaaaagaagagaagcaacaggccgaaaaactacaacgaagctatgagagagaagatgggtgggcgacttgtggaggaagaaaaatgttggatcatacaatccaacaagttggctcgaggttctgatcacaagtctcttcactcaaaggaggaaggaggcatatgtctcaccttccccacctcatactatagtggaagctggtacccttgtgcactaggctttccattagacaaaactcacattcatgagcctttccttttatcattcacagatgtgatgtataaaaagagtaagttaccaccaggtgttatggagatatcattgttaaaaatgatcgtaaatggaatgtcctcatttttgcatttatctttttctggaaacatgaactctgaacctgtctcaaagtattaccagaaggcagaggagatacataagttgttgaagccaatcattgatgcaattgttaatcctgagttagcttctgatgaagtgcttaataagatattggaagaaattggttttgctgttaatgagttaaaggagcatgttgagaactggcacctattatctagcaaagtatactttttaagtggttttacttttggaaaaccaaaggttcaggatcctaatgattcagaagacatgatggttatgcaagttgaacccctgatatcaagaattcgcacttcagggctcaatattttccagcagctgaaggattctcagcattgtctccctgatgaattaagttctgaatatttacagctctgttcacaaaaacttaagcttttgggacatgaagaaatctccccagtcattaaggaagctattacagaacacttggaaaatgtaggacccagttcagagctcctgacaaaaatagctgatagcctgggcctaaggtctaatcaggaggttcttattgaggcagtggccctcgaaaggttgaaggagaatgctgaacaaactgaaaagactgcagaagctgaattcattgatcaaatgattgctgttgtaacgcgaatgcatgagcgtcttgttatgcttaaacaagcccagagtagcagcccagtttcaatacctgctgatttttgttgtcctctttctttggagttgatgactgatcccgtgattgtggcatcagggcaaacatatgagcgagctttcatcaagaactggattgatcttgggcttactgtttgtccaaagacacgtcagactctggttcatacccacttaatacctaattatactgtaaaagcactaattgcaaattggtgtgaatcaaacaatgtgcaactggttgatcccacaaaatccacaaatttaaatcaagcatctgtccttcatggttatatggaatctggtacaaccagggaatcacctgtttttgctcattccaggagcaaccagccatcctcacctgagtcagcacgttcttgttcttttagttcaccagctaataacttaacttctggtggaactcagcgagagggaacatcacctttgcatccccgttcaacttcagaaggctccttcagaggtatggttaatgggcaatatatggatcttgctagaatatctcctgaaggtttggatgacaggtctgctagctcagatgaaagcagtgtggattcagctagccatccatcaatgtcaccatctagaagggaatcttccagtgccttcagctctgaacaatctcaaacccatattagagctgtttctgattccagtgcactttctaatgcaaattttccccaagaaacacaagatgatgacaacaatgctcctcagctgtcaacaagtgcagggcacagtagagaagcttctggtgaattaaatccagggacagaaactggtggtactactgccgtgccatcagtgcatagagaacctgagttcccactccgattggagacaaggtctcgaagtcaagccatttggaggcggccatcagagaggcatgttcctaggatagtatcttctcctgttgttgaaacaagagctgatctttctgctattgaaacccaggttcggaatttggttgaggggttgaggagctctgatgttgatactcagagagaggcaacagcagaactccgccttcttgctaagcacaatatggataatagaattgcgattgcaaactgtggagccattaacttattagttgatttacttcaatcaactgatacaacaatccaagaaaatgctgttactgcacttctaaacttgtcaatcaatgataacaacaaaactgcaattgcaaatgctggtgcaattgaacctctgattcatgtgcttgagactgggagcccagaagccaaggagaattcagctgccactcttttcagcttatcagtgattgaggaaaacaagattttcatagggaggtctggggctattggaccactggtagaattattgggaagtggaacccctcggggaaagagagatgctgccactgctttatttaatttgtcaatatttcatgaaaacaagaatcggattgtgcaagctggtgctgtgaggcaccttgtggacttaatggacccagcagctggaatggttgacaaggcggttgccgtcttagcaaatcttgccacaattccagaaggaagaaatgcaattggtgatgaaggtggtattcctgttctggttgaggttgtggagttgggttctgcgagaggaaaggagaatgcagctgcagctcttctacatctttgcttacatagtcccaaattttcaagcaaggtgcttcaacaaggagctgtcccgccattagtagctttatcacagtcaggcaccccaagggccaaagaaaaggtggggctcaggctctcctcaatcaatttaaaagtcaaagacatgggagttctgggaggggctgatcttgaattcccaactcgtgtggtatccaaaggttttgaattaactcctgtataa

SEQ ID NO: 17875 - DNA, 1890 bp, Glycine max
  Peptide Sequence Number=SeqID_109560
atggaagaccgggtggatcctagaagatattgccaacttgaggcagttggccacctgaccaatgcggcgaaggcgaacaagcaaccaatcgtccacagaaaattgagcatctacaaattgtttcatggaagcttgggctttagcgagccgttgtatcagagtggtgtgaacggcgaggaatcagagccactatgcaagattgtcatggacgaaggctctgaggcattgttcaagaatgcgattgaggaccttcgtctggtcgtccatttgtgggtgactgcgaagaaaactgtgaagtttgcagacaatgtccatgaagaggatgactaccttgtgcaccgtataatagaagatggtgtcggcaagggttggaggaggctcgctggtttcgtagattcgtacttggcgatgaagagttttagcaacttcaatgtgaccaccaagggtgtattgcgaagtttgaatgtgcttcaaggtgttgttggatttgcacgagtaaatcctgcccaggagtttggcaaggtaaatttgttgttcgggagtctgtttcacctgagacatgaggtccctgaggctctggtgatctataagaatcacaaaaggatgacccaaaagaggactgctcccatggcgacgcctgaagcatcgaattccagggtaaaaggaagagaaaagttcgacatagctagaactggggcgttaatcatacattgtttgagagctttgaaggctcgttgggcttccaattgccagaaaaattgggagttggccatgcaactattgcctgaatcttatccaggtctggggccatgttgtcggctaacacgatatgctcgaggtagtactaaagacgagaatgtcgttaaagaagaccgcgacaaatttttgaagaaatggtctaagaagatcattcatagtcgcttgaaatgtcgaggggacattacaaagtccgaacgacatgactttatactcaaaatgtccatggagctcgtctatcgtaggcatgggaaatttgtctttgaccgtgatggtgttcagagcccgagcatcggcgaagagaaggggttgcgactgggttggatgaggccagccacgagcataaaagctacttacctttcatgttttgacttttggcaatatagggactcaaagctcaaaagcagggtggtgatgacagggggtattgaaggtgaagctgggggtacagtaggaccaattaagtgtagaggttttgggtcgggacggagaggtacatccatgtgtaaggttataggtcgacccagatgggtgaaggacatagttagaaagggtgaattggtggccctgaatgatgatggcaaccttggggcatgtggtgtagcaggacgcaaggaggttaaagaatttagcaacgtgactctgaatgaagttatgggtgcttttgccgtccacaagaatggtgacacgatgatgaagaatatggactggctctgcgattgggtggtcaaagtccgaatgtttgttgttgtcggggatgagaaggtggaggcgaggcttgcatctatggcctacgatccacttctcatcacattggtagcaaagacctttttctcgtttgactgccatctccttcggggtcagtcatttgactggaaatttcggggtggggtgaaacgtgatttgatcgttttaagcatggcgggccatgatgtgaggaatccattcctcgacatccactggggtcccctgataatcgaagaactgacaaattttgaagatccatcctatgggatcctgaccgtcgaagcgtggtacctcaagcttcatgtgagggaagagggggtgacagtaagggctgctagtcgtcccatgatggagtcgagcttggcttccatggtggtttgggcgtga

SEQ ID NO: 17876 - DNA, 159 bp, Glycine max
  Peptide Sequence Number=SeqID_109561
atgctttcttcaaatggtgcagcgatgcatttcaaggttgtgcaacggatgtatataggtgtaatgtttgatttaaaaaaggagatgcaaaaggaattaaatggagatcaaaaggttgagttagtgttgctatttttcaaggagattagaggagagtga

SEQ ID NO: 17877 - DNA, 189 bp, Glycine max
  Peptide Sequence Number=SeqID_109562
atggctaacattctatggaacatatacctctatagctattatagccatgcacgagctgaaagatggctcgttagtcttgagattgatagtgacaatttggtatcgtggggtggagaggtatatggacttccaattaatcacttacctgtggatgtggatgatgttcatctgtggggtatggatccatag

SEQ ID NO: 17878 - DNA, 2604 bp, Glycine max
  Peptide Sequence Number=SeqID_109563
atggaggcaatggagcgagaagtacttgcagtagattcagagtttaaccaggttttacaaagtgatgcttgccgtcttcaacaacttcagtgccatactgcagctcataatcatcctttaaatagattcttttgggggaataaaaagagcttggttgatgcaatggagaagggtattaatttgcgggagcaaatattgaaattatacaaggaatattatcacggtggattgatgaagcttgttgttattggtggagagtctctggatgtgcttgagagttgggttgtggaactgtttggcgctgtcaagaaaggtcaagcaaacccagtgttcacagtggaaggtcctatctggaaatctggtaaagtttatcggctagaagctgtcaaagatgttcatatccttgacttatcatggacacttccctgtctacaccaagagtatttaaagaagccagaggattatttagctcatctccttgggcatgagggcagaggaagcttgctctcctttctcaagagcagaggatgggctacatctctatctgcaggtgttggggaagaaggaatttatcggtcatctatagcttatgtcttcgtcatgtccatacacctcactgactctggtgtagaaaagatctttgatatcattggctttgtctatcaataccttaagttgttgagccaagattctccacaagaatggatatttaaggaacttcagaatattggaaacatggatttccgatttgcggaagagcagcctcctgatgattatgctgctgagcttgcagaaaatatgcacttttatccaccagaacatgtaatttatggtgactacgtgttcaagacatgggataaacaattgttaaaacaagttcttggtttcttcattcctgaaaacatgagggtagatgttgtttcaaagtcgttccttaagtcagaagatttccaatatgaaccttggtttggttcacgttacgttgaggaagatattggtcaaagtttcatggagttatggagaaatcctccagaaattgatgtctcactgcatcttccttccaagaatgagtttattcctagtgacttttctatacgtgctagtgacacctgtgttgatgattttgcaaattcaacatctcctagatgtataattgatgaagcattaataaaattatggtacaaaccggatagcactttcaaagttcctcgtgccaatacatattttcgaattaccatgaagggtggctatgctgacgtgaagagttgtgtattatccgaattgtttattcatcttcttaaagatgagttgaatgaaatcacatatcaggctagtattgccaagttagaaacttctgtcacttatgttggtgacatgcttgagctgaaggtctatggtttcaatgaaaagcttcctgttttgttatctaaattcttttcagtatctaaatctttcgtgccaactgatgatcggtttaaggtaataaaagaagacatgaagagagctttaaagaacaccaacatgaagcctctaagccattcaacatatttgagattgcaagttttgtgtgagagtttttatgacgctgatgagaagctgtgttatctaaatgatttgtttcttgatgatctgaaggcatttatccctgggcttctctcccagatgtcaatactgttagtgattggtgagcaacatgcacccgaatgtgtcatgtgtgttgtgccaactcctgaggtgcacatggatgagcaattgttattgtgcttggagcttatatacgtggagggtctatgccatggaaatctgtcaaaagaagaagcaattaacatatcaaaaatatttaagatgagttttccagttaatccgctccctattgagttgagacatgctgagcgtgttatttgcctcccatccagtgccaatttagttagagatgtcaatgtgaagaataagtcagaaaaaaactcagtggttgagctttattttcaaattgatcaagattttggtctgggttcaatcaaattgaaagctttaattgatctttttgatgaaattgtggaggagccatttttcaatcaactgaggacaaaagagcagcttggttatgttgttgaatgcagcccgcgagtaacataccgtgtctttgggttttgtttctgcgtccagtcatctgagtacaacccagtttacttgcagggtagaattgaaaacttcttaaatggcctggaagaattgctggatggacttgatggtgattcctttgagaattacaaaagtgggttagtggcaaagctgctggagaaagacccttcactcacatatgaaagcaatagattgtggaaccaaattgttgaaaaaaggtacatctttgacttgtcaaagaaagaagcagaagaattgaagaacataagtaagcatgatattgttgaatggtacaagacttacttgaaaccgtcgtctccaaagtgtcggcaactacttattcggctatggggttgcaacacagacttgaaagaagctgaagcactacccaaatctgtgctggccattacagatccagcagcttttaagatgcaatccaagttttatccaagtttttgttaa

SEQ ID NO: 17879 - DNA, 540 bp, Glycine max
  Peptide Sequence Number=SeqID_109564
atgggtgtgactgttttgagtttgggatgctgggaaacaaccaagggaggcgtagttgacgtgggtgctgctgttggtggtggttgtgcggaggaggacggagttgacctgggtgttgttgtaggtggtggttgtgcggaggaggacaaagctgacatgggttttgttgttggtggtggttgtgcggaggaggaggttcttgtgtttcgatgttccagcattgctgttggcattgtaggatacatggaaggcggcacagtttgcagagctgtggtactaaacaagcttaacagacggtgttgggtactcgtaaaatcaataactggcgggattaagctagatgtatataaggagaaggtgggtgctgagacggaagggatgactcctgcaggggtgattacgggtggtgtgttatggcatggccagagtaagggtaaaggcagccatgggaggcagccatgggcgatgaatgcccaagaagaaaggagattctggaaattgctgcattgttacgtgagagatggtaatgagagagaatga

SEQ ID NO: 17880 - DNA, 534 bp, Glycine max
  Peptide Sequence Number=SeqID_109565
atgatgaggttgactcgtgattttggtgatacaatgcaaagagatgttgtgcctgcagtttcttctgatgttgaggttgttgcacgtgagactgcacagttgttggaacagcataatcatctctccgttcgtgaccttgctagtaaattcgagaagggtttggcagcgccaactaagttttctgaagaggctagacttagagaggcagcatcattggaaaaacatgttcttttgaagaagcttagagatgcacttgaatccttaaaaaggcgtctggcaggcagaaacaaggatgatgtagaagacactattgcgatggcttctgaagatgctaagattgttgatgaggaaagagcttttgctcatgctgaaagtaaggatgccagagcagcagttcaaagagtggaagtggcactacaagaacacgagagaatgtctcaagcttccgggaaacaagtcatggatatggaacatgagcttcgagcattgagggttcaacttgcaaagaagactagacagtatcttcgactttag

SEQ ID NO: 17881 - DNA, 564 bp, Glycine max
  Peptide Sequence Number=SeqID_109566
atggcagaagccaatgtagtgccgttggatttctggccaagctcttatggaatgagagtgaaaatcgctttggcagagaagggtatctcatatgagtgcaaacaagaagacttggaagctaaaagttctctgattttagagatgaacccggttcacaaaatgataccagttttgattcataatggaaaatccatttgtgaatcacttaacattgttcagtacattgatgaggcatggaacctcaaaccttctctacttccatctgacctttacaaacgatcccaagccaggtatggacagggaaggaccatggaagatgaacttggagacaagccatattttggtggtgaggactttgggtatgtggatgtggctcttgttcccttcactagctgcttttacacggttgagacctgcgggaaactaagcatagaggaagagtgtcccaaacttctggcttggccaagaggtgcatggaaaaagagtgtggccaagtcactccctcacccacaccagatctatgcctttgccatgcagtataaacagagacatggactagagtag

SEQ ID NO: 17882 - DNA, 1227 bp, Glycine max
  Peptide Sequence Number=SeqID_109567
atggccacacagacgcaagatccacgttcaaaccctaaccctaatcccaatgcaatgtcggcaacgccatcttcctccttcttcatccgcgccgccggcggcaacggtccctccgccgctcccgtcgccggctccggcgagtcgcactcgcaccaccggagggcgcactcggaggtcagcttccggctgccggatgacatgattgacttgtcgccgtcggatccgttcaacggcggatcctcgacggcgagcttcgaggagatcggatccgaggacgacctgttctccacctacattgacgtcgagaagctcggggctggacgcggcggaaacggatcggatcagagcggttatggaaatggcgccggcagcagctgctacaacgacggcgagaagagtccgagcaccgccgctgcgcggccgagacaccggcacagtagctccgtcgacggttccacgtcgacgagcatgttcggagagatcatggatgcgaagaaagccatgcctcctgataagctcgcagagctttggaacattgatccaaagcgtgccaaaagaatccgaatgcgatggtttaaagttgatgtcacatctttcgatctatatctagaactgctgtgggatggtaataaaatagctataatactggctaatcggcaatctgccgcacgttcaaaagaaagaaaggcacgctatatacaagaacttgagcgcaaagtccagacccttcagactgaagcaacaacactttctgcccaacttacactgtaccagagggatacaactggtctgagttctgaaaataccgagcttaagctccgtctacaagccatggagcaacaggcacagctgcgtgatgttcttaatgatgcattgatgaaggaggttgagaggcttaagattgctaccggagaggcattgaaccaatctgagtcttttaacctgggaatgcaccagatgccatatgcagggtcaaatttcttttcaatcccaccacattcaggtccttctgggcaccagaacatgcaattgccaccatttggccactcccattccactgtgccgactcatcagctgcaacaaacaaattctcaccaaatgtcagatatattgcaaaacgaccagcttggtcgtctgcaaggactcgacattagtagcaaaggaacacccgtggtgaagtctgaaggcccctcaatatctgcaaatgagagtagcaccacattttga

SEQ ID NO: 17883 - DNA, 478 bp, Glycine max
  Peptide Sequence Number=SeqID_109568
ggttaaacgggtcggatcaatagaagaagacgaagaaggtgttggtattggtgctggagttggggcttctgagaaagagggaaggtttatggagtcagaatcggtggcgtcatggtcggtgagaattacccggagtagcttcttgcgcggaggggtggtggagattcaggggtggttgtacggacatgaaagtttggtgtgtgtcactcattttattgaagaaaagagtaaggaaatggaaaaaggtggtagtggaagagagagagacagagatgttattgttatagtgagtgaggttggcgggaaagaggagagagagtggagggaagaaagcaaggagagagaggtaggattaaagggtatttatggtgcaccacggggtgtgtccccattggaggatcaaggaaatatttttctcgtgaaaggtggagatttgggtaacgaattgaaggagagagagagagggagaaaagagtga

SEQ ID NO: 17884 - DNA, 696 bp, Glycine max
  Peptide Sequence Number=SeqID_109569
atggcatcgaaacgcatcgtgaaggagctcaaggatttgcagaaggaccctcctacatcctgcagcgcaggtcccgtggcggaggatatgtttcactggcaggcaacaatcatgggacctcctgatagcccatatacaggtggcgtattcctagtttcaattcattttcctcctgactatccattcaaaccaccaaaggcaatgatctatcactgtattgtggatcagttccttgttatactggtctacccagtctttcaagttcagcagcttgtcagggtcagtttttccattgctgcaaatgctggtatccttcattgtgatagtggttcaattttctatgaaggaggaaggaaatttgccttgggtggtggtgcctcaggctatctgaggtgcaaagccaaaaacctgcctcacctcagtggctcaaatgctctggtggtcaaggttgcatttaggactaaggtattccacccaaacatcaatagtaatggaagtatatgccttgacattctaaaagaacaatggagcccagcactaaccatttctaaggtccttttgtccatttgctcattgttgacggatcccaaccctgatgacccgcttgtgcctgaaattgcccacatgtacaaggctgacaaggctaagtatgaagccactgctcgtagctggacacagaagtatgccatgggataa

SEQ ID NO: 17885 - DNA, 963 bp, Glycine max
  Peptide Sequence Number=SeqID_109570
atgggttggttggagcatatggttttagttgcaacagttagtacttcagtgtcttatggtatgaatcctagacgtatggacattggaggatgtgatatacagaaacaggaaatccgtgaggctgtggagctaccccttacacatcatgaactatacaaacaaattggtattgatcctccccgtggtgttttactgtatggaccccctggcactggcaaaacaatgcttgccaaagctgttgcgaatcataccactgctgctttcatcagggttgtgggatctgagtttgtgcagaagtatcttggtgagagcaacatcttcaaatcttccctgccatttatatttcagggtccacgaatggtccgtgatgtatttcgtcttgctaaagagaatgcccctgcaattatatttattgatgaggttgatgcaatagccactgctagatttgatgcccaaactggagctgatagagaagtacagcgtatccttatggaacttttgaatcagatggatggttttgaccaaacggtaaatgttaaagttataatggcaactaacagagcagacaccttggaccctgctctgttgcgtcctggaaggcttgatcgtaaaattgagttccctttgcctgatagacgccaaaagaggctcgtttgcacagccaaaatgaacttgagtgatgaggtagacctagaggattatgtttctcgtcctgacaaaatcagtgctgctgagcaagatgacattattccctggggaaattgtggaacagagttgaagctattagcttgcttctcactggctgtcccgaataaaaagaagagggtgatagcagccatttgtcaagaagctggaatgcatgctgttcgcaagaatagatatgtcatactgccgaaggacttcgagaagggttacaggacaaacgtgaagaagcctgatactgactttgaattttacaagtga

SEQ ID NO: 17886 - DNA, 900 bp, Glycine max
  Peptide Sequence Number=SeqID_109571
atgtctaatttgtacaatcagatttccttaccttcaccccaaagagccaattcaccaaacataaacatgagaggcaattttgatgttgatagtcagtacttaacagagctgctagcagaacgacagaagcttggacctttcatgcaagttctacccttatgtacgagactcattaatcaagagattttaagggttaccggaaagaatgaatcattgcagaaccaaggatttagtgactttgatagaatgcgattcataaatccgagtcatatgacttctccaaactcaacatcaaacttcactggctggaaaagcctgtcacatgaaaggttagctggtgtacaaggactaagcatggattggcaaacttcaccggttgttccaagttctcccattgtgaagaagatattgcgcttggatattccgaaggatagctatccaaattttaattttgttggccggcttcttggccctaggggtaattcactgaagcgagtggaagctactacaggttgccgtgtatttatcagagggaaaggttcaattaaagacttagacaaggaagaattgctacgaggaaggcctggctatgagcacctgaatgatccacttcacattctaattgaagctgaactacctgccagtgttgttgatgtaagattgatgcaagctcaagaaatcatacaagagctacttaaaccagtgttacctcttccacttaccagagtgtggctaatgctgaaaggcaatattgatgagtcacaggacttttataaaaggcaacaactaagagaacttgctatgcttaattccaacttcagagaagagagccctcaactgagtggtagtgtctctccattcacttctaatgaaataaaacgggccaaaactgatcaatag

SEQ ID NO: 17887 - DNA, 361 bp, Glycine max
  Peptide Sequence Number=SeqID_109572
atgtctccttctccggtatcttccatgatgtctccaacaacgacgcctctaatgacctacatatccatctacatcatgactctgttgctatcacagacacctccaacaactatcatttctgccacttttgaaaccttcatcgaaaacttaagcacaacccaaaagcggtttaaagctgcacaaggtggcgtgataagcatgggttgcggaggagaagctctgggacaagggggtgatggtcctaccatgtgggctgaccctttggttgcacatgacggtggttgtgggcaaggaggagccgccaaggattttgtatttcaattcgaggttgagaggggattggagtggaaggtcgtgagtg

SEQ ID NO: 17888 - DNA, 1062 bp, Glycine max
  Peptide Sequence Number=SeqID_109573
atggtgttggctgggctggtgaggggtcgcacactcgcaaatctgaagttgggaatggtgcacgatgctggtggtggtggtgacgtgttgaggccaataccgcatggtgcgatgctgatgggaatcgaccttggcacgacttactcatgtgttgcagtatggcaggagcatcactgtcgagtggagatcatccacaatgatcagggtaacaatacaacttcttttgttgctttcacggacgacgaaaggttgctaaaaatcaggctgctaccaatccagagaacaatgtctttggttgttgctggtactcatgacaaacctatgattatccttaactacaaggatgaggagaagcacttttgtgccgaggaaatatcgtccatagttcttgcaaagatgtgggagattgcagaagcgtttttggagaaacgtgtaaagaatgcagtggtcactgtgcctgcttatttcaatgattctcagcgtaaagctaccatagattgctggaggactaataattgtgttggagagcgaaaaattttcatctttgaccttggtggtggtacttttgatgtgtctctccttactcataagggtaagatcttccaagttaaggtaacaactggaaatggtcaccttgggggagaggaaatcgataacagaatggtggactactttgtaaaggagatcaaaaggaaaaaaaaagtagacattagtgggaacccaaaagcgctaaggaggttaaaaactgcgtgtgagaggtcaaaaagaatactctcatgtgctgtagctactcacattgagacatatgctttatctgatggcattgacttctgttcttcaaccactcgtgcaaggtttgaggaaatcaatatggatctctttaaggagtgtatggagacagtagataagtgtcttactgatgctgaaatggacaagagcagtgtacatgatgttatccttgttggtgggagcatcaacactgatgaagctgttgcttatggtgaagttgtgcaggctgctttgttgagcgaaggcattaagaatgttctagacttgtgctga

SEQ ID NO: 17889 - DNA, 951 bp, Glycine max
  Peptide Sequence Number=SeqID_109574
atgggtgtgaagtttgtgggcaaacaagaattcctaactcgtttttccatgtgtgttcgatccaagacgacgtctgcgcagtatttagcgacaagatttcgagaccccacgtttgagaaactcatggacaactacaagaaccttgtcaaagtcattgccattcaagacctcatccttgcaaacccaaagaaccgatcagtctccattgacttcctccgcaagtttcctcacatcttccacatttactatgacccttccaagttgaagcccttttgcagtgccattaatgcttctttgcctgttgttgctgatggacttgttcggatactgtcaatgtcttcatccagaatagtgcctcttagagctgtttttaaggtttggaaggagcttgggctgcctcatgatttcgaggactcggtcatatctgctaactctggtgtttttcagttgtgtgatgcgcaggaaccgaatactcatttgttgaagctggttgatggtgcttgtaacaatggttttagggcagctgttgaagattggagggttgttgagtgctgcaaggaggactgtagtgttgataggatgaaaatgtggttcagtttcaaacatgggtatcctccggggatgaggttgaccaagaatttcaaggccaaagtgaaggattggcaaaggttgccatacgtggggccttatgaagtggtgggtgagaagaagaagtctaaggctggaatgatggcttcggagaagcgagcagtgtcgattgaagcttatgacagagggtgtttgattgaaccaaatcctgtctatgatgcaagaagaagaaggttacttgatctcgttgttttaggacgtcggggtctgccagctgttaattcaaagttgcaggatacaagcagctgcaatgaggttggacaagaggaaaaccagcaaagacatgatttgtcatcatcttga

SEQ ID NO: 17890 - DNA, 237 bp, Glycine max
  Peptide Sequence Number=SeqID_109575
atggatgaaagggacttcactgatcacgtaatgcaagtgtatggaactcttaaacaagaaagggagaaatgggaaaaaaccatacaagttgagcttattacaaagatagctaaggaagcatatgccaaggtcaccgaagtacctgctgatatcaacactgccttgcaagaggatgtcaaaaaagttgtttcaccaactccgtccaatgctgagtttgctaacatgacatctaagtga

SEQ ID NO: 17891 - DNA, 336 bp, Glycine max
  Peptide Sequence Number=SeqID_109576
atgcttcggaaaccaagaaactggaacaagaacaatgttggaccgttttcatccaaggctagaggaggaacttgcaccactgcatcttctgatccaaccgaagccgtcctttgccgcgcttcctttcttctcaagaaaggatttggtggctaccatttgttcaagatcaactgtgaggactttgcaatgtactgcaaaacaggcttgcttgtagtcacagacatcagtgtagggcaaagtggacaagcaacatctctcttggctgctgttggtactgtagtttcttcaccatttgtgtttatgagcactagcttgtgtggtttggctttggtttga

SEQ ID NO: 17892 - DNA, 2799 bp, Glycine max
  Peptide Sequence Number=SeqID_109577
atgcgtggtttgaagctaactgaacgtttcaagagcactcaagttcatgctctcagttcttcttcatcagaaacaaatggtggcaatagcagcaaagcctcagtggctgctgccaccaaacctcacaactaccttaagagaaacaaaaccatgttaccatcatggtcaaaaaccaaatccagaactaccaacaacaactcaacctcatcactagcaaaccttgcccttcttcgcctaccttcgaccgacaccattgaaccatccatagaacctcaccttaagcccatcaaccttgtagagaccttatcagaactctatcatcgcatggagtgttgtacacagtccaacaaagccttaatgtgtgcggaacagtactctctcttgcgtggccttggtgatcagaaaatactcagaagatgtctcaggacagcatgtcaaaatgctgaggatgtgctctccaaggttgtgttgtctgcgtggttgaggtttgagaggagggatgatgagctagttggtgtgtgttcaatggattgtgctggttatgttgttgagtgtccaaagaagaatttggaacatgggtttagtccttgttcagttaatgatcactgccagtgtcagaaagagccaaatcaggaaacctgcactgatagtgtgtgtttgccagacgaggaaagtgatgttttgttctgtgttggaagtgaagaaatcagttgtgttaggtgcaggatagctgcactttcagacccttttaatgctatgctctatggtggctttgctgagtccaaaacgaacaagatcgatttctcaggaaacgggatatgtccaaaggggatgagggcagtggagttttacagcaggactaagagattggacctcttctgtccaatgactgttttggagctgctgtcctttgccaataggttttgttgtgtggagatgaggtctgcctgtgatgcacatttggcttcaattgttgtgaatgttgaagatgcattggtgcttattgagtatggattggaagagagagccacccttcttgtaggggcttgcttacaagtgttgcttagggagcttccaaattctctatataatccaaaggtggcaaaaatattctgtagttttgaggcaaaggaaaggttggccaatgtggggtgtgcttctttcttattgtactacttcctgagtcaggtggcaatggaggaaagcatggtatctaaaaccacaatgatgttgctggagagaatgggggagtgtgctgcagaaagatggcagaaggcactagcattccaccaattggggtgtgtgcttcttgaaaggaatgaatacaaagaagctcaacattgttttgaggcagcagttgaggagggtcatgtttattctttggctggtgtggccagaactaagtacaagcagggtcaaccatattcagcctataagttaattagttctctcatatttgagtataaaccagcagggtggatgtatcaggagcgtgcactgtataacatgggaaaggaaaagagttttgatttagatgttgcaactgaattggatccctctctttcatttccatataagtatagagcactagcaaaggtggaagagaagaagataaaggaaggaattatagagttagataggtttattggattcaaactctcccctgattgcctagaattgagagcttggttgtatgttgcacttgaggactatgacagtgcaatgagagatattcgggcgctgctgaccatagaaccgaattacataacttcacatgggaagatcaaaggggaatacttgctccaacttctaaaccgtggagttcagcagaagtgtcaggctgattgctggatgcagttgtaccaacaatggtcttgtgtagatgatattggttctttggctattatacatcaaatgctagagaatgagcctggaaagagtgtgctagagtttcgtcagtctctcctcctattgagattaaactgtcaaaaggctgcaatgcgcagtttacgattggccagaaaccattctagctcaatgcaagagaggctagtttatgaaggatggatcctatatgacactggatatcgcaaagaagcattggcaagggctgacatatccattgcaaagcatagatcatttgaagctttttttctaaaagcatatgtgttggcagatacaactctggatcctgaatcttcttcctacgttattcagcttctaaaagaagcacttaaatgtccttcagatggtcttcgcaaaggacaagcattgaataacttagggagtatttatgtggattgtggtaagcttgagcttgcaaaagaatgctacaagaatgctcttgcaattaggcacacaagagctcatcaaggtgtggcacgcatttatcatcagaaaaatcaaagaaaagctgcatatgatgagatgaccaagctaattgagaaggcagagagcaatgcctcagcatatgagaaaagatcagaatactgtgaccgtgagatggcaaaggctgatcttgatgttgtaactcaacttgatcctttaaggacctacccatatagatacagggcagcagtgatgatggatgagcaaaaagaaactgaagcagtagaagaactcactaaggccataaagttcaagcctgacctgcaaatgcttcatctacgagcagcattttatgaatcaatgggggacctatcatctgctcttcaagattgtcaggcggctctttgcttagacccaaaccatgcaggcacacttgatgtatatcgaaggatacaaagattgaacttttaa

SEQ ID NO: 17893 - DNA, 318 bp, Glycine max
  Peptide Sequence Number=SeqID_109578
atgaagttggaagtcgcactgaccaaagtagtggtgatgacaaatgacaatgttaatggtggttgcattgatggtggtggtagtgataacaatcataataatagtagcaaaagtattgtggtcatggtactaactactagttatagcagtgatgatgataatgacaatgacgaagatatttttaccctaacacttacccttgaggttgctctccctacctctcgtacgctgctctcccttcaagcctctctctccctctcgtacggtggtcactgctcgccgtcgctctctctcacggtgctctccgccatacaataa

SEQ ID NO: 17894 - DNA, 627 bp, Glycine max
  Peptide Sequence Number=SeqID_109579
atggcgatcgcgccaacaacgattaatatcagacgcaaatcctgcatcattgtattctctgttgttccaataccttgccaccacggcaaactttatcctctaactgtatttgcccagctacacaagtgcaatgcgcctgtcaccgataaaaagccagggctggaaactggtgcgtctgccaggtatccgccgctacgtcatcatcccgctgctggtaaacattgtgctgctgggcggtgcgtttatctggctgtttcagcgcctcggccagtggattccacagctgatgtcgcacgtgccggactggctgcagtggctgagctatctgctgtggccgctgtcggtgatttcgattgtgctggtattcagctatttcttctccaccatcgccaactggattgccgcgccgttttgcggcctgctggcggagcagctggaagggcgtctgaccggaaaacccctgccggacagtggctggctcggcatgatgaaagacatcccgcgcatcatgaagcgcgagttacagaagctcggctactatttgccgcgcgcactgggcctgctgctgctctattttatccccggctttggccagaccgtggcgccggtgttgtggtttctgtttag

SEQ ID NO: 17895 - DNA, 1881 bp, Glycine max
  Peptide Sequence Number=SeqID_109580
atgcctgatttctctcgtttacgtccgcactccagccagggctggctcgcctgggtgctgctggctttcatggtgttcttctcgctggccagcgatcagtttctgacggtgcagaacctgctggatctggcggaaagctatgccgttaccggcattttcgccctcggcctgtttgtagtgctggtgaccggcggtatcgatatctccttcgccgccgtggcgtcggtggtgcaatacctgatcgcctcgctgtttgtgcagttccagtttgataacgcgctgctcagcattctgctggccatcgtctgcggcacgctgtttggcgtgatcaacgccctgctgatcacatcgctgcgcgtggtgtcgatcatcatcaccatcagcatgcagtcgctgctgtttggtctgctgatgtgggttaccggcggcaaaagcctctactcgctgccggactggtggatcaccctgcgcagcgtgctgccgtttagcgtacagggcaacagttttcagattggcttaccgctggcgatcatgctggtgattgccgccctcaccgcgctgctgctcaacaaaaccaatctgggccgtcagctgtatgcggtgggcggcgatgcggaatcggcgcggcgtattggcatccgcgtgggattgattcacgtgtttgcctacggctggctcggagcgatggcggcgattggcgggctggtgcaggtgtaccgcatgggtgaagtagtgccgaacgcgctggtcggcggtgagctggatgtgctggctgcgacggtgctgggcggtgccagcctgatgggcggcaaaggcacggtcagcggcacgctgatgggcgtattcctgatcgccatcctgaaaaacggcctcaatctgatcggcgtctccaactacttcatgaacattgtggtcggcggcacgattatggtggcgattgccgtcacccactacaaaaaacgtaaagaaaccgacgccaccttcagcgtcatgctgccgggccgctttctcaccgactcgacctttatgagcatggcgtttcagctgccggagctcggcctgttaacgctggctatgtttatcgccatcctcagcggcggcctgaacctcgccatcatcgccaccgccaacctgacggcgctgttcatcgcctggaccctgatgagcgccctgcccgctgatgccggtaccggtcagcagctgctgtggctgtttatcgccatcgtcggcgcgatggtgattgccgccgtgattggcgtgatcaccggcgtgatggtaacgcgcatcggcgcgcacccgattctggtgacgctggccaccatgatgacgctcaacggcatcggcatctggctgaccaaaggtgcggcggtgagcggtatgccgccggtggtgcagtcgctcggctcagacacgctgctgggcatgccgctgccgctgtgggtattcctggttgccgccgcgctgctggcgctgttcctcggcaaaacccgcgccggcaaatgcatctacatgggcggcagcaacatcaacgccacctggttcagcggcatcaatacccaccgtatggtgatgctggtgtacgtcatctccagcctgctgtgcgtgctggccggcctgatcatgatggcgcgctttaactcggcgcgcatgggttacggcgatgcctacctgctgctgaccgtactggccatcattctcggcggcaccgatcccaacggcggttttggccgcgtgaccggcgtggtgctggcgctgattgcgctgcaggtgctctccaccggcttcaacctgatgaacatcagccagcacgtcagtcctggcgatgtggggtgccgtgctggtggtggtgctggccttcaaacaactcaaagcacgctttaa

SEQ ID NO: 17896 - DNA, 525 bp, Glycine max
  Peptide Sequence Number=SeqID_109581
atgatcgacaacgcgcgtgccggcggcacgtttgtcattctgaatccggcaccgtggcagaaagtcagcgatgcgctgctggctaaggtggatctgttaacgcccaacagcaccgaagcgatgcagctgagcgggataaaagtgaccgattttgccagcgcgcagcgcgccgccgaagtgctgcaccgtaagggcgcgcgtcaggtgattattacgcttggcaccgcgggcgccctgctctccagcgcggagcagcagctgcgtattccgctgtttcctgcccagccgctcgacaccaccggtgccggcgatgccttcaacggcgcactggcggcgcgcctggcgtccggcgatgcgttaccgcaggcggcgctgtttgcggcggcgtttgcctcgctgtgcgtcgagcgttccggcgcggccaattccatgccctcctacgccgaagcgctggcgcgcatgcaggctcatccggagtgtgaagtaacgccgttaaatgctccggaaatcacgcacatggcgtag

SEQ ID NO: 17897 - DNA, 2217 bp, Glycine max
  Peptide Sequence Number=SeqID_109582
atgtacggcaaagatcgtctgacccagccgctgctgcgcatgaccgacggcaaattcgataagaacggcgagtttaccccggtaagctgggatcaggcgttcgacatcatggaagcgaagtttaaggcggcgctgaaagccaacggcccggaatcggtcggcatgtttggctccggccagtggaccgtatgggaaggttacgctgcatcaaagctgatgaaagcgggcttccgcaccaacaacctcgatccgaacgcgcgccactgcatggcgtctgcggtggtgggctttatgcgtaccttcggtatggacgaaccgatgggctgctacgatgacatcgagcaggccgatgcgtttgtgctgtggggatcgaacatggccgagatgcacccgattctctggtcacgcctgaccgcgcgtcgtctcagcaatgacaacgtcaaagtggcggtgctgtcgacctatcgccaccgcagtttcgagctggccgataacgccatcgtcttcacgccgcagagcgatctggcgatcctcaacttcatcgctaactacatcattcagaacaataaagtcgataaaaccttcctgcagaatcacgtcacgctgcgtaaaggcgtgacggatatcggctacggtttgcgcccgaccaatccgctgcaggcggcggcgaaaaatccggacaacggcgagtcgacgccaatcagcttcgatgaatatgcgcaatttgtcgcggaatacacggtggaaaaagccagcgccatgagcggcgtagagcaggatcagctgatcgcgctggcggagctgtacgccgatccgaacgtgaaggtggtctcttactggaccatgggcttcaaccagcatacgcgcggcgtgtgggcgaacaacctgtgctacaacatccacctgctgaccggcaaaatttcccgtccgggcaccggaccgttctcgctcaccggccagccatcggcctgtggcaccgcgcgtgaagtgggcacgtttgcgcaccgtctgccagccgacatggtggtgaacaatgacaaacaccgcgctttagctgaaaaactgtggaagctgccgcagggcacggtgccagccaaagtcggtctgcacgccgtggcgcaggatcgcgcactgaaagacggcaagctgaatgcctactgggtgatgtgtaacaacaatatgcaggccgggccgaacctgacgcaggaacgcatgccgggctggcgcgatgcacgcaactttgtcgtggtatccgacccgtatccgaccgtcagcgccctgtctgccgacctgattctgccgacggcgatgtgggtagagaaagagggcgcctacggcaacgccgagcgccgtacccagttctggcatcagcaggtgaaagcgccgggcgaggcgaaatcggatctgtggcagctggtgacctttgccaaacgcttccgcgttgaggacgtgtggccagaggcgctgattgctcagcagcctgagctgaaaggcaaaaccctgtacgacgtgctgtatgtcaacggccaggtgaatcagttcccgctgagcgaagtggccgacgaccgcctcaacgatgaagcgcgtgagttcggcttctatattcagaaaggcctgttcgaggagtatgccagctttgggcgcggtcacggtcacgatctcgcaccgtttgatacttatcacgaggcgcgcggtctgcgctggccggtagtggacggcaaagagacgcgctggcgctatcgtgaaggtttcgacagctacgtgaaagccggtgagggggtacgtttttacggtaagccggacggcaaagccaccatttttgccctgccgtacgagccgccagcggaagcgccggatgccgaatatgacctgtggttctgcaccggtcgcgtgctggagcactggcacactggcaccatgacgcgccgcgtgccggaactgcaccgcgcggtgccgcaggcgctgctgtatatccatccgctggacgccaaagatcgcggcttccgtcgcggtgagaaggtgcgcgtggtatcacgtcgcggcgaaaccctcgccaccgtggaaacgcgcgggcgtaatcagccgccgcaggggctggtatttatgccgttcttcgatgccggcgtgctggccaacaacatcacgctggacgccaccgatccgctgtcgaagcagaccgattacaaaaaatgcgccgttaagctggtgaaaatctga

SEQ ID NO: 17898 - DNA, 1257 bp, Glycine max
  Peptide Sequence Number=SeqID_109583
atgccgcgcggcgagccgggaaattacggcgatgaatcctacccggcattaacggtaaatctcggcgctgccgctccacatgctggaatcgcccggattctgcatgccaatgacgcgataatgactggcgcccatctcttccgctttttgcgacagctgacgggtggcgtcatccagcgaaccgcgcacgccgctcaccgaaacggtgccgctgctttgcaggtcctgggtttgtgcctcgctcaacggcgaggcggcaaagggttacgcgtcaaagtatcggtgagccagtgcaaaccaggctgcgcgggcggtaaaagcgttcaatatttcgccagccaaacgcggttaatccagggaaacgtaaaccgcgtgaaacgtcccgttacccgcaccatcgcccgcgcgctcagcgcgattgtgctgctgtcgctgttaaccaccggcctggcgctgatgacgctctccagcagtttgcgcgatgccgaagcggtgaatgtcgccggctcgctgcgcatgcaaatctaccggctggcgtgggacagcacgcgcgatccgcagcagctggcgcaccatatgcagcaatatcagcagacgctggagtcaccggcgctgcagcatctggagcgtccgtgggtgccgattgagctggccggtactgcaagagacgctgcagccggcgcgggcgcaggtgtaccagcagcgcgtggcgggctaccactatgccgagctgaaaatgcatctggtggccgccagcagcctgttcggctttctggcgattgtcgcgctggcgctgtggagcattggctttattcgccgcaacgtggtgcgtccgctcgattcgctggtcaccgccagtcaatacgtcgagcaggccaacttcagttttccgccgctttccgtgcatcagcccaacgagctgggcgtgctggcgcaggcctttaccactatggcggagcggctgcattcgcactatcgcctgctggagtgcgcgattctcaccggcagcccgctcaatcccgagctgttccagggcctgctgcggctggtgcagcgacgggaagcactggaggtgctgcaaatcgccagcgaggatatcgccttccaggccggcgtgcccgccgacgatctcagctggcagcggctgccgctgcagcaggaggagcagcgcctcggcgaacttctggccaacatgctggcgcgtgcactgtggatctggcagacgcagaagcagtatcagcagatgctgctgattga

SEQ ID NO: 17899 - DNA, 977 bp, Glycine max
  Peptide Sequence Number=SeqID_109584
atgtcgaacttttttatcgaccgccccatttttgcctgggtgctggctattttgctgtgcctgtgtggcacgctggccattatctcgctgccggtggaacagtatccagatctcgcgccgcctaacgtgcgcatcaccgccaactatcccggcgcatccgcgcagacgctggaaaacaccgtcacccaggttatcgagcagaatatgacagggatcgataacctgatgtacatgtcctcgaacagcagcaataccggccaggcgcagatcaccctcacctttaccgccggcactaacccggatgaagcgcggcaacaggtacagaatcagctgcagagcgcgctgcgcaagctgccggcggcggtgcagtcgcagggcgtcacggtaaacaaaaccggcgacagcaacattctgatgattgcctttgtctccaccgacggtagcatggataaacaggatattgccgattacgttgccagtaacattcaggatccgctcagccgcatcgacggcgtcggccaggtcgatgcctacggctcgcaatacgcgatgcgcatctggctcgatcccaacaagctgattaactacgcgctaaccaccgacgatgtggtcagcgccatcgaatcacagaacacccaggtggcggtcggccaggtcggcgggttgccgtcggtggacaaacaggcgctgaacgccacggttaacgcccagtcgatgctacagacgcccgcgcagtttcgcgccattacgctgaaaaccaacaccgacggttcagtggtgacgctcggcgacgtggccaccatcgccatgggcgccgaaaagtatgactttctgagccgctataacggccagccggcctccggtctcggcatcaagctggcctccggcgctaacgagatgaacaccgacaagctggtgcgcgcccgtgttgctgaactggcgcaatacttcccgcacgggctggaagccaaagtggc

SEQ ID NO: 17900 - DNA, 831 bp, Glycine max
  Peptide Sequence Number=SeqID_109585
atgaaaggctcgctggcggcgatggtggtggcggccgagcgcttcgttgctgctcatcccaatcatgctggccggctggcgtttctcatcacttccgatgaagaagccagcgccgtcaacggtacggtaaaagtggttgagcgcctgatggcgcgcaatgaacgcatggattactgcctcgtcggtgaaccgtcgagcaccgaagtggttggcgacgtggtgaagaatggccgtcgcggctcgatgaccgccaatctgaccattcacggcgtgcagggccacgtggcttatccgcatctggccgataatccggtgcatcgcgcgatgccggcgctcaacgagctggtggcgaccgagtgggatcagggcaacgagttcttcccgccgaccagcatgcagatcgccaacgtgcaggcgggaaccggcagtaacaatgtgattcccggcgagtttttcgtgcagtttaacttccgcttcagcaccgaactgaccgatcagatgatcaaagatcgcgtggcggcgctactcgatcgccaccagctgcgctatacgctggagtggaatgtgtccggtcagccattcctgacttcacgcggcaagctggtggatgcggtcgtcaacgccgtggcgcactataatgagatcaagccgcagctgttaaccaccggcggcacctctgacgggcgctttattgcccgcatgggcgcacaggtggtggaactcggcccggtgaatgccactattcataagatcaatgagtgcgtgaaagcctcggatttgcagctgctgagccggatgtatcagcgcattatggaacagctgatcgcctga

SEQ ID NO: 17901 - DNA, 759 bp, Glycine max
  Peptide Sequence Number=SeqID_109586
ggcggactggatgctgcgctggcgcaggcggtgtgggccggcttacgtcgtccgcgcggcaatctggtggcgcagtcattagcggcacatgccggttttactgaagcggcgacgttacgttcgctgcgcatcagccgcattgccgtgcaggccgcacagcgccagcgcggtattggtggtgcgctggtggcgacggcgcggcagcaggcgcagggcgcggactatctgtcggtgagctttggctacaccgcagcgctgtggcagttctggcgcgcctgcggctttacgctggtgcgtatcggttcacagcgcgaagccagcagcggttgctatgcggcgatggcgatttgtgcgctgacgccagccggtgaagccctgcagcagcgtgccgcgcagcgtctggcgcgcgactggccgtggctgcaaaagctgatcgcggtgccgctgaccctgtcgtccaccgaccatcaatccctcagcgccgacgactggccgctgctggccgcgtttgcctgggcgcagcggccctatgaagccagctatgcggtgctgcagcggctggctggtgtcgcatcgccaccgttgctgtgtgccatactgcaacaaaaacaaacgctgagtgaagcggcacggctggccggcgtgagcgggcgtaaaacgctgatgctcaggctgcgcgcggaggcggctgacgcactcatcacgctggatgccgccgccgcgcagcactggcagcagcgcctcggcatattgcaataa

SEQ ID NO: 17902 - DNA, 1572 bp, Glycine max
  Peptide Sequence Number=SeqID_109587
atgaatggtcaggttttgctcactggtcaactggcgacgcgcgatgacagtattaacccgcacgatgaggcgctgtcatttgctgtgcatccctctgcctgtgcatgccggagagtttctatgcgttctgttgtttcctatgccctgattgccatcgtgggtgggatggtcggtgccgccgtaatcaaaagcgatgacctgtatcagcgcatcgcgggccatttttccgctgaacctgccgatccggacgggttctggagcacgccggcggtcgcgggctacggcaaaattcattatgaagccgacgccgcgtttaaaccggcggtggggctgagcaacaaagtggtgttccagctgacccgcaatgaaggcgatatcaaacggcctaacctcgggctggagcgcgtggcgcgcgtggtcaatctgtacatcgccgctggcgtaccggccgaacagctgcagtttgtggtgtcgatgaccggcgatgccacgcccgccacgctggataacgcgcattttaagcagttttacggcgtcgataaccccaacctcgcgctgattggcgcgctgaacaagctgggcgtcaaagtctcggtgtgcgatcagtcggtggcgttccatcactatccgcgcgactggatcgaccggagaagtgtcatgcgtccagcatcctatattgttatcgccgcgctggcgggctttgtcggtggaaatatgctgcagctgccggaactggtggataaagtcagcgggaaattcgctgaccagaaaaccgaaccggcggatttctggagcacgccggcgattgccggttacggtaaaattcactttgttaacacgccggattacaacccggccaacacgcccgggctgagcaataagattgtgtttcagatcaaccgcagcgaaggggatatccatcagccgaacctcggccttgagcgcgtggcacgcgtcactaacctctattacgcggccggcgtgccgcttaatcagctcaactttgtggtgtcgatcaacagcgatgcggtgccggccgcgctcaataacgatcagttccgtaaagcatacggcagcgataaccctaacctgaagctgattgatgagctgaagaaagccggggtgaaagtgaccatttgcgaccagtcggtggccttccatcagctagagcgcgactggattgatacccgcgtcacgcatacgctctccagcggcaccaccgtcgcgtcgctgcaaaacgaagggtacgccttcctgatgctatcgatctcatcggcactttacgaggcgaacatgtccgacttactcacggtggcaaagctggcaggcgtttcacgcgccacggccgcgcgcgccttttccgatccccatctgctgcggaacgacacgctggagagagtgctggcggcgtcggagcagctcggctttcgtcctaaccacatcgcgcgccagctgcgcacgcagcactccaccaccttcggcgtgctgctgccctcgctgcttaacccgatcttctcctgccagttacaggcgatggagcgccaggcgcgcgacgccggctatggcctgctg

SEQ ID NO: 17903 - DNA, 762 bp, Glycine max
  Peptide Sequence Number=SeqID_109588
atgtgtggtgagctggctggtgatgaacgtgctacactactgttactgggaatggggctggacgaattcagcatgagtgccatttcaatcccaagcatcaagaagatcattcgcaataccaatttcgaagatgcgaaggcaactggcagagcaggctctggctcaacccacagcggaagatttgatgaacctgagagcgcgtcagggactatcgatatcgttgcgcctctgtcaggcgaaatcgtgaatatcgaagacgtacctgatgtggtattcgcagagaaaatcgtcggtgatggtatcgccatcaaacctactggcaacaaaatggttgcaccagtggatggtactatcggcaagattttcgaaaccaaccacgcattttctatcgagtctgataacggcatcgaactgttcgtgcacttcggtatcgacacggtagaactgaaaggtgaaggcttcaaacgcatcgctgaagaaggccagaaagtgaaaaaaggcgatgtggtgatcgagtttgatctgccgctgctggaagagaaagccaaatccacgctgaccccggtcgtgatctcgaatatggatgagatcaaagacctggtgaaactctccggtcaggcgagcgcttctggcaaagcgcaccgtgcctgtttgagggcgggacgaccgggcagaggagcgaagcgtcccgcgccatggatggcgcgggccgaggcccagggacggtttatgccgtctttgcgatctgtccggtcgtcctga

SEQ ID NO: 17904 - DNA, 1867 bp, Glycine max
  Peptide Sequence Number=SeqID_109589
atggaaattcgctccttccgccaggaagattttgaagaagtcattacgctctgggagcgttgcgatctgttacggccgtggaacgatccggaactcgacatcgaacgcaaaatgaaccatgacccggagctgtttctggtggctgaggtaggcggcgaggtcgtgggcacgctgatgggcggctacgatggccatcgcggctccgcctactatctggcggtgcaccctgattatcagggccggggatttgccaatgcgctgatgaaccggctggagaaaaagctgattgcgcgcggctgcccgaaaatccatctgatggtgcgcgaagagaacgatcaggtggtggctttctacgagaagctggattacgagccggtcgactcactgctgctgggcaaacgcctgattgaagaccgcacgccagtcggcacaaaagaaaggagtttgcatgaaagttgttcgtcccgccctgctggtcagcgccctggtgctggccggttgcgccagttccgttcgctcaccgtcaccgagcagggcgtcgccgggctgaacagcaacacggcaatgtcggagtccgccattagcgccgcgctgaacaatgattatcagctgcgtcagggcatgcgcacgcagaacgggcaggtagtggatttctggcaggcgctggatgacggtaaggttaagctggtgattaatggccagcgtagcgtcgagcgcattgaagtgctcgatagcgatgcgcgcagcgccgacggcagtaaaatcggtgatgcgttcagcgataaattcagcaaagcgtttgataattgcaaaatggttgccgggctggatgtgcgcgatgttgagtgccgcgcgccgggtagtcagcatatcgcctatatctacagcggcgagtggcacggtccgaccgggctgatgccgtcagatgatacgttaaaaagctggaaaatcagtaagatcagcattgtcatgtctcagtttcagagcgggatcctgctggagcaccgccgttttgccatttggctggaagcccgcgccaccggcgacctcgctgcgctgcgtcagggttgccacgcctttctgcaacagctggctgcgctacagcagcaattcccggacgccggccttggtgcggtcatcgcctttggtgatgcgctgtggcgcgatctgcagggcaccgactcagctcccgaactcaaagctttcacgccgctcggcaaaggtgcggcaccggcgacccagcgcgatctgttgatccatattcagtcgctgcgtcacgacgtgaacttttcgctggcgcaggcggcgctgacggcgtttgccagcgcggtcgccattgaagaagagacgcacggtttccgctgggtcgaagatcgcgatctttccggttttgttgatggcaccgaaaacccgcagggcgaggcgcgccagcaggtggcgatcattgctgacggcccggatgccggcggcagctatgtgtttacccagcgctgggagcacaacctgccgcagttcaaccggctggcgattgataagcaggaagcgattattggccgcaccaaacaggacaatgaagagctgccgggcgatcagcggccggcgacgtcgcacctgagtcgcgtggatttgaaagaagcgggcaaaggcctgaagattctgcgccagagcctgccgtacggcaccgccagcggtcgccacggtctctattttatttcgtactgtcatcgtctgtataacattgagcagcagctgctgagcatgtttggcgagcgcgacggcaagatggatgccatgttacggttcaccaaaccggtgagcggcagctacttctttgccccttcgctgacggcgctgcaggcgctgtcac

SEQ ID NO: 17905 - DNA, 1743 bp, Glycine max
  Peptide Sequence Number=SeqID_109590
atgttaatgaacaagatttcactgttgcggcgcctgaccaatcgccgccagctgatcctctccggcctggcgctggcggtgctgtcgccgcgcgcggtccaggcgcaggaaacgcgcgcggcagtgcccgtcagcgcacgccatacaccgccgaaaccggccaccagcggcaagcgcattgtgatgatcgatcccggtcacggcggcattgattctggcgcggtgggtcaggaaggctcagaagagaagcacatcgtactggagatcgccaacaccgtgcgtacgctgctgcagaaccacccgaaggtggaagtgcggctgacgcgcgacagcgaccacttcattccgctctaccagcgcgtggagattgcgcatcagcacggcgccaacctgtttatgtcgattcacgccgacggctacaccagcccggaagccaacggtgcatcggtgttcgccctctccaatcgcggtgccagcagcgccatggcgcgctatatgtcgcagcgcgaaaacgacgccgataaagtgggcggcgcggcggtgcaggaaaaagataattaccttaaccagatcctgttcgacctggtgcagaccgataccatccgcaacagcctgacgctgggtaaacacgtgctggaccagattcgcccggtgcatcatctgcacagccagcacaccgagcaggcggcgttcgcggtgctaaaatccccgtcgatcccgtcggtgctggtggaaacctcgtttatcaccaacccgcgtgaagaacagctgttgggcaccacggcgttccgccagaaaattgcccgggcgattgctgacgccatgagcaatcccgatatttcgcgcgtcaaagcctatctgctggcgctgcaggatgacatttgcgccggtctggcggcggaagacggcagcgccagctttgccgaagacacctggcaacgccccggcggcggcggtggacgcagccgcgtgctgcgtaatggcaaggtgttcgagcaggctggggttaatttctcccatgtgtatggcgagcagatgcccgcgtcagccaccgcgcaccgcccggagctggcaggccgcagcttcgaagcgatgggcgtgtcgctggtggtacacccggaaaatccgtatgtgccaaccagccacgccaacgtgcgcttttttattgccgaaaagccgggcgccgatccggtctggtggtttggtggcggtttcgatctcaccccttactacggtttcacagaggatgcccggcactggcatcagaccgcgttcgatctgtgccagccgtttggcgacgacgtctatgcgcgctacaaaaagtggtgtgatgactacttctacctgaaacaccgcaacgagcagcgcggcattggcggactgttttttgatgatttgaatacgccggattttgaccactgctttgatttcatgcaggcggtcggcaacggtttcatgcaggcctatcagccaattgtggcaaagcgtaaacaggtggcgtggggcgaacgcgagcgtcagttccagctttaccgccggggccgctacgttgagttcaatctggtgtgggatcgcggcacgctgttcggtctgcaaaccggcggtcgcaccgaatcgattctgatgtcgatgccgccgctggtgcgctgggaatatgattatcaacccgccgacgactccccggaagccgcgctgacccgcgatttcctgccggtgcaggattggctggggctggaaaaataa

SEQ ID NO: 17906 - DNA, 951 bp, Glycine max
  Peptide Sequence Number=SeqID_109591
atgaaccagctagatgcattaaaacagttcaccaccgtggtggcggacagcggcgatatcgaatccattcgccattaccatccggaagatgccaccaccaacccatccctgatcctcaaagctgccggcctcgacgcttacaaacacctgattgatgacgccattgagtacgcgaaaaaacagggcggcagcaaagagacgcaaatcatcaacgccagcgataaagtggcgatcaacctcggtatggaaattctgaaaagcgtaccgggccgtgtttcgaccgaagtggatgcgcgcctctctttcgatcgtggcatgtgtgtgaccaaagcggagaaactggtccgcctgtatgaagagaacggcatcgaccgctcacgtattctgatcaaactggcgtccacctgggaaggcatcaaagcggcggaagagctggagaagaacggcatcaactgtaacctgacgctgctgttctccttcgcccaggcgcgcgcctgtgccgaagccggcgtgttcctgatttcgccgtttgtcggccgaatctacgactggtacaacacgcgcaaaccgctcgacccgtatgtggtcgacgaagatccgggcgttaaatcggtgcgtcgtatttacgactactacaaaaagcaccgttacaacaccgtcatcatgggtgccagcttccgtaaagtggagcagattgtggcactggccggctgcgatcgcctgaccatctccccgaacctgctggaagagctggccaacagcgaagcgccggtggagcgcaaactggagccatcaaccgagggcttccaccagccggcaccgctctccgaagcggagttccgctgggagcataaccaggatgcgatggccgtggagaaactgtccgacggtatccgccagtttgccgtcgaccagcagaagctggaagacgtgctggccgcccgcctgtaa

SEQ ID NO: 17907 - DNA, 464 bp, Glycine max
  Peptide Sequence Number=SeqID_109592
atgactaggggcaatccaggtgatttacaaccctgtgatcctgaaatagatagaacctttcatagattagttagggatagtgtgcatcctggtcattctgtgcattttgaatattatgattttgagcattccactactaatttttatactgagaacatggctcaacctccacctcgtgagaggactcttagggagatggttgcacctgatttcacttatgaaagcttgtgcattcaatatcctgatgagggtgttccatatgttctcaagactggactaatacatttgctgcccaagtttcatggtcttgcaggtgaagatcctcataaacatcttaaggagttccatattgtttgttccaccatgaagccccctgacgtccaagaagatcatatctttctaaaggcttttcctcattctctggagggagtggcaaaagattggctatactaccttgcgcccag

SEQ ID NO: 17908 - DNA, 327 bp, Glycine max
  Peptide Sequence Number=SeqID_109593
atgcccttttgtgggcgagcgaggcgaggctcacgggtgcactttccaaaggaggaaagatgcgtggagtcgccaccaacgtttttttgtggaaaacgtcggaaaaaccgaaggaaaccggtcaaaacgaaaattctaagtttgggagttgtatttacgtttgaggaaggtcgacaaaagcagggctcttgctcctacgtaccctccatcgaagaggaaatcagacctacttacttctttcttagggtgaatcacacgacttctttttacttgaaaggtgatcatttaaaggcgttggaccttaaaaatcatccatttacttggtaa

SEQ ID NO: 17909 - DNA, 635 bp, Glycine max
  Peptide Sequence Number=SeqID_109594
atgccgctaaaaaacactgcaacgaacaaaccgcaggaaatcgccgccatcgacctcgggtcgaacagtttccacatggtgatcgcccgcgtcgtcaacggcgccttacaggtattgggccgtttaaaacagcgggtgcatctcgccgacggattggacagcaacaacgtactcagtgaagaggcgatagaacgcggcctggcctgcctggcgctgtttgccgaacggctgcagggcttcccggcggataacgtcaccatcgtcggcacccataccctgcgtcaggcggtgaacgccgaagtgttcctcaagcgcgccgccaaagtgatcccctacccgatcgaaatcatcgccggccaggaagaagcgcgcctgatcttcatgggcgtggagcacactcagccggagaaaggccgcaagctggtgatcgacatcggcggcggatccaccgagctggtgatcggcgaagacttcgagccgctgctggcggaaagccgccgcatgggctgcgtcagcttcgcccagctgttcttcccgggcggcgagatcagcaaaaacaacttccgccgcgcgcggctggcggcggcgcaaaaattggaaacgctggcctggcagtaccgcattcagggctggca

SEQ ID NO: 17910 - DNA, 408 bp, Glycine max
  Peptide Sequence Number=SeqID_109595
atgactaagggcaatccaggtgatttacaaccctttgatcctgaaatagatagaacctttcatagattagttaggcatagtgtgaatcctgatcattatgtgcattttgagtattttgttgttggtgattttgaacattctgattttgagcattcaactactaattttcatactgagaacatggctcaacctctacctcgtgagaggactcttagggagatggctgcacctgatttcacttatgaaagcttgtgcattcaatatcctgatgaggatgttccatatgttctcaagactggactaatacatttcctgcccaagtttcatggtcttgtaggtgaagatcctcataagcatcttaaggagttccatattgtctgttccaccatgaaactaccttgctcctag

SEQ ID NO: 17911 - DNA, 486 bp, Glycine max
  Peptide Sequence Number=SeqID_109596
atggcagctgactttgtagatgagattcattctggtcacatacatgttatttgcaactctacaatgacaaggagactttggtgggagcctttgagatgggttaatagagtgggtcctttttccacagacccaaagaaccactttttgcaattcactcaatggaacaacaaagctagtataaacaacagatggaaatttctgtggttagctctatccttcttcgtctggcatcatagaaatgctatgattttcaagaaccacccgtttgatcctgaaaagagaaggactacaccagggactacaccatccatatgtagcagttgcatgtggaggtcaacaccaggttgtctcatgaacgacaactccattagccatcttccagcggtcaatgacatggtgtgcatgcaacgggactcgagaaatttgaacaccttgcaatacatgttctgggggtggtcgggtaaggacataaaaaggcggagatga

SEQ ID NO: 17912 - DNA, 522 bp, Glycine max
  Peptide Sequence Number=SeqID_109597
atggatatgaacatcgacaccctgatctcagagcgggcaaggaaagcaagggctcgaccagttgatgttccttcttcttctactccaccagctccttccacttctgctactcctacactagctcctctagacccatctgcccaggactctcagcgctttgagtccatgcttcagagtctttatcagggaaaacagttcgtggagaaggtagcctggccagaaaatcagccttttcttgtgagggaaggtggaagtcccagtgctcaggcaggagggacacaggtaaggcaggaggctgctactccagagaggtcaacacagatttcaccagatccacctacaccaatgcatgagatgccagcagacccttctactccattactggagattccagaggaccctgcctcactagtcctgggactgactaccactcctctagccactcttgtgctacattttacagatgaggaaggcactcaggatcaagataaccaacaagatgaccagtcacaggagttttaa

SEQ ID NO: 17913 - DNA, 321 bp, Glycine max
  Peptide Sequence Number=SeqID_109598
atggagagaagtatgatagatgttgctagtggtggagcccttggagatatgacccctactgaagccagaaacttaattgagaagatggcttccaactcccagcaattaagtgccagaaccgagactaagaagcttgaaggtaaactagatgccttggttaacctggtaacccaactagccatgaatcaaaaatctgcacctgtcaccagactctgtggtttatgctcctctgctgaccaccacatagacctttgcctttctgtgcaacaatctgaagcaactgaacagcttgaagcttatgctgtaaacatctacaattga

SEQ ID NO: 17914 - DNA, 456 bp, Glycine max
  Peptide Sequence Number=SeqID_109599
atgcccagtctcaatccgcacccgttaagggactccttcccatttcaaaagacaagggaaagatcgatctgcttgaaaaaaaggttgagagcggtggaaggcctcgacaactatcctttcccggagttagccgatctgtgtctggtacctgacatcatcattcctcccacgtttaaggtaccagattttgataaatacgagaagctgataggatatatgccggccaactttgcaaacctcatcttcgccggagaaagaatcgagtccggactgaggaaaggcaagtttgaatatgcctccaacattggccccaacagcaatagaaaagccccagtggtgggcacacggaaaaaggaaggggatacccacgcggtcaccaccgccccaacgtggatgaaaacacccaaaaatgctcaaaactcataccaacacaaccacccgaacttttcgatctga

SEQ ID NO: 17915 - DNA, 234 bp, Glycine max
  Peptide Sequence Number=SeqID_109600
atgaaacagaggcaaatgatgcacaagctgttcattaaagaaattgccacttggcggagagagggtgacacctttggatcagacccattggggatgacacttggggaaatagagggtaagatggaaagtgacccgccgtcgcatcacaaacactcggcaatcttcaatggggatgatgccaccagggtgtatcaaaatagtgacggagtaaagcccggcgtatgcagcaactga

SEQ ID NO: 17916 - DNA, 610 bp, Glycine max
  Peptide Sequence Number=SeqID_109601
taccctcacctttagagaactacacgtcctcgccatcaaagggctacaagcactctccttcaaagggctacacgccctctcctttagaggactacacgtactctcctttagaggaccacatgtccttgccttaagagggttgcacgcccttgccttcagaggactacacgttctcaccatcagaggactacacgtcctcaccttcgaaggactacacgtcctcgcctacaaagggctacatgccctcaccttcagaggactacacgtcctcgccttcagagggctacatgccctcgccttcagaggactacatgtcctcgccttcagagggctacacgccctcaccttcagaggactacacgtcctcgccttgaggactacacatcctcaccttcagagggctacacgccttcaccttcagaggactacacgtccttgccttgaggactacacgtcctcaccttcagaggactacacgcctttgccttcagagggctacacgcccttgccttcagaggaatacatgtcctcaccttcagaggactacacgtcctcaccttcagagggctacacgccctcacctttagaggactacatgtcctcaccttga

SEQ ID NO: 17917 - DNA, 902 bp, Glycine max
  Peptide Sequence Number=SeqID_109602
gcccagcaacagctgtgcttgatgcattggcaccgacagtagcacttgatgatgtgctcaccaatgacagcacacctgcgctcactggtacagtcaacgatccaaccgcaactgtggttgtgaatgtggatggtgttgactacccggcgacgaacaatggcgatggcacctggacgcttgcagacaatagcttgcctgcgttaacagacggtccacacaccattaccgtgacggcaactgaccctgcaggtaatgcaggaacagatactgcagtggtgacgattgataccaccgcaccaaatgcaccgctacttgatccaatcaatgcaaccgatccagtcagcggtacagcagaagcgggttcaaccgtaactgtcagcttccctgatggcacgactgcaactgtaatggcaggcacagatggcagctggtcagtaccaaacccgggtaacctggtggatggcgatacagtcacggcaacagccactgaccctgcaggcaatacgttcattgccaggcacagcacacctgcgctcactggtacagtcaacgatccaaccgcaactgtggttgtgaatgtggatggtgttgattacccggcgacaaacaatggcgatggcacctggacgcttgcagacaatagcttgcctgcgttaacagacggtccacacaccattaccgtgacggcaactgaccctgcagatgatgtgactaccaacgacaccactccagctttaacaggagcaatcaacgatccaacagcaacaatagttgtgaatgttgatggcactgactatccagcagtgaacaatggtgatgtcaccgtaactgcgacagatccgctggaaatattgcaactgatacagcaacactcactattgatactgtaccggcagacctga

SEQ ID NO: 17918 - DNA, 530 bp, Glycine max
  Peptide Sequence Number=SeqID_109603
atgatagaaaaacaaaagtctgtcttagatccttattcctttttaacccctccttctcctactttctattctccattcctaaaccctccagattatttcttttccaaagctagccaatcttggtctttgcccacaacttcagcttataagaaaaaatcagaacctccaaagaaagaatctacaagactaaatatctcttcccaagagtcaactgaatctcctacaagaataggagaaactcaaaagaatgaccctcatgactttcaagattctcaggatccatattcccagttttcgattcaacaaaagctaaaggcctcagaaggatctgatgaaactggaacagaatctgaagaatcttcttcaaaaacacaaaaatcttattctgatgaagaagaagaggttggacacatggacatctcaaacattttgatggctcgctccacagaagaaccattctatgattctcctgtagaagaagaaccagtgttttcaaagagttcatcctccaagccaaatgcaggaccttg

SEQ ID NO: 17919 - DNA, 142 bp, Glycine max
  Peptide Sequence Number=SeqID_109604
gattttcaactttcaccagaattgggtgcaagccattggtctatttgctcaagcgacctgtgctcctgagtttggacttccaagaccattcaatcagagattactcgtcttgcacgttggtggggctgtcgtaagacaatga

SEQ ID NO: 17920 - DNA, 872 bp, Glycine max
  Peptide Sequence Number=SeqID_109605
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgggtcagggaacttttccatctcactatgtgccaggctgtttgctaggcgttgtggtaagcatggacactgaactcatgggactttcaactgctgatgcaactagatcactagatgtgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17921 - DNA, 847 bp, Glycine max
  Peptide Sequence Number=SeqID_109606
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggtccacctctgatgttcactgaagagtaccagaagagtctgccagagcagtaccatctgggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 17922 - DNA, 839 bp, Glycine max
  Peptide Sequence Number=SeqID_109607
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgaatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17923 - DNA, 228 bp, Glycine max
  Peptide Sequence Number=SeqID_109608
atgaaggttattctatggatgaatgctctcctagaacctaagcttttgaatcctagaaaaaccatgaattgttggcagcctaaccccattacaagcctagaaagtgaaaagaggctaagttttgaattgcaaaaagtagtagttgggctaagctcagcagttgggctaagcacatatccatcgctaagcgcaacttcaacgtgcttagcgcaaaggagaatctggtag

SEQ ID NO: 17924 - DNA, 204 bp, Glycine max
  Peptide Sequence Number=SeqID_109609
atgggtgtgttgaagggaacttgcaattcattcaacaaggattccaaaggtggtacacaagctagtcacactacaaagaaggttcttatgggggatagtagaagtgggatctatttcaccatcagggagaactctgagctagagtgttggattccaaatatggagtttggcggagcttggatggcaacaattcacatcaattag

SEQ ID NO: 17925 - DNA, 397 bp, Glycine max
  Peptide Sequence Number=SeqID_109610
ggcccagggatttcccgcattgatcacaggactttgtcagtcgtttagagtccccgtcgcacctagcaagggtgatgcaccacaagccgcagacgcgccgccacctcatcaggctggcccagctgggtcatttgattcagagcagtatttacggcatgtggttcaccagcaggcggccaaccaccgggcgcacgtgcagacccatgactgtctttaccagctgagcctcagcctgcagagccagggttttacttcttttccatgccctactccggatcagttcagggcagaggcaagggaggcacctgcagaggctcccggcgaggcagatgaggcccgcgaggacgaggagatgaccgatttgcttgacttcttgggtgggagcggagccacatga

SEQ ID NO: 17926 - DNA, 207 bp, Glycine max
  Peptide Sequence Number=SeqID_109611
atgctggttcctaagttgtgttctttcttgttgggggtttgtaaaaggagttttgatgataacaaagatgatgacaaaaagttcaaaagtcaagatcacttcatgataacaaagatgatgacattcaagaatgagttcaagattgagtcaagaacacttcaaagatcaagaggaaatttgatttcaagaatcaagattcaagaataa

SEQ ID NO: 17927 - DNA, 290 bp, Glycine max
  Peptide Sequence Number=SeqID_109612
cttggaggggttgatggggacccggtgctgagaggaatgaggagaaggctacgtacgtgcacagtggtacctgcagatatgtcgcgggggtcaggagaccttggggacgtcaggtggggtgctattgcccaaaaccaagcttggccaatcctgacccaacccgggcatagtcagtcagtgagaacctgtgatgtacctaagcaggcgagctcctggcagtcaaccaataaaagaacaaagtccacgaagcaaggaggcttgtgtggcggctggccagctatttatcttgg

SEQ ID NO: 17928 - DNA, 181 bp, Glycine max
  Peptide Sequence Number=SeqID_109613
ggggcctgatgaccttgctgggggtgatagacactctatagaactgacagaggctcgtaatcagagctggaaaccccaggaccctgttggacttcttcgagtccactggggcataaaccagctgacacttcagcagggggagatcggagtggtggtcactgggcagaatgttactaagtag

SEQ ID NO: 17929 - DNA, 884 bp, Glycine max
  Peptide Sequence Number=SeqID_109614
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatctgataggtcaccgtcgccacctcgcccttggccagggtcgcggaccagtttaccgggttgtccgcagcgaccgtgcccttgtccgcagtcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17930 - DNA, 894 bp, Glycine max
  Peptide Sequence Number=SeqID_109615
ttggaacctcttacgtgccgatcacggtctcattttcgccaaaagttggctcagggcttcccggtatcaacagggacaccaggattttatttattctgcgaagtgatcttccgtcacagtggcttctgtttctatcagctgtccctcctgttcagctactggcggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcagaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcg

SEQ ID NO: 17931 - DNA, 459 bp, Glycine max
  Peptide Sequence Number=SeqID_109616
atgtactttagaaggtgcggaagcaaaagtggaaatgatttgagagatgtattggagcacttgatgggactcatattctggttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 17932 - DNA, 174 bp, Glycine max
  Peptide Sequence Number=SeqID_109617
atgcagcagaattttgtgcttgtgcagaaaatgcttatgcatggctggttgtggaaagggttgtatatattcggttacggatattttctagcagatcccaacggtcaaaatcttggagggattgatggggacccggtgttgagaggaacgaggataagggctacatgggagtac

SEQ ID NO: 17933 - DNA, 332 bp, Glycine max
  Peptide Sequence Number=SeqID_109618
atggagtggcagggataccaaggaagcgcttggaggagaaggtggaagctctggccagcattcatcaacgtattagctctactagtgtttgggacaacactattcccgaatgtagacgagttggtggatcttaaggcgatcgacgcctttcttgcttatcaccacagcatggaaagtccgatcatcgctgttttggtagatcagtctgtcccttacaaggttatcgcatgtgctccgaaaagggtaaaacaaattgggaagaactcttgcacacttgatttgaggccgctgtcccttatgatgggcgtgtggggtgctaataccttccccac

SEQ ID NO: 17934 - DNA, 474 bp, Glycine max
  Peptide Sequence Number=SeqID_109619
atgatggtagacaccttgcctgtgttttactatgagaaattagtgggctacatgccctccagcttcgcagacttggtattcgccggggaaaggatcaaagtgggattgaagagagggaagttcaattacgtctcctccataggtaccaactctaggaggatcggagcaactggggcaaaaaggaaggaaggagatacccatgccgtcacttcaacgcctgcatggatcaagccgccgcagatctcccatggtacccaccaatatgcgcaacatcacccgagcttctcagctcgcgctgtagactcctccaactcagcacccgtacaacctagggtgcccgcgcctatccagagggagcccctccccccccccccccccgcgcgcttatccagagggaggccccccaagctctggctccaaccccgattcgcctggctggcaatgcccactttggcgtcggttccaacgcgataa

SEQ ID NO: 17935 - DNA, 297 bp, Glycine max
  Peptide Sequence Number=SeqID_109620
ggtgctaacaccttccccgtgcgtaaatacaactcccgaacctttcacttaaaagttcgtagatcgcgtcttttccggtttttccgatgttttcctcaaataaacgttggtggcgactccgcgcgcattcctttcgtggaacacgcatcccgcgagtcacgcgtcgccctcccgccgaaggtaggttgcgacaagactttttcgcagtctcagccggaagacgctgacatctgcgggaagggtgcaggtgaagacgttagtcacttcttgctattgggctttgagttttacggatag

SEQ ID NO: 17936 - DNA, 927 bp, Glycine max
  Peptide Sequence Number=SeqID_109621
atgaatgcggggcgaaaggtagatttgtatatctccgaaatgggatattcaaactcactgcgtggatttattatgcgtacgattatggtggttgtattaagtgactgcagtgcccttgaatcaaatacacttgaatcattaaagacatcagagcgttgtttagatgaactgctaattgtgaacaacggtggggaaataagcacgattgatcaagacaagattcaggatatggggttgcaggttaagaaagtcaacgttaaaaatttctttgatgtcaggccactcagctggatctataatggcgtgctcaatgagtattatcaatacgatagatttatcttttttagttatgattcttttttagaaggcaactacattggtaacttaatcgactgttatagcgaaggggtcgatttacaaatacctaatatacgtgacagcatctcaaagcagatcatttatccacgtttaaataaagttacaaggaaaatcccggatgggatgaaaattgattcgcagtataatttactgtccatgaattctggactggttatctaccggagtttggtcgaaaaattttctgagtgcaacattgaggtgttcgataatcggtttgctttgtatggtgttgattacaatttttttaaccgcctggaaattttgaaaaaggccaagtataaaatttgtgtgcaagttgtcaataccattgaatcctcagtgccagtgacagacaagcagaatgaactctctcaggaagtggaaagactttatgaccgggtgctatcagggaaatattattcaaagaataagcttgtgatttatttaaggttgttaaagatttcatttcagcaacttatcaggtttagattctcaaatttagaattgatattcagaatttactttgaaggaaagcatccacgttgttga

SEQ ID NO: 17937 - DNA, 375 bp, Glycine max
  Peptide Sequence Number=SeqID_109622
atggatttagccacttttccgctcaatatcttcaccacacagcgcatgtttaatgactatggcgctgacgatatgcgctacggcgatatctgtgaacgccggatgaaaaacgaattcggcctcacccacatttccaatgtgatcgacccgtggaacatgacgcggctgcatcccttccataatccccagtcgcgctttgctggtgcttatgcgaaacctggcgaaaagctttcaccgctggagtgcgccaggctgctgtttgctgagatgcaaaccacttcattacctttcgcgcttgttggcccgcaacgtttcctgataaataagatgctggagcattttatgcgctccagcggcctgccgtttcgggattag

SEQ ID NO: 17938 - DNA, 558 bp, Glycine max
  Peptide Sequence Number=SeqID_109623
atgagtgaaatagaggaggtgcaagagcagatgaagaccgacatggaggccatgaaagagcaaacgaccataatgatggaagccatgatgagtatgaaaaaaataatgaaggtcaatgcagctacagttgttgccgcaagtaccgccacagaagtggacccgactcacccatctagcctcaatcgaataaatcatccagcctcggatatggtaggtcagggaggcaaagagctgggaagtgtgggaagcccccattttgtgaaagttaagaacaagcattccttcccaccatatggattacctcccaactatacaccacccgatgttgcacatgcttttgatgagaatgtcaataactcccctcccatactcattgagagacaacaaacccaatctgatcatgcacatgtctctcaacacataggggggacacatgaagcgcctcgagaccacaatctagttgacttcgaaccccacctcggatatgccactgaggggcaagcattttgcggcatacccctaccaaacactttggaaggacctaagtttcgcccataa

SEQ ID NO: 17939 - DNA, 394 bp, Glycine max
  Peptide Sequence Number=SeqID_109624
ggaatgggaagaatcaaaagaattctcagactgtgtcgttttgaattattcgacaagggagaagggagacacaaaagaattcaggcggttagtccttcgttcttttggaaaagggagaagagatacacaaaaagaattcaggcggttagtccttggcgaattctttttggcaaagggagaagagaatgaaaagatgaatagcactagttttcaaggtttggaaaaccagaaaacttcagaaagcttttggtacaaagaagaagaagaggttcaaagagattcaagtcttgtaaaggattgtaatgaaatgattggaaaagtattcaagatcttgaaatgcaaaacaaagccttgcttttatagactctcatgtctggtcaagaagaccatttag

SEQ ID NO: 17940 - DNA, 237 bp, Glycine max
  Peptide Sequence Number=SeqID_109625
atgttaaggtgttggaccattaacgatctctttgtttttgaaaggagagaaacgttaaggtgttggaccattaacgatctcttggcgtggtcgacaaaagcggggcttttgctcctacgtatcctcaattacgatgaggaaatcagacctgcgtacttcttgcaaaagcgtgtgaacgatcggtttgattttgttttaacagtgattaaacgagattacaacaaaatgatcggttga

SEQ ID NO: 17941 - DNA, 627 bp, Glycine max
  Peptide Sequence Number=SeqID_109626
atggagcttatgtccaagagtgatcaaaggattaagtccttgaaatcaacagtgtcaaaccttgtcactcttatgtctcaaagggctcatggtacaatgccttctcacactaaagcaaatcccaaggaggaattgaatgttctaactacaaggaataagagaccaattgccaagctgaagaagaaggacaaagagcgctctgctatgagtttaaagaagttacctcctaagcttaaggatccagggagtttttcaatcccttgtgtcattggaaacttgtccttttatagagcattgtgtgattttggtgctatcggcacttacttacccggggggaataatggagaattttttggtgaaagggccttgattgatgtcagagaagggaaattgacttcgaggttaggtgatgaggtggaagtgcttataatacttggttcttcacaaagctcttcctcctcctgtaattttgtgcaagctagacctcacccaaggattgttgcgagaaagggacatcagcctattcaaaggtggttgatttatctccttttcgactgccaagcttgggatgttaaacaagtgatatccaagaggcaacctgtgaatgcactggcctttgagttagac

SEQ ID NO: 17942 - DNA, 82 bp, Glycine max
  Peptide Sequence Number=SeqID_109627
atggctccgaaaaaactctccacgaagaggtctagaagggacgccaccggagaaggctctagtaccgcctcagagtttgata

SEQ ID NO: 17943 - DNA, 228 bp, Glycine max
  Peptide Sequence Number=SeqID_109628
atgaaccatttgaatttctcgacaagttccgttgttcaatttcgagatgctcaaattaaactgcgtctgaattcaaacagccataacatccgatgtagaaaagccaataatatatctgagaggctattgaaattgacaatggaagctctcgaaaattcaaatggagcatcatgtttgagatggtcgaaattgagcatggaaactcatggcaaattcaaatggccgtaa

SEQ ID NO: 17944 - DNA, 450 bp, Glycine max
  Peptide Sequence Number=SeqID_109629
atgctggatgaccacaatgtccatgcaaaaagttttagaatggtcatggatagattgtcagatagtcaactagataatttgaaattgagattgatagctggacgtgaaaaggatggtcgtacatacaatctcccaaatgtttatgaagttgttgccctgattgttggtgatttagatgcagactcaataagggatattattgttaaaactcaaaatggagaattacaaagaatccatgaattacactctagctatctaggactgcagtaccctttactcttcccttatggtgaagatggatatagacctgacatacttcaccgttctacatctggcagcaaaaaaaggaagagaaatcgtctaacgatgagagactggtttgcttatagacttcaatccaggtcaaatgaagcacaaactttgttgcattctagaaaactattccaataa

SEQ ID NO: 17945 - DNA, 432 bp, Glycine max
  Peptide Sequence Number=SeqID_109630
atggcagtgcagttgatccatgatcgcgttgtgatggagtgcctagagggtgttcgggaaaccctcgaaggcaatgagaggtgccgattccgtggtacaattcgactcactactacttcattagtacatccggaggaacccgcatgcacacttcagcagcctgtggagtggatactacctacacctactccatatcgactagttgagccggttcatgtgatagaggtgtcatcctctgaagagcatcttgaagaggacccagaggagttacctcctgaacctgctatggacgcccttgacttacctgaggatgatgaagacccactccctgatgtcgattctctagaggatattatgtcagcatctgaggcagactctacagaggagagtggccctggaggggcagcaaatagtgacgactcttcatcatag

SEQ ID NO: 17946 - DNA, 360 bp, Glycine max
  Peptide Sequence Number=SeqID_109631
atggagttgattgaaaacatgtctgccagtgatcacgccattctacatgatagagtgcatcaacccactaagaagagtttaccggagctatcatcacaagacgttgtgttggcacaaaataagtttctctctaggcaacttgagatcttgacagaaaccctgagtaatttgccaactaacttatcaaatggtcaacctttacagccttctattttgttggtcacaagttgtaccatatgtggtggtactcatgaatccgatctttgcattccttttgaagagcaaacacaagaggttagctacttggggaatcaacaaaggcagggatacaatcaaggtggattctcaggtttccagtag

SEQ ID NO: 17947 - DNA, 530 bp, Glycine max
  Peptide Sequence Number=SeqID_109632
atggatgtgctgtgtacggataaaacaggcaccctgacccaggacaatatcatccttgagcatcatctcgacgttggcggcgcggaaagcaatcgagtattaatgctggcgtggctgaatagcagcagccaaagcggagcgcgcaatctgatggacagagccgtgttgcgctatggggaagggcggctggcgccggcggaaaaagagcgtttcgtgaagctcgatgaattgccgttcgattttgtacgccgccgcgtatcggtctcggtggaagacagccgctatggcgataaaagcctgatttgtaaaggggcggttgaagagatgctcgaagccgcgacccatattcgtgagggcgacaagatcgttgaactggacgcgctgcgccgggaactattgctgacgaaaaccgaagattataacgctcagggttttcgggtattgctggtcgctacccgcaagctggatgatgccgcgctaaacgtgccgctcaccgccgctgatgaacaggggctcaccgtcgagggcat

SEQ ID NO: 17948 - DNA, 376 bp, Glycine max
  Peptide Sequence Number=SeqID_109633
acccatgaattcattgcctagcgctgttcatgcatcctccacccacgagtctggagccctgcgaatttattgcctagcgctgagccccgcgaattcattgcctagcgctgttcgccaattctccactcttattcggagacccatgaattcattggctagcgctgttcatgtgtccgcccccaacgagtctggagccccgcgaattcattgcctagcgctgttcgccaattctccattctccactcttattcagagacccatgaattcattggctagcgctgttcatgtgtcctccaccatcgagtctggagcttcgcgaatttattgcctacgctgtttgccaattctccattctcaatctttcggagacccatga

SEQ ID NO: 17949 - DNA, 479 bp, Glycine max
  Peptide Sequence Number=SeqID_109634
aggagtcctctttccaaatgtgaatgggttggtggacctggaagcgatcgacacttttctcgcctatcatgaccgcaaggaaagcccggttgtcgctatactagccgatttatatgacaccttcgaccgaagatgtgagaagagcagtacaaggattgtttgctgtactccggacctctatgtatggattcttatttcgtgcggaggatttccaaatgttcccttgatagggacaaggggttgcatcagttacaatcccattcttgctataagacaacttggctaccctatgagaggggcaccactagaggaagagctcgcacctattattgcacgaggtttctataaaaccaacgtggaggcacttcagaaggtccgcaaggcatgggagatggtgcaaaagaaggacaaagaactcaaaggcagtaacaacgggcccatcggcggctaccgtaagtggttgaaagcccacatgcaag

SEQ ID NO: 17950 - DNA, 408 bp, Glycine max
  Peptide Sequence Number=SeqID_109635
atggctgaacagccccagcccgggattgaacaggaacatccacagcaccgccgcaaccaccggcgctaccgcatagggcagcagcagcagcgtctgatagagctttttcagccggataacgtaatccaccagcgccgccagcagcagcgagaatgtcatgccgcataccgtcaccagcgcgctaaacacgagggtggtccagaacgaatcaaggtagtagtcgtcactgaacaggcggcggaagttatcaaggccaacaaacgtgctggagatgccaaacggatcgatgctttgcagcgagtaccacagcgcctccccggcgggccagagaaaaaagatcgcggtgatcgccagctgcggtgccaccagcagatacggcaacaaacgggcgcggaaaaccggacgtga

SEQ ID NO: 17951 - DNA, 129 bp, Glycine max
  Peptide Sequence Number=SeqID_109636
atggaagctctcgagaaattcaaatggcaagatacaggtaagacgcccaagtggagaaggaagatcaagtctgggaaggacaagcccttccgagtgaaggaagatgaaggcccaagtggagaaggatga

SEQ ID NO: 17952 - DNA, 198 bp, Glycine max
  Peptide Sequence Number=SeqID_109637
gaaaatacaaggatcatgtatgagcaaacaaaaagtatgttgaacgcatatgatgatgcaatgactcatgcaaaatgggaatgtgataacggacaaatgcaggaacgatatgttcattatgatgctgaagagatgtttatgcggggatcaagacagaacccatgtgcgatgcatatgcgaaaggcgcaacacgggaat

SEQ ID NO: 17953 - DNA, 417 bp, Glycine max
  Peptide Sequence Number=SeqID_109638
atgtttatcctcaatgcagagatacacaagcaaatcattaaaggctttggttttgtgtgcaggaaccatcatggaaacactatggttgctgcaacaaagatgcttcaacaatgctattctccaaaaattgtagaggctttgtgtatgaagtgggcccttcaagtggcaaaggatatttctcttcactcttttattttggagacagattacttacaactgcgagaattcgctaagagcaaccttcagtggctaagcgggaggaagaatccagaagaagatgagttgccaggttcactgagcgcactgctccaggtcatcaagcgcaccgcttcagctcattcgctaagtgagagaagcgcgctaagccaaaaattactaatgtgcactaagcggtccatacgtgtgctaagcacatga

SEQ ID NO: 17954 - DNA, 273 bp, Glycine max
  Peptide Sequence Number=SeqID_109639
atggtctttggcacttacttttggctgttgtcgcaacgtgcccttcgcgggcgagcgaaggcgaggctcactggtgcgctttccaaaggaggaaagatgcgcggagtcgccaccgacgtttatttggtgaaaaacgtcggaaaaaaccgaaggaaaccggtcaaaatgaaaattctaagttcgggagttgtatttgcgcttgaggaaggtcgacaaaagcggggcttttgctcctacgtaccctccatcgaagaggaaatcagacctacgtag

SEQ ID NO: 17955 - DNA, 258 bp, Glycine max
  Peptide Sequence Number=SeqID_109640
atgggattcagtgacgtcaccctccaaagaattcccaaccaagaattttggaagaagctagaaatttccccgttcaacttgttatttgagaggtgtaacccctgcaatgtgcacatgttaccaaagaaagatggaatttccccttgcagtttgttaccggtgaggaaaggtcaaggatcagaagagaaggaaagtttgggcagagaggagatgacaaaacaatgttattatcaccaagataaagctcctgaagattaa

SEQ ID NO: 17956 - DNA, 324 bp, Glycine max
  Peptide Sequence Number=SeqID_109641
atgcacacacaaagtttcacaattccacaaattcccaaaataggcctaactcacaaaaatagtccccagtggagtcgccaactgtcgcaacctacccttttgcgggcgagcgaggcgaggctcacgggtgcgtcttccaaaggaggaaaatgcgcggagtcgccaccaacgtttatttgtggaaaacatcggaaaaaccgaaggaaaccggtcatgaagaatattccagattcaggagttgtatttacgtttgaggaaggtcgacaaaagcgaggctcttgctcctacgtacccttcattgaagaggaaatcagacctacgtag

SEQ ID NO: 17957 - DNA, 375 bp, Glycine max
  Peptide Sequence Number=SeqID_109642
atgggttctccacctgcctcctcctctcctcctcctcctccttcggacgcatcggcttcgccgtctaccgtgaagcggacacgcaaagcctcacatctacgatcgttgtccactagaccacttggtgctgacagaccagtggtgcatgttgatcctgctaccgggaaggctgacggtccccacaggaagaaattaagaacatatttggggattgtggcgcgtgataaggtgagtgtcacctacgagaactggaaggaggtccctactgctcagaaggacctgatttgggaggatattcaggcggaatttgatatcccagaggcttctaacagtaggacgaaaaggaagttactgcagaccatgggggagagatga

SEQ ID NO: 17958 - DNA, 375 bp, Glycine max
  Peptide Sequence Number=SeqID_109643
atgaaaagagaaaaacatgcctcctatagtagtcatgactcttgcaagagtttaagtgaagaacttagtgactattatagagggaaccatagttcacatactaaacatcactcccaaataagagaaaaggatagaaggcctcaagaggttaacattagcctcccatatttccatggaaaagataatgttgaggtctacttagattgggaaatgaagggaatgaaggattcatggggatcctctagtagagtattgaatgatcttaagagtgcccttaggaagaggcacattccctcctactatgaaagggagcttatggacaagctccaaaggattagacaagggagtatgagtgttgaagaatatagacaataa

SEQ ID NO: 17959 - DNA, 417 bp, Glycine max
  Peptide Sequence Number=SeqID_109644
atggggctgaccaagcccttcaacggcattccgaccgatatagagatcaggcaggacgacctcacacttccgatccccgcagacgcgacggaggacggatttcggcagcgtcaatcttgccggactggtcagcggctttacggaggagttcttctccttcgacgtcaatcgcgcgcaggcggcgcttttcgggcttgccggcacgtgatgaagctcaccaaggacgaaggcttgatggccaaggcgatcaaggccgctcatcgaccgcagaatcgacatgaccgaggatcagccgcaagcacgcctgacggtctgtcgatcggtgatgctgcgacggcagatcgaagtggcggagcagccgaagcctcaaggttcgctggaggcgatcgagtgcgtatctcagcacgcgctcgatga

SEQ ID NO: 17960 - DNA, 429 bp, Glycine max
  Peptide Sequence Number=SeqID_109645
atggagcccatgaaagagcaaatggccacaatgatggaggccatgatgagcatgaacaagataatggaagccaatgcggttgtagtgcccgctaccagcgctattgctaaggtgaacccgacgcccccatctagcctcaaccaaatgaatcatccatgccgacaacgtcaaactgatcatgcacatgtctctcaaaccatgggggagacacatgaaatttccctccacaatctagccgacttcgagccttgcctcggatatgccactgaagggcaagttgttggtggtatactcctgcaaaacactttggagggccctcaatttcgcccccaaccacaacccttgcattccacaacaggtaaaatccctcctattatggaaggaatgggaaaagttggatcatctagaggaaagcctcagggtcgttga

SEQ ID NO: 17961 - DNA, 167 bp, Glycine max
  Peptide Sequence Number=SeqID_109646
atggcacatcagggacaaaggatcgcgatcccccgaggttcagattgtaggctgcaactcgcctgcatgaagtcggaattgctagtaatcgccggtcagccatacggcggtgaattcattcccgggccttatacacaccgcccgtcacactatgggagctggcaaag

SEQ ID NO: 17962 - DNA, 354 bp, Glycine max
  Peptide Sequence Number=SeqID_109647
atgccggtccagcggccgtataatcccaacgcccgccgcatggctgagatgattcaggccgactgggcaaaagtgggcatcaaagccaacatcgtcagctatgagtggggcgaatacctcaagcgcgttaagggcggtgagcatcaggcagcgctgatgggctggaccaccgccaccggcgatccggataacttcttcgggccattgtacagctgcacctcggcgaacggcggctccaactcgtccaaatggtgctatgcgccgtttgagaaaatcatcaccgaggcgcgcgccgagcaaaatcacgacaagcgcgtggcgttataccgtgaggcgcaggcagatgatgcatga

SEQ ID NO: 17963 - DNA, 984 bp, Glycine max
  Peptide Sequence Number=SeqID_109648
atgaccaaagtgattattgtgtcggcggtagtattcggcttattgattctgctgttcaccgaccgttacctggtgacgatgctggtgaaaccactggatcgcattcgtaaccatttcacggtgattgcgcagggcgatctcagccagccggtggaagaatttggccgcaactgcgtcggcaaactggtgccactgctgcgggcgatgcaggacagcctgcgtgaagcagtcagcgccatccgcagcggcacggagaacatctatcgcggcgcggcagaaatttcagccggcaataacgatctttcatcgcgcaccgaagaacaggcggccgcgctggaacagaccgcggccagcatggagcaactgacctgccacggtgaaattcaacgccgacaacgcacgtcaggccagcgcgctggcggagaccgccaccggcaccgcgcagcagggcggccgtctggttggcgaagtggtgaccaccatgcagggcatttccggcacgaagtgcgcaacctggcgcaacgcagcgccggcgccgcaaaagagatcgccacgctgattgaagattcggtgtcacgcgttgaaaagggctcggagctggtcagcagcgctggcagcaccatggatgacattctgaagtcggtgcaggatgtgaatgagatcatgaagcacatcgctgccgcgtcggaagagcagagcaaagggatttcgcaggtcggtaccgccgtcaccgaaatggacagcgtcacccagcagaacgcgtcgctggtggagcaggtgtcggcggcggccagcgcgctggagcgtcagaccgaagagctgcaggcgtcggtggcgaagttccgtctgtccgacagcgcaccgcgcgcgcaggctgtagcatccgccgctgcgcctgcgactgcgctgcgccggccggtgttatctgccgccgcaggcgctcagggtaaacccgccagcagtgtagagtgggtttcattctga

SEQ ID NO: 17964 - DNA, 342 bp, Glycine max
  Peptide Sequence Number=SeqID_109649
atgaaaaagtcgttattcgtagctgctatcgctgcaatctctctagttgcttgtaaaaaaactgaagctacttctactgaaggtgctgctgattctgctgctgttgctgctactgattctgctgctgttgtagctgattctgctgctcaagttgttgattctgctgctactgctactgtagacgctgctaaaggtgctgctgctgcaactactgctgctgctgctgacgctgctaaaggagctgctgctggagctgctgatgctgctaaaggagctgctgatgctgctaaagatgcaactaaagaagctgctaaagaagttaaagacgctgctaagaaataa

SEQ ID NO: 17965 - DNA, 370 bp, Glycine max
  Peptide Sequence Number=SeqID_109650
atgaacctacccaacctcactctactccagaaaaaagatgatgacaaaaatttaaagagtaagttacctaacaatttctatgcaggtgaatctaaagagaagcaacatatccctcttccattccctccaagaacaatttccgacaaaaaattggaagaggagctgtgcactaataagcgaaagcttaaaggaagtgaaagaattagtatgggcagaaatgtctctgcattgattggtaaatctgttccccaaatccctgaaaaatgtaaagatctaggtcctttgcagtcaactgatgtggtaattcatttagctaatagaagtgttgcctatcctgctggtttcatagaggatgtcttagttagagttg

SEQ ID NO: 17966 - DNA, 711 bp, Glycine max
  Peptide Sequence Number=SeqID_109651
atggccagatcacgtctatggcccagtctaaactcctttagacttgggttccctactcttatcaaagctctatgtaggtccagaggggttgcttctgacagcccgatcttcgaacgcttgagcccgatcattaacttggcctatattaggaagaactgttggaaccatgctgatctgacagttactattagaggggctaggagagcgagggcaaggccagctgaggctccttccacatctgcagctcctcctccagcacgtacctcagcagcttcttctaccccatcttctgcagactttcaacgtcttgaagctatgcttcgaagcatacatcaagggcagatttttttattacaaagtttacagctggtagcacctctagactctattccttctgtagagcagtttaatgagagggatgagtcatccaagacttccactccagagcccttgatcagaaggaagagggtagttgaaacacaagaagttgcagccacttctgagaaatctcttgaggccactcctgagcctacaacaccagtggcagatacaacctcaccacaacaggcagcagacccgtctactcctgaggatcatactacactagccgtgtctccgaacgcctctcctatagctactcctgtggttcattttatggatgaggaggatgttcagatgcagaacactcaagaccaatcacaggacttttaa

SEQ ID NO: 17967 - DNA, 207 bp, Glycine max
  Peptide Sequence Number=SeqID_109652
atgcagcagaattttgtgcttgtgcagaaaatgcttatgcatggctggttgtggaaagggttgtatatattcggttacggatattttctagcagatcccaacggtcaaaatcttggagggattgatggggacccggtgttgagaggaacgaggataacggctacatgggagtacgtgagctcagttgaacgtgggcaactagggatg

SEQ ID NO: 17968 - DNA, 276 bp, Glycine max
  Peptide Sequence Number=SeqID_109653
gtcgactctagaggatccccagtggacccagagaagtccaacagggccctggggtttccagctctgattacgagcctttgtcagttctacgaagtgtctgtcgcccccagcaaggtcatcagcccccctactaaccgagctttcattaagaagtactgcgcccccaggcaggcgcagggcgagacaccacaacagcctagggatggccggcagcaggcaataagggcgtcgccgccacctcttgagttcacctcagctcatccacaaaaaggttag

SEQ ID NO: 17969 - DNA, 261 bp, Glycine max
  Peptide Sequence Number=SeqID_109654
atgcaatggcggtttccaaactcagatgatgcaaaggtcagattagggtttcgttctctactgaaatcgcgaggcaagttggaagattccgcttcggttgaagggttcctctcagtgtggggtttcaacagagaacaaaggtggtttgtggtggctactatgggtgatggagaaagagcttgggactttggaaatggttttggaagaaagaaggagaaggaaatggcgtttttcctgagctacttggactacaaggcttaa

SEQ ID NO: 17970 - DNA, 144 bp, Glycine max
  Peptide Sequence Number=SeqID_109655
tcgagacaagttgactgcggaaatcagccaaggtacatagggacggatgcaagtggggttagggtcatgaccgaccgatcgttgccccttcccggcgctaaacaagcagagaacgtcgctgcaaggcagcccagcatcctttga

SEQ ID NO: 17971 - DNA, 291 bp, Glycine max
  Peptide Sequence Number=SeqID_109656
tgatcttccgtcacaggtgctccagtggcttctgtttatatcagctgtccctcctgttcagctactgacggggtggtgcgtaacggcaaaagcaccgccggacatcagcgctggcaaggcgcgtcccattcgccattcaggctgcgcaactgttgggaagggtcatcggtgcgggcctgttgactattacaccagctggggaaagggggatgtggatagggcgaattggagctccaccgcggtggcggccgctcttgaaataaaggatcccccgggaggcaggcattcgag

SEQ ID NO: 17972 - DNA, 376 bp, Glycine max
  Peptide Sequence Number=SeqID_109657
atgacagaaccatcgaagaagaaaaagggatcatcctccactgccgctgctgctgcccatcgccgccacggaccatccaaagcacccacaacacctattcatccctctttgtcatctccaagatcatccacgttgtttttatcggatgatcagcgtctacggtacctttctcaattttcttctaggatcatcttagaccttaagtacttagacatagatttctttaatgatgaaacgtttgattgctatcaagtgtttcaaaattctggcctggttgatttcatgtcattaaaattgccacattatcctgaacttgtaaaggtcttctactgcaatttaaaaattcaggatggcattatttcctctgaggtgcatg

SEQ ID NO: 17973 - DNA, 552 bp, Glycine max
  Peptide Sequence Number=SeqID_109658
atggctaagtttgacccagatatagtcctggagttttatgccaatgcttggcccacagaagagggagtgcgggacatgcgatcatgggtgaggggtcagtggattcccttcgacgcagatgccctcagccagttcctgggtgacccgttggtgttagaggaaggccaggagtgcaagtttagtcagagaaggaacaaagctgatgggtttgacgaggaggccattgcccaactattatgcataccgggtcaggattttgcccggaccgctgccggaaggcgggtgtggatcatgcacaccagcatgaccatattgacccagatgtggatgacgttgatgctcagcaatgtcctgcccagtatgccacccaccaggcaccctttagacccggataagtctaacagggccctggggtttccagcattgatcacgggtctctgccaatcattcggggttctcgtcacacctagtaaggtgatctggccgccgatcacctgggccttcattgagaagtattgcacgcccaggcaggtgcagggtgatgcaccatag

SEQ ID NO: 17974 - DNA, 567 bp, Glycine max
  Peptide Sequence Number=SeqID_109659
atgacaactctagctcagacatggagcgttctttccttttctaacctcattcctacctcccacacttctgatatcacatttgacagggccaggttgatttatggaatcattcagaagatggatatgaaccagggctatattatttcagctcaagtttctctgatcgcccagcatgactcttctaggcttgggtttccagccttaatcactgctttgtgcaaggccaggggagtcatttctgattcattgacattggagaccctcggtccatctattaatgtggtttatgtaaagaaaaactgttggaacctagatgacctctcaattacatttagaaggccaaggaaggccagtggtaagagatcagaggtccccactactttagcaccaccagagacaccagctccttcttcgtccacagctccagtacctcccattctgactccagttattcctctagcatctgcacagataccacttctagttcctttatctacaggaccatcagactttatatttacacctcagatgtttcattccatgctccagagcatacacatggggtag

SEQ ID NO: 17975 - DNA, 288 bp, Glycine max
  Peptide Sequence Number=SeqID_109660
atggctgttcagtttttggaggagatcagcaatgtgcctattcaaagccaggtcaaggataatatgatatggttgcctgaacctaatggacagtacaccactaggtcagcttatagtttatgtatgaataccaggtcagtaaattctgaagacaagatctttaagacaatttggcagctgcatattccccctcgggcagtcattttctgttggagacttctgaagaatagactccctacgaaggtgtgggtggtggattgccttaacgtgctctatatggcagcatag

SEQ ID NO: 17976 - DNA, 234 bp, Glycine max
  Peptide Sequence Number=SeqID_109661
atgaggatcaaaaggtcttttaaggttgtaatggggccaaggacaaggtacggagaaatatggaataagtggctaaatcccaaaggaatagaggagcaaaggggaataacctttgagaaacaacatttcattcagcatgcttgtagtgagcttcagaacaaggaaagggaaacaaggctcaaaagggctatcaaaggaatatcgaaatttttcaagagcaaaaactatggctag

SEQ ID NO: 17977 - DNA, 314 bp, Glycine max
  Peptide Sequence Number=SeqID_109662
ggattgcgcctacaagacacttagtgggcccggagaagtccaacagggtcctggggtttccagctctgattacgagccttcgtcagttctacggagtgctcatcacccccagcaaggcccgtgaccgacaagtcatcacgcgtccggctcaagacgttaaagaagcgctactaggaggcaacctagaagtggctatgaagaagctccctgcgaagcggtctaggaagggcaccatcgaagaggattccaatgtggccccacaagccgacacaggctttaaaaaataccaattccagagcgtggaacatcaatag

SEQ ID NO: 17978 - DNA, 180 bp, Glycine max
  Peptide Sequence Number=SeqID_109663
atgcagaaggggtccaaaactgaatcaattgatgtagaaatgggagatcaattagaggatatgattcatgatcttggacaagagtcatttgagcaagcacatgcccatgttgacaaaaacttcacttcactacttcaggtggtgcaggatatgcttccagatgaaaacacgttgccataa

SEQ ID NO: 17979 - DNA, 239 bp, Glycine max
  Peptide Sequence Number=SeqID_109664
atgcaaggaagatcttctgcaggtgatttgattcccattgatttggagattaacaccacttgtagatggcgtaatcaagagagaattagaaattttttgcaggacttagaggcagcagcaattccagaggaagaacctcaatcttctgaggcatcttctagttttcatattgcagaacattctcatttagaccctagtgaagactacatcatggctgaagagccacgaagagttaccct

SEQ ID NO: 17980 - DNA, 890 bp, Glycine max
  Peptide Sequence Number=SeqID_109665
atggtagaagtctccatagaggccattgcctcccttgcccagtattatgatcggctgttgaggtgcttcacctttggggacttccagctatcacctatggtagaagaatttgaagagatcctaggatgccctctaaggggaaggaagccatacctcttctcagggttttatccctcattagctagaatttccaagatagtccaaatctcggcgcaagaattagaccacaggaagcaagtcgaaaatggggtggttgaaataccgagaaaatatttggaggcaaaagcaagaatcttggcaggtaaatgcaagtgggccccgttcatagatattctcgcactgttgatcttcggaggagtcctctttccgaatgtggatgggttggtggacctagcagcgatcgatgcttttcttgcctatcataaccacaaggaaagcccggttgtcgctatgctagccgacttatatgacaccttcgaccgaagatgtgaaaagagcaatacaaggattgtttgctgtactccaactctttatgtatgttacaatcccgttcttgctataaggcaacttggttaccccatgagaggggcaccactagaggaagagttcacgcctattattgcacgaggcttcaataagaccaacgtggaggcatttcagcaagtccgcaaggcatgggagatggtgcaaaagaaggacaaagaactcagaggcagtaacaacgggcccattggcgactaccataagtggttaaaagcccacgtgcaaggtttggattggcttccaagtttgagaaccgctaagagaaaggaagttgaggcaccggaggaagacgaagaggtgcaggcccttagggcagaactcgagcaagcccaaacaatcaaagaaag

SEQ ID NO: 17981 - DNA, 231 bp, Glycine max
  Peptide Sequence Number=SeqID_109666
atgggtgccaagtacctcgaagcggtcaagcaaaggttgcatgccatcaaacaatggtccccgaacgaaattacggcaatcaatttgtggggctccggactcgatggtggaggatgcatgaatggaaatcaattcatggggctccgaataagatttgatggtggaggatgcacgaacggcgctaggcaatcaattcgtagggctccggactcgatggtggaggatgcatga

SEQ ID NO: 17982 - DNA, 507 bp, Glycine max
  Peptide Sequence Number=SeqID_109667
atggcaagccttgaacgtcaattcatcattgaggaagcatctctcaaagggccactaggcttcgttggagaagactatccttattggaaggatggaatggaaatgtacatcaagtccacccattatagaatttggcttatcatcactaatggggatattcctattcccaaacctaaagcccggatacacttaaaggtgttggacaactttcccaatgtgtgggaactaaagaccacatgcattcaagaagtaagagatatgaaaaatcttgcatgggatgagctattgggcattctaagagtccatgaagttcacattcaaagcaaggagcatctacaaaagaataatttcgctgccctcaaatttgaagagacatgctttagaagaaaagaaaataagagtttgtgtaaggctcttaaagtactaatgcaagaatctgatggatcaaataactatgatggatccataaatgatgagatgaccctcatgtacaaaaatttcaaataa

SEQ ID NO: 17983 - DNA, 180 bp, Glycine max
  Peptide Sequence Number=SeqID_109668
atgtgtgcacaagaaatggctccgaaaaagctttccgcgaagagatctaggagggacaccgcgactgaagggaccagtgccgcccccgagtttgatagccaccgtttcaagagcgccgagcaccagcagtgcttcgaggccatcaaaggatggtcattccacagagagacagatttttag

SEQ ID NO: 17984 - DNA, 285 bp, Glycine max
  Peptide Sequence Number=SeqID_109669
atgttcctcatattcaacactagtgctttgaaaggacttgatgatactccacaaccgaaatccaaggctgctgctaggtggaatgttgttaagtgtaatatacaaaaaggaatcactgaatgtggctactacgtgatgcactggatgtccacgataatcttaggatctttcaggaataattgggagacgtattttaacgaagttagaccattggaagcagagagattcaaggcactttgcatacagtgggcacagtattatctaaaagttagaaatcaaacatag

SEQ ID NO: 17985 - DNA, 164 bp, Glycine max
  Peptide Sequence Number=SeqID_109670
gggttcccacgaaccctatgagaataaaggtcattcctgagtggctcactacaccaagtgttgagggaggaagcccaaagtttcaagaacctctagatttcaggtcaaatccttttcaaggaggagggaatgatgcaatactaccccccaagggcattggatag

SEQ ID NO: 17986 - DNA, 204 bp, Glycine max
  Peptide Sequence Number=SeqID_109671
atgggtgttaagtacctcgaagaggtcaagcaaaggcgaggatgggcattctcaccctgggtcaaggtttatggtgagttgggattttggctcaaggcttgtagaacggctggacacgatatatgtcagagtgttggtttggccagcggttcagggataaaggtgatgccccacattatttccatgacacacatgcaacaatga

SEQ ID NO: 17987 - DNA, 312 bp, Glycine max
  Peptide Sequence Number=SeqID_109672
atggctgaagtagatgaggtgcaagagtggataaaggccgacatggaggccatgaaagaacagatggccacaatgatggaggccatgattagcatgaagaagataatggagatacgggcggccctcattttgtgcaagtccagaacaaacatgttttctcgccatatggtttgccttcgaactatactccacccaatgagaatgtcaataactccactcctatactcattgagagccaacaacctcaaactgatcatgcatatgtctctcaacccatgggggagacacatgaaatatcccatcgcaatctag

SEQ ID NO: 17988 - DNA, 441 bp, Glycine max
  Peptide Sequence Number=SeqID_109673
atgtcggtggattgccacaaagaagactgtcaagaagatatctatagcgacgtacaggcagcgcctggatcgtctcaggattccagatgtctgctggatgccatatgcggagcactgactggtccaggagtttcatccgattacatgtttctcaggacagctccggtgagggcctgttgttgtcagataaagactggagaggacgataggtgggtgcactactctgaccatctagcgccagcaggtgacatatgtattgtgccagaggcttgccatgccatcgcgaagacgttggagcatcatcccagcctaaatgaagtcatgccaggcacattgacacatgaggtcatccaaaaatgcctcaggattgccaggggtgtcacagaagaccgcaatatgcatgccgggtctcgacgtaggcggcgcacggatcaaccatag

SEQ ID NO: 17989 - DNA, 279 bp, Glycine max
  Peptide Sequence Number=SeqID_109674
atgggattgagtcaggcatttttgcttaaaaaaagattctatcaagtcaaggttaagagcctaggagtcaccagtctgaaagagttagggcagttgatgggtcagctccagcgacaagcttttcataaagcttacggtaagatatgggacctagccgtggcagaggtctccaccgaggccattgcctccctcgcccaatattatgaccagccgttgaggtgcttcacctttggggacttccagttatcacccacggtggaagagtttgaagaaatcctg

SEQ ID NO: 17990 - DNA, 276 bp, Glycine max
  Peptide Sequence Number=SeqID_109675
atggactcatcaaacttcctatttcccgaaggaagctccattaataggcctcctatatttaatggtgtgggatatcattactggaaaactcacatgcaaatcttcatagaggctatagatttaaacattcgggaagccattgaaattggttcttacatccctacaatggttgtaggaaatacaactatggaaaaacctagggaacaatgggatgaagaggaaagaagaagggtacaatataacttaaaggctgaaaatataattacctctatatag

SEQ ID NO: 17991 - DNA, 471 bp, Glycine max
  Peptide Sequence Number=SeqID_109676
atggggacaaatcaaattggcaaaaggttttatcaaatcaagttggtcgctacagacgtccggaaagagtgtgccgggttacgagaagaaaatgcagctactgcaaaagcccttgaacaagaaaccaagagggctcgcaaggaagagcatggcggtgacaaattccgtggagcattttggggtagcaacaatgagctcaagcttcgaagggaagaaaaagaccgatcacgagcacacagcatgaccaacatgttagctatcatcaccactgcccacgagcatagggtggcagacgagtatgcccaagtgtacgcggaaaaggaggctagaggaagggtgatcgactcgttacaccaagaggtaaccatgtggatggaccgatttgctcttaccttgaacgggagtcaagaacttccccgattgctagccgaggccaaagcaatggcagacacctactccgcccccgagtag

SEQ ID NO: 17992 - DNA, 565 bp, Glycine max
  Peptide Sequence Number=SeqID_109677
atacaatccaggttggaggaatcatccaaatctgagatgggcaagtcctccacaacaacaacagcctgtccctccctaccaaaatgctgctggtccaagcaagccatatgttcctcctccaatgcagcgacaacaacagcaacaacaaagacaacaagcaactgaggccccttttcaaccttccttagaggagttagtaaggcaaatgacaatccagaatatgcaatttcagcaagagacaagagcctccattcagagtctgacaaatcagatgaggcagatggctactcagttgaaccaagctcaatcccaaaattctaacaaattgccttcacaaattgtgcagaatccgaaaaatgtgagtgtcatcaccttgaggtctggcaagcaaattgaagtgcctccaccagtagcagcacctgcacctgaacctgtcaagcttcattctacacctgaaaaagaggatgagatagttgcacaaaagagaaagcttcctaatcatgagggagctaacaaaaaatttcatgcaggtggaccttcttctagtaattttgacttgcagtag

SEQ ID NO: 17993 - DNA, 355 bp, Glycine max
  Peptide Sequence Number=SeqID_109678
atgactaggggcaattcaagtaacttacaaccctttgatcctgaaatagatagaacctttcatagattagttaggcatagtgtgcatcctggtcattctgtgcattttgagcatcctaatcactttgagtattctattgctggtgattctgaatattctgattttgagcattcggctgttaattttcagactgagaacatggctcaacctccacctcgtgagaggaatcttagggagatggctgcacctgatttcacttatgaaagcttgtgcattcaatatcttgatgagggtgttccatatgttctcaagactggactaatacatttgctgcccaagtttcatggtcttgcag

SEQ ID NO: 17994 - DNA, 187 bp, Glycine max
  Peptide Sequence Number=SeqID_109679
aacaccggatgatatattaaacttacttcaagccactatgactcctactcaagatgccctgctatattacaatgggaggtggaacatgtcatgccaagatgactttggggttactcgttcacaggaaaaaatcaaaaaagatttgacattcctttgggatgtagcatcgacggactcaaggatgtga

SEQ ID NO: 17995 - DNA, 315 bp, Glycine max
  Peptide Sequence Number=SeqID_109680
atgggggtttactggaaagcgcaccagattgtcaagtatttaaaattaaaacggatgaatctgagtatcgaacattgtgaaagcaatgacttccaagattattttgatgatgccaaagaatcaagagttaagcaagttccaaagaatcaggcttcaagaatcaagtctctaagaatcaagattcaagaacaatcaagtctcaaagattcaagaacaatcaagatcaagattcaagatttaagagaagttgatttcaagattcaagagaagaaatcgagaagcaacagtcaagacttcacaagggaaatggtgtaa

SEQ ID NO: 17996 - DNA, 495 bp, Glycine max
  Peptide Sequence Number=SeqID_109681
atgaagatagacatgaatgtggggtacctcatctcccaccagatctccctcattgctcagcatgacacatccagactaggattcccgaccttaattacaactttatgtaaggctaggggagttcagtctgactcgaggtccctggagagcctgagtcctgccattaatttggcatatattaagaagaattgttggaatcttgatgatccaacaataactttcagaggacccaggaaggccagagggaagagatctgaggccccttctacttcagcaccagagacaggaggtccctcttcttctacacttcctccctcttcctccatagagatcccagtgattcctcctgcacctacacagattccacttccagctctaagccttcagggcttgggcttgccctccattatgagcatggaggagtttgatgcacaggtggcctggacaggagaccagccttcttcctctggagggggtggggcctctacagcctag

SEQ ID NO: 17997 - DNA, 588 bp, Glycine max
  Peptide Sequence Number=SeqID_109682
atgagttcaaaggaggaactcgagagacgccattgggatgagaagctgactggtttctctgatagtagcatagacatcgatattgtgaaggagttttatgccaacctctatgaccccgagtataaatcacctaagcaggtgagggtgagaggtcacttagtgaagtttgatgaggatactttaaacacatttctgaagacccctatagtgttggaggagggggagaacttgtgtacatatttcagatttgcactcctaaggcctgatcctcaggagttggctgctaagctctgtatcccaaggaggggatttgagcttaatgctgatggacaacctttgaagattctgaggaagaacctgaccactctagctcagacatggaaagtccttcggattcattttttgagcttagctcatcactacgctaagcgcagcttcagcgcgcttagcgcgacagaagaatctggcagagcatcaatttcaaggtcgtgcgctaagcgcgagatcaatgcgctaagtgcagcagttgtcttcagacaggctcagcgcacaactggcgctaagctcaaatccacttactcgcgctaa

SEQ ID NO: 17998 - DNA, 1254 bp, Glycine max
  Peptide Sequence Number=SeqID_109683
atgcagtgcagctttgactcgactaagctagcactgcttgctaagccattgtttgaaataaattgctctgggctaaatggcatcaaggaaaaggaagagcactgcttcaaggccacagagttagagaggtgtaacctacataaacgccttgccaaccttcaggagggaagcatagatgtggcggtggttaaagaattctatgccaacttatacagcccggaagaccagagccctaagcaagtgaaggtaagaggacatttaatcaggattgatgttgatcgcctgaataccttcttagagaccccagtagttttggagggtgcgacactgcctacctattccagatttacgaggatgaggattgatcctcaagagttttctacccgtctctacatccctggtaggggttttgttctgaatgcagagggccatccttggaagcttttgaggaaagatctcaccactcttgcacagacatggagtgtcctctcctacagcaacctgactcccacttcccacacctctgatcttaatatggacagagccagaggggccaggaaggtaagagctcgactagcagatgttccttcttcttctgcaccaccagctcctcctacttctgccatgcctacaccagctgcccatgactctcaacgctttgaagccatgcttcagagtattcatcaaggacagattttattactgcagagcctacaggtggtagttcctctagggtccattctatcggtagaacaattcattgagaaggtatcctggcctggaactgtaccttctactgtgagagagggtgagggccctagtgctcaggtacctcaacaggtacatgatgcatcttctaaggctaccatccctggagcttttgattttttaggtgcaggagtaaaaataagacctgatgaggctgtttttcctgagccaattgtagcagttatacatgaaacagttgaagcaggtgagtcacaattgagacaggaggctgctactcctgagaggacaccacagaccctagaagatccactctcaccagggatggggctatcttttgctcggcaagtaacagatcctcctacaccagtacatgagagacaagcagatcctcctacacccatcatggaaatgcttgaagaccctaccacgccagtcctgagactgtcatccactcctccagctaccccagttttacatctgatagatgaggaggatatgcaagaccaggacacacagggcacatag

SEQ ID NO: 17999 - DNA, 504 bp, Glycine max
  Peptide Sequence Number=SeqID_109684
atgaccaaacaacaaagatcaacaaagtgtgatccgtcttactgggagtatattgatgcattacattctgtgcaaaatagtaattcttcaatcaaacgtagtgcatcatcatctgagcaaccaattcaaagaagaaccatgccgatgttggatcaatttcatccatgcattcatgattccattataaacattgttgatgtcaaagcttatggtattggtcttgaagattcatggtcattggtgtgcaaccatttgcttaaagaacttacaaaatggtctgatgagtatatcaacctggttggtggcatagacagatttgaggaattaaagcggtctctacttgttgatggattatccatgatgaatataaccgacatgggatatgtcattgcatcaaggtataatgtgatccttgtttctctttcactccaacaaagcatgacatttatccttaggttgagcaacctttccaacctttcagctattgcttggcaagtctcctag

SEQ ID NO: 18000 - DNA, 613 bp, Glycine max
  Peptide Sequence Number=SeqID_109685
atgaaaagagaaaaacatgcctcctatagtagtcataactcttgcaagagcctaagtgaagaacttcgtgactattatgaaggaaggcataggtcacatcttagacctcactcccataggagagaaaatgaaagaaagcctcaagaggctaacattaacctcccatacttccatgggaaggacaatgtagagacttactcagattgggaaataaggatagagcaaaaacttaaaagaaagtctactagtatgcaagaaaagactagctctataaagtgctttaaatgtcttggaagaggacacattacttctcaatgccccaccaagaaaaccatgattatgaggagccaagacatttatagtagccaagatgaggctactacttcaccttcctctagtgaaattgaagaagcaaaaggggaagaatctagtgaagaaatctacccccaaggagagggacaacctttagtgtttaaggaggagtataaggagaaacttgttagcattgccacacctcttgggcttgagtttattcctcaagtaaaggagttgttggatgagggtttggttcgcaagagcttaaatccttgtgctttgtcggtgcccaaaatag

SEQ ID NO: 18001 - DNA, 342 bp, Glycine max
  Peptide Sequence Number=SeqID_109686
atgaaactggccaaatacaggctaaaggcccaagtggagaaggacaaagcccccgagtggagaaggatgaaggcccaagtggagaaggatgaaggcccagaggcagagacactatcaagactatcaattacttatcaaggtaatccttgtggtgtctacccagacttatcttccttcaccggaagtggcgtctaccctgacttatcttccttcaccggaagtggtgtctaccctgacttatcttccttcaccggaagtggcgtctaccctgacttatcttccttcaccggaagtggcgtcatccaaatctccgtagcctgtatcaaacgatctgccccgtaa

SEQ ID NO: 18002 - DNA, 437 bp, Glycine max
  Peptide Sequence Number=SeqID_109687
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggggagcggaaaatggcttacgaacgggggcggagatttcctgggaagatgccaggaagatacttaacagggaaggcgtttccccctggcggctccctcgtgcgctctcctgttcctgcctttcggtttaccgggggtcattccgctgttatggccgcgttttgtctcattcccccgcctgacactcagtccggg

SEQ ID NO: 18003 - DNA, 651 bp, Glycine max
  Peptide Sequence Number=SeqID_109688
gtcgactctagaggatcccacccaaatgtggatgggttggtggaccgggcagcgattgatgcttttctcgcctttcatgaccgcaaggaaagcccggttgtcgctatcttatccgatctatatgacaccttcgaccgaagatgtgagaagaacagtgcaaggatcatttgttgtacaccagccctctacgtatggttggtttcacaccttttgcgccaagagggagcgtctgttaattggttcccccgatggaaagaaggaagaaccaggattcttatttcgtgcagaggatttccaaatgttcccttgatggggacaatgggttgcattaattacaatcccatcctcaccatgaaacaacttggctaccctatgagaggggcaccattagaggaaggcctcacacctattattgcacgaggtttcaatagcaccaatgcgggggtacttcagaaggttcataaggcatgggagttggtgcaaaagaaggacaaggaacttagaggcagtagcaacgggcccatcggcggctaccaaaggtggttgaaagcctacacacaaggtctcgattggctcccgaatttgagaaccactaaagggatggaggtgaaactccagaagaagacgaagagatacaagccctcaagatag

SEQ ID NO: 18004 - DNA, 354 bp, Glycine max
  Peptide Sequence Number=SeqID_109689
atggagcattttcttgagcaagtagcctggcctgaagctcaacttccattggtgagacccaatgaggctactcctcctgagcccgcaccggcacgggttgaaccaatgccagctgagccacgatctccagtggtgaatccacctccttctcctgagcttgaagtagttcccccatctccatctctgattatcatctctgatgcatcatcggatgaaactactgccctcctgattcaccaactggagaaacagctaatccccctgattccccagttggaggaattgccgatctttctaattcttcatctagagaagtttttactctcactgattccccagtttagacactgttga

SEQ ID NO: 18005 - DNA, 120 bp, Glycine max
  Peptide Sequence Number=SeqID_109690
atgtcttgcaaaaaggataaagacaacttaaccaaacactttgttcacaaagaactacgtaggctgtcgtctcttgtgacagacgcgtggggtgctaataccttccctgtgcgtaaataa

SEQ ID NO: 18006 - DNA, 666 bp, Glycine max
  misc_feature (654)..(654): n is a, c, g, or t
  Peptide Sequence Number=SeqID_109691
atgagatgcggagagtgtacgattactcttcaagacgtctctgtattattaggtctgtcggttgatggggcaccattaattggtcagactaatcttgattggggcgaattgtgtgaagaattgttgggcgtcagaccacaagagggtgaactacaaggcagtgtggaacgctgcacgactttggctccaaagaggactcctcctatactagaaaataaaccactggggcataggtggctgcgacgtggaaaccaacatattggcaatgatgatctaatagttttccgtcgcaaattggatatcatgaaacgacatgagtttctgtgggagccttacacaacaactgttttgttgatgttgcctctcatttgtttggtttgtagtgtggcgtggtgcgcagtggtgccactcatttgtttccatgttgtagagtggcaccaacccgatagagtgttgcgacaatttggaatgcaacaacctatttcggaatctccttcgcaaccacataatatccatgggctaacgctgaaaggcaaacaagatgaaaattggttccagctgttggccccaatgatcagtcagtggaataatcgagctgactttagggtcgacatttatcctcgacaggagggcctattgagttttaactcaganttacatggtctg

SEQ ID NO: 18007 - DNA, 522 bp, Glycine max
  Peptide Sequence Number=SeqID_109692
atgaccggaaggctactttccggatcattggcttttgaaagtcgcatccttcactatctcattgtgcgtattttacttccaagatcttcaaaccttgcacaggcattgcgattaaatgctcctctaccatatcctcatctagtcactcttttccttcaacactttaacatccctcttgattctgaaccttatgttccaatcaagagatactttttaattggtgctgttgtgattgcatcttttggttaccgcaaagagaatgatggctcttgggtaaaaaagggtgttcaacccattgatgatgaaggacacttaccagttggagaggattcctctctccttcacagaattttggacaggttcgatggtcttcaaacctatgttggtgaaaggtttgttgctttggaactacaagtggacatgcgatttgacgagatgggctcaaggatcaccaaggttgaaggagatgtcacttacatctgcacatgctttgatctaccttcaccaccaccatcatcttag

SEQ ID NO: 18008 - DNA, 669 bp, Glycine max
  Peptide Sequence Number=SeqID_109693
atgcccactgggaggaaggaagccatatcttttctctgggttctatccctccacgacaagagttgccaaggtagtgaaaatctcagcacaagagttggaccgtgtaaagcaaaacagaaatggagtagtcggagtaccaaggaagtgtttggaggaaagggcaaaggccttggcaaaatcaaggcgactgggctttcttttattgacatcttggcgcttttgatctttggagttgtcctctttccgaatatggaagggttagtggacctagcaacggtggacgctttcctcgcctttcatcatggcaaggaaagcccggtcgtcgccattttggccatgtatgacacgttcaaccggggatgtaaaaagagcaatgcaaggattgtttgttgtactccagctctctatgtgtggctggtttcgcacctttttctccaagaaggtaggcccgtctatccgctacaaggtcaccgctcgatgtccaaatgttcccttgatggaacaaggggttgtattaattataaccccgtcctcgccataagacagcttggctaccccatgagaggagtgccatcagacgaaagcatcacgcccttcatcgcatggggtttcagtgaccacaacgcgagggtactccaaggagttcgcaaggcatgggatgcggcgtga

SEQ ID NO: 18009 - DNA, 503 bp, Glycine max
  Peptide Sequence Number=SeqID_109694
agactaatgtcgtcttctacgccttttgtcatccagaggcggcgggcccgatgacatgcggagaccaattacggtcatccacacgctcgatgagtgataaacgcgcagagactaatgtcttttgcgccctttgtcattcaaatttcgcaaatcgagtgataaacgcgcagagacaaaatatggtcattctgcgtcctttgtcattcggggacaacaagtcaagaggtgggcggagacaaattatggtcattccgtacaccttttcgccatccagaggtggtcgtgtctggtggcacgcagagacaaattatggtcattctgcgcctagccgcccaggctcgatcgcatccaaagacacgcagagacagattatggtcattatgcgccttgtgtcaaccaggaggaacgaatttgacaacaagtatagagggcaactttcataccctaatttcgtccggggaccatccattgttgggatgcgaccctcgtttgaccacttcgag

SEQ ID NO: 18010 - DNA, 1224 bp, Glycine max
  Peptide Sequence Number=SeqID_109695
atggtcccaactattgaagagtttgaggaaatattaggatgccttcttggggggaggaaaccatatcttttcttcggctttcttccttccttgagcaagattgcggctgtggttggtgattcagcaaaggagttggatcgcacgaagcaaactcggaacgacgtagtgggcttgcctcggaaatacttggaaggtaaggccagggatatggcgagccaagagaagtggggcccgtttgcagatattttagctttgctgatttttggggttgtcctcttcccgaacgtcgacggtttggtagacttagccgccattgatgctttcctcacatatcaccatagcaaggaaagtccagtggtggctatcttggcagatttgtttgacacctttgaccggaggtgtgagaaaaacagtgcgcggattgtctgttgtttacccgctctgtgtgtgtggttgatttcacacctattccatcaagacacgagacacccgtgtccgcttcaaagctatcgctcatgtgccgaaaaaggaagagtcgattgggaccaacatttggctaggataaggggcagcgcgatcaattggtttcctcattggaaggaaggcaaggaaggagttcttttcttgtgtggggactaccctaatattccattgatagggactagggggtgtattaattataatcccgcactcgccataagacaactagggtaccccatgaggggagcgtcaaccgaagaaagtctctcgcctttccttgtgaggaatctgggcgcacaaagtctcaaggcgatacaaagagtccacaaggcgtggagaagtccgttgaggaaagacaaggagcttaggggcatccgtaatggcgtcatcggaggttatcatggatggctaagaattcacacgcaggggttagattggctctccaagttgaaagttatcgatgaggaggacttcgaagctccggaggaagatgaagaagtccgagctctaaaattagagttagggaaggcaagactcgccaaggagaagttcaagtcagctgctacacacatccagaaggagtgcaccgagttacaagaggaaaacgcggccactgcaaaagcacttgaacaagaaaccaaaagggcccgcaaggaggaatatggccaagagaaattccgaggggcattgtggggtagtaacaatgagctcaagctccgaagaaaggagagagatcggtcacgg

SEQ ID NO: 18011 - DNA, 380 bp, Glycine max
  Peptide Sequence Number=SeqID_109696
aacctattacctttagaggactacacgtgctcgccttcagaggactacacgtccttgccaacagagggccgcacgccctcaccttcagagggctacatgtcctcgccatcagaggactacatgtcctcaccttcagagggctacacgtcctcgccttcagaggattacttgtcctcgccttcagaggactacacgtcctcgccatcagagggctgcacgccctcaccttcagaggactacacgtcctcaccttcagagggctacacgccctcaccttgagaggactacacgtcctcgccatcagagggctgcacgccctcaccttgagaggactacacgtcctcgccttcagaggactagacgtcctcaccttcagatga

SEQ ID NO: 18012 - DNA, 231 bp, Glycine max
  misc_feature (224)..(224): n is a, c, g, or t
  Peptide Sequence Number=SeqID_109697
atgtccaaatcttgtggatttgggatgaccggccctctcgatgagtcgatctcttgctttctcataagggtggacccttggaggactacatgtcctcgccatcagaggactacaagtcctcaccttgagaggactacacgtcctcaccatcagagggctgcacgcccttacctccagaggactacatgtcctcgccttgagagggctacacgtcctcaccttgngtactag

SEQ ID NO: 18013 - DNA, 132 bp, Glycine max
  Peptide Sequence Number=SeqID_109698
atggccctcgacgttcacttaatcgaacccactcaaggctaccttgcagcggcgttctccgcttgtcccgagctaggaagggatgacgatctgtcggtcgtgaccctagcctctatttgcatccgtccctaa

SEQ ID NO: 18014 - DNA, 165 bp, Glycine max
  Peptide Sequence Number=SeqID_109699
atggcgggagaagaacatcctagaaggacacttggagactatattgcacatgttgtgcaaaggcacttcatattggaatgtgttattttggctattaaagtctatgtaataataactttctatcatgctcttggatggatagatccagaaatccgtgagaaataa

SEQ ID NO: 18015 - DNA, 585 bp, Glycine max
  Peptide Sequence Number=SeqID_109700
atgacggcgccatggcggttatggcagcatggcacaaatagcattttttttgttttttttccacggttgaatcagaattcagaacgcaaccctcctccaactaaaagcgcaacccctgcacccagccgcgaccccccgcacgcagaatgcagccagcagcaacgaccccacggcgtcctctttcaattggctgaaccatcatctgatgctgctactgcaagtgcaacgaggaaaaataagacagacccaggctggaaatattgtcatccactggtggaaggagaaacaaacataattgtttgtaatttctgtggaaaaatcacaaatggaggaataaccagagccaaacaacacttgattgggaagtcgggtaacattgcagcttgcaagaaaactccaccaaatgtagtcgaagagttgaaggaatatatgactatcaaaaaaagtgggaccactaacactattagaaattatactttcagcatcggttatttagggcattctacattggctctaaaaccgatgttgaaagtgacgatgttgaatgtatcatcgttaacatcgattttcaaaaaccgatgttaa

SEQ ID NO: 18016 - DNA, 692 bp, Glycine max
  Peptide Sequence Number=SeqID_109701
atgccgcccctgctcaatgccatccctaatgtggtcttttttatcaaagatcgtcaggcgcgctatctgctggcgaacctaacgctggcccgccgctgtggtttcaaaagcgtctcctcgctgctgggcaaaacctccgctgatgtctttccttccgcgctgggtcagggttataccgagcaggatcttcgggtgttgcgcgaaggcgtgaccctgcgcgatcagctggaaatgcatctctacaatggccgcgagcgcggctggtgtctgacgcagaaattggcgctacgcgatatcagcgggcaggtgatcggcatggccgggatctcgcacgatctgcaggaggcccacgcccgccatccggcgtggcagcggctggcgatcgtcgacgatcatatccgccgccattatcaccggccgatcgccatggaagagttgaccgccttaagcggaatgtcgattgcgcagatcgaacgctactgcaaacggatctttcatctcactccgcggcaaatgatccacaaagtgcggctggaaaaagctaccgaactgctggctggcgatacgccgattaccgatatcgccctgcagtgcgggtataccgatcacagcgcctttagccgccagttcaaggcgatgaccgcgctcgacgccgcgcgattttcgcctcacgctgctcggataaacgctgg

SEQ ID NO: 18017 - DNA, 267 bp, Glycine max
  Peptide Sequence Number=SeqID_109702
atgtcagcatcttccgaccgacactatgaaaaagtctcatttgctatccgtaagactcaaagcacgatagcaagcagtggctatggtcgtcccctgcaccgttctcggagatcgtcatccgaccaacactacgaaaaagtctcatttgctatccaaaagacacaaagcacgatagcaagcagtggctatggtcgtcccctgcacctttccagagatgtcagcgtcttccgaccgacacagcgaaaaagtctcattcggtatgcataa

SEQ ID NO: 18018 - DNA, 207 bp, Glycine max
  Peptide Sequence Number=SeqID_109703
atgaggacacgtagccctctaaaggtgagggcgtgcaaccctctcaacggtgagggacgtgtagtcctctcaaggcgaggacgtgtagtcctctcaacggtgagggtaactagtacccaagtacccaaggtccacccttatgagaaagcaagagatcgactcatcgagagggccggtcatcccaaatccacaagatttggacattag

SEQ ID NO: 18019 - DNA, 188 bp, Glycine max
  Peptide Sequence Number=SeqID_109704
atgttcatgacccctaggctatccatttcagctattttgggtaaaaaaacacgtttctctgaagaaaaatcgagtcaaagtgcttccgtaacgcttccgagacatttccgtgagcaaatctttgaagatttttctccgttcttcattgttcttcgtccattcttcgttcgttctttgttcttcaaccg

SEQ ID NO: 18020 - DNA, 471 bp, Glycine max
  Peptide Sequence Number=SeqID_109705
atggaaaggaaagataataagcttaggggaagtagcaatggcatcatcggtggttatcaaaagtggttgaagtctaggacgcaagaaataaattgtctcccaaagctaaaaggcctaagtgggaagaaagctgaagtccctgaggaaagcgaagaaatgcaagctttgaaagcggagctcgaaaaaacaagagtggtcaaggagaagctaaagatgacagtcactagggataggaaagagtgtgatgagctgagagatgtcaacatgactatggacgaagcaatcgagcaggaaacaaaaagggcccgaaaggaagaatggagcaggaacaagttccgaggggctctatggggcaacaacaatgagctcaagcttagaaaggatgagagggacgagtcaaggatggaaaccatggtgttagaggataagttgaaggcttatcaaagggtgaagagaagtttgacggaatag

SEQ ID NO: 18021 - DNA, 206 bp, Glycine max
  Peptide Sequence Number=SeqID_109706
cccatgggctcaaaatctaccctaaggctcatgagaaccctagggccttcccttggatctctggcccaatctacttggagtcttctatccaatgcccttgcggggcggcgagcccgatgacatgcggagataccttatggtcatccacgcctttcgtcaaccgagaggaatggattcggcagtatcaggatgactttggtcgtccg

SEQ ID NO: 18022 - DNA, 502 bp, Glycine max
  Peptide Sequence Number=SeqID_109707
atgggtgaagtagaggaggtgcaaaagcagatgaaggccgacatggaggccatgaaagagcaaatggccacaatgatggaggccatgatgagcatgaagaagataatgaaagccaatgcggttgcagttgctgctaccagcgcttttgctaaggtgaacccgatgcccccatctggcctcaaccaaatgaatcatccaacctcagatatggtaggtatggcaggaaaagagttggaaggtccgggcggccctcatttggtgcgagaaaacaagcatgccttcccaccatatggctttcctcccaactatatgccacccaatgtggcgtacactcccaatgagaatgccaataacttcactcctatactcattaagagccaacaacctcaatctgatcatgcacatgtctctcgacccatgggggagacacatgaaatgccccaccacaatctagtcgactttgagcctcgcctcggatatgccactgcaggaaaagcacttg

SEQ ID NO: 18023 - DNA, 363 bp, Glycine max
  Peptide Sequence Number=SeqID_109708
atggagtcaggtgacatgtgggcgtaccttatggttatccgtacctttcgtcaaccaggggcaaacgagcctgttgacgcgcagaggctaacatcgtcttctgcaccttttgtcatcctgacctatggagatgatgttggtcgtttgattctgacaattcttaaaatttttgcaggtttttactctcgtcgtccggagacattcaagcctgatgacgcacaagattcttctctgctgggcggcgggcgattgagttcgatggcatggggaagtgtcgtggttccgctggggcaactatcataccctaatttcgtctggggaccattgtttggtggcatgcaaccttcgcttgaccgccttgag

SEQ ID NO: 18024 - DNA, 270 bp, Glycine max
  Peptide Sequence Number=SeqID_109709
atgtcatgccaaaatgagtttgttggttactcgttcataggaaaaaatcccaaaaagtttgacattccttccagatgtaccatggatgaactgaaggatttgatcaagaaagttgcgcctgctgggattcccccttatggtattcatgaaacacaaatggtgttacttgagtctaactactggaaaaagactgggcctatagaaattttagttgttttcagtaaacctgtaatggaaatggaagacgagttatccttgtcgcaaaattag

SEQ ID NO: 18025 - DNA, 399 bp, Glycine max
  Peptide Sequence Number=SeqID_109710
atggaaaaatctgacaagaagactttcaaggataagaaagaaaagaaagcatatatcacttgcaaagataatgacatggattcatcaagtgattcagaaaacgaaatcataaatctaagcctcatggccaaagactatgaaagcgaagaagaggtcatagtgcatcaacatgttatattagaaagaatgttagtaacattggaaaaatgtggacctgtgacctatggagacaacaacaaaggtaaaaatccttggagttggaaaaataggttaattaggcaagtttgtgaagtgctgattttcatctgctcgctaagccaacctgccagctcaacgagccatccgctgagcgcaacactcctttggctgagcatgaggaagaatctggaagaaggatga

SEQ ID NO: 18026 - DNA, 106 bp, Glycine max
  Peptide Sequence Number=SeqID_109711
ggaattggaaaagaggaatgtgaaaatttgcattgcaagcctacaatccaaatttgaaagagatccaacggttaatgaatccgggattgcggttttagtggaacag

SEQ ID NO: 18027 - DNA, 222 bp, Glycine max
  Peptide Sequence Number=SeqID_109712
atgggttttcctttgtcggcagtcatttaccctgccgaaaatttatctagtcagaaaatcttctattctcttatctgtattctttattcgctctcccttgaggagattctgccgtccttttctccgggggaaaggatgaggattcttttcacgggccaaggttcaaagtatcttaaggttgtgtctcaacatggtctttttatcgtgcaagctcgattttga

SEQ ID NO: 18028 - DNA, 484 bp, Glycine max
  Peptide Sequence Number=SeqID_109713
aatctcacttaattatgcaacgatgcttccatttgatttccgcacctcacaaggaccaaagaaaggtcgcatgtcatcaagcaaaggtccccggacgaaattagggtatgacagactgcacgtgctcgcctttagaggactacatgtcctcgactttagagggctacactttctcgcctctagagggctgcacaccctttccttcagaggattgcaaatcctcgtctttagaggattacatctcctttactttagagggctacacctcctcgccttaagaggaggagtacatgtcctcgactttagagggctacacgtcctcgtcttaagcgggctgcacgttctccccttaagagggctgcacgtcctcgccttaagagggttgcacatcctcgccttcagagggctgcatgccctcacattcaaaggacttcacatcctcgccttcagagcactacatgtccttgactttagagggctacac

SEQ ID NO: 18029 - DNA, 600 bp, Glycine max
  Peptide Sequence Number=SeqID_109714
atggcacgctccgaagaactcctcaaggaggcatttagctctttaaggatcagaacccctcaatcccttccttttcccctcaaattccacgcctccttctccttcaagtcttcgacctcaaccttccgctcctttttcgacgccgaggaggacgaagaagacaatgaagaagaagaccaagatccactgaatgtttcaggcgaatgccgagggagattccgacgagcttgtagatccaccgaaggtggaggacaagatcggtgttgtgcctcatggcctttcaaccgattcaaatgtcgtcaagagttgatctcgaagagatctctccgaagcaacgcggagaagtttgagttccaagcgaaagtgtcgtggctagcttatggattgtgttctgccccaaaaaccctaatcgaaagcccattcagagcctcaagggccatcatgggcaacaataactatatttgtagggtatcattttctagttctgtttgcgggaaaaatttgcaaatggaagaaatgaaggttgcttcaaacttgttggtgggtgaccctgcttcactggagaagaaaattgatgcaattcgtttcggtggtccctag

SEQ ID NO: 18030 - DNA, 156 bp, Glycine max
  Peptide Sequence Number=SeqID_109715
atgacaaaaaaacttgcaggatataacactctattacagcattttctgtccgttggtttcgctgttcctgctgaggattatgatgagaggagaccgtgtgcatgccgatggacctctggcaaggcactgcctgtttccacgcaggcgtctggatag

SEQ ID NO: 18031 - DNA, 546 bp, Glycine max
  misc_feature (538)..(538): n is a, c, g, or t
  Peptide Sequence Number=SeqID_109716
atggctcaacctccacctcgtgagaggactctaagggaaatgactgcacctgatttcacttataaaagcttatgcattcaataccctgatgaggatgtcccatatgttcttaaaactggactgatacacttgttgcccaagtttcatggtcttgcaggactgagtaacaaggagagaagtatgattgatgcaaccagtggaggagcccttggagacatgacccctgctaaagccaggaatttaattgagaagatggtttccaactcccaaggagtgcatgaagtagccacgaattcatcttcatcagctgaaactaagaagcttgaaggtaaactagatgccttggttaacctagtaacccaaccggccttgaatcagaaatctgtacctgtcgcaagagtctgtggtttatgctcctctgccgaccaccatacacacctttgcccttttatgcagcattctggagcaactgagcaacgtaaagcttatgctgcaaatatttacaatagacctcctcaacctcagcagcaaaagcaancacaatag

SEQ ID NO: 18032 - DNA, 486 bp, Glycine max
  Peptide Sequence Number=SeqID_109717
atggcggataccgacggcaacggccgctctgcccagatcatcagccagatactgacgctgctggacggcacggtgaaaagcggcttcgccggcagcgatcggctggcggcattggcctaccgctccgggcaatacccgatggcggcgagcctgctgaaaaacgccggcgacggcggcctggcgtggtggctgcgcgccaaaatggcgctgcgcgacggcgacgtgaaagccgccaccgccgcctacgccaaggcggcaagcgcgttccccgccgacgaaagctggggcgaacagcgtaacgccgactttgtcgcggaaaccatcgtccccgaatgccgggtggccggcgaacaggctatcctggcgctgaaccgcggcgactatctgcaggcgatggacctgctgtatcgcggcaaagcgctctactgggccgacgtggccgacgtggcggagcgcgtgctgaccgtcgatgagttgaaagacttt

SEQ ID NO: 18033 - DNA, 436 bp, Glycine max
  Peptide Sequence Number=SeqID_109718
cccagataagtctaacaaggccctggattttccagcattgatcacgggtctctgtcagtcgttcggggttcccgtcacacctagtaaggtgattcgaccgccgatcacccgagcctttatagagaagcattgcacacctagacaggcgcagggtggtgcatcgcaggccccagatgcaccgccaacacctcatcaggctgatctagctgggtcatttgacacggagccgtatttacgtcatttgagccagggtttcgctccttttctgggccctactcctgcccagttcagggcagaggtcgcatggcccggagattggcctgaggcccaggcaggggaggcacccgcagaggctcccggcgatggagaggaggcccgcatggatgaggagatgacggatttgctcgatttcttgggaggcagcggaaccacctga

SEQ ID NO: 18034 - DNA, 180 bp, Glycine max
  Peptide Sequence Number=SeqID_109719
gcaggtgcagggcaaaacaccacagcagcctagggatggccggcagcgggcaatagacgcaccgccgccacctctagagttcacctctgctcatccacaaaaaggtttgagtattgcctacaccacatggccgaccagcaggctaccaagtccaaagccaaagataagcaaaagtgctag

SEQ ID NO: 18035 - DNA, 297 bp, Glycine max
  Peptide Sequence Number=SeqID_109720
atgtgtagaatctgggatgaagactcccgagacagggcagcatattatcggagtacgggttcaatgaagaacaagaagaatgaatcccaaaatcacggaaaaccatactcgacccctcctaagcattatggtaatcgccctagcaatcagaggactactgctatggggttttctggtggtagtgatagcaaacccactacttcctcaattcaaatagtttgttacaggtgtgatagaagggccatattcagagggattgcccaaatcccaagaaggaatgaaatggtggaggtctga

SEQ ID NO: 18036 - DNA, 135 bp, Glycine max
  Peptide Sequence Number=SeqID_109721
atgaagctcatttggtctccagaatcagccttaaaatcctacatcgacactgttaaatcaggttcagagggagcgtggtgctaccatctgacaagctatttggatagttttgaagagaaagttagttatgattag

SEQ ID NO: 18037 - DNA, 295 bp, Glycine max
  Peptide Sequence Number=SeqID_109722
gttaggtgcggtgaaggtgaaggtgcgtagcggtggtcggcggtggcaaacgagatacgcagagggtgtggtgtttgtcgcggacatggacgaagatgagtggatgtatgaaataatgtctaaacgagcggatatggattatgaaaatgcagaagaagcatgtggtgcgaatgaaccgcatgttgattgttcggatgcgttcaacacttctcagattataatgtgtttgagtgtcgagatgatgttttgcggtgggctcgatccatggctcatgaaaacggatttgtggcggtga

SEQ ID NO: 18038 - DNA, 216 bp, Glycine max
  Peptide Sequence Number=SeqID_109723
atggtggcgactccgcgcatctttcctcctttggaaagggcacccgtaaacctcgcctcgcacgctcgcaaaagggcatgttgcgacagttggcgactccactggggatctttttcacccacgggtttgagtaaaaaggggccctacacccgggttcatgggaatttaaggagtggaggtgaatctatcatcatgctaggtctccgacttgcttga

SEQ ID NO: 18039 - DNA, 1361 bp, Glycine max
  misc_feature (1265)..(1265): n is a, c, g, or t
  misc_feature (1342)..(1342): n is a, c, g, or t
  Peptide Sequence Number=SeqID_109724
atgacaatgcgtaattctcttttgaccgtactgggaagtgttatgttgcttggcgcggcgctgcccgcccattctgaaagcgtgctgcgtgtggggctgggggctgacccggacatgctcgacccgcatctggcgcgcacctactatggccgcttcgtgtttgcctccctgtgcgacaggctggtggacgtggatgaaaatctgaaggtcgtgcctggtctggcgaaagactgggcctggagcgacgacggcaaaaccctgaccctgaatttgcgcgagggcgtcaccttccacgacggtgagaaattcgatgcggccgccgcaaaatacaacctcgaccgcgccctgaccttaaaaggctccctgcgtaaaagcgagatttcctccgtggagtccgttgaggtcacaggcccgatgcagattgccctgcacctgaaaacgccagacgccgcgctgctgatgcagctcaccgaccgcgcgggcgcgatgatggcccccgacgcggcgaaaaagccggattttgccgcccatcccgtctgttccggtccgtataaattcgacagccgcgtgtcccaggaccgcatcgttcttacgcgtttcgacaattactggaacaaagacgcctaccacttcgacaaaattatctatctgccgatcccggatgcctccgtgcgtctggcgaacctgcgcgcgggcgatctcgacctgaccgaagggattgccgccagcgatgtcaaaaccgtcgaagccgacagcaagctggcgctggcaaaagtgaccggtctgggctatcagggcattaccttcaacatcaataacggcaaggtgccagcgaacgatccgttcagggacgcccgcgtgcgtgaggcgttttctcaggccatcgaccgcgatgcgctaaaccaggtggtctttgaagggctgtataccccagccaaccagccgttttcgacggtgagcccgtatcacgtcaacctgccggtgccaccgcgcgatgtcgataaagccaaagcgctgctgaaagcggcaggcgtcaccacgccgctgaccgtcaacctgctggtgccgaacaacccaacctcgcagcaggtcggtcaggtgctgcaggcgatggtcgctgaggcgggctttaacctgaatctgcagatgaccgaattcgccacgctgctggatcgccagcagagcggtgattatcagctgagcttctccggttggtcgggtcgcccggatccggacggcagcatctacgggtttattcacagcanaggcaccctgaacgacggtcgctacagtaacgcccaggtcgatgagtggctgacccaggcgcgtctcagcaacgatnaagccgttcgtcagccgct

SEQ ID NO: 18040 - DNA, 300 bp, Glycine max
  Peptide Sequence Number=SeqID_109725
atgggcccagttttgtcagacctgttgagactcctcgtgggaggatctgcgaaaaaggcacaggccatccagaagcaaaacatcgccccccatgtgttgtctcgtggaggttatgaatatttagaacaaaagctcatggttgagaagacaaagaaaagactagaggaagctgcccaatccggaagcattgagggcatcattgaccctccatctcccatcagacgccacgtgaagtggaagatggctcgcaccaagaaaactgggcagatgacgtctgaggcagcaaaggaaatcacttga

SEQ ID NO: 18041 - DNA, 540 bp, Glycine max
  Peptide Sequence Number=SeqID_109726
caacctgaagcttatgctgcaaacatttataatagacctcctcagcagcaaaaccaacaacagcggaataattatgacctttcaagcaacagatacaatccaggttggaggaatcatccaaatctgagatgggcaagtcctccacaacaacaacagcttgcccctccctaccagaatgatgctggtccaagcaagccatatgttcctcctccaatgcaacaacagcagcaacaacaacaaagacaacaagcaactgaggcccttcctcaaccttccttagaggagttagtaaggcaaatgaccatccagaatatgcaatttcagcaagagacaacaacctccattcagagtataacaaatcagatggggtctggcaaccaaattcaagtgcctccactagtagcagcacctgcacctgaacctgtcaagcttcattctacacctgaaaaagaggatgagatagttgcacaaaagagaaagcttcctaacaaaaattttcatgcaggtggaccttcttctagtaattctgacttaccgtag

SEQ ID NO: 18042 - DNA, 49 bp, Glycine max
  Peptide Sequence Number=SeqID_109727
ggtgaatgctgtgaatattttcccagacgcccaaaatggactcggatga

SEQ ID NO: 18043 - DNA, 774 bp, Glycine max
  Peptide Sequence Number=SeqID_109728
atggatggcgaatgggaaaccgcgcagcttacgccgcttctgcaaatcctggctctcaacggcgaggttcttggccgtctggagaaaggctttcgcctgctcggcaggccgcttgagcggctacgccactggacgcggcgtaactcccgtgcccaggcgcgggaaaatatcgccgcccattacgatctgggcaacaccttttatagccattttctggataaggagctgctttactccagcgcgctgtttaccgcggatgagcaggatcttaccgcggctcagcaggccaaaatggcgcgcctgtgtgaacagctggcgctgagtccgggggatcacctgcttgaaataggcaccggctggggggcaatggcggaatacgccgcccggcattatggctgtcgggtgaccaccaccacgctttcgcaggagcaatacgtctgggcaaccgagcggattgcccgtgcggggctgcaggaccgggtcgaggtgctgctctgcgactatcgcgacctgaccggggagtacgacaagctggtctcaatagagatgattgaggccgtagggcagcgctatctgcccacgttcttccgcacctgtcaggcgcggctgcggccgggaggacggatggcgattcaggccattaccattcaggatcagcgctatcgcgactacagcaaaagcgtcgattttatccagcgctacattttccccggcggttttctgccgagcatcaccgcgatgaacgatctgatgacgcgccacaccgatttcgtg

SEQ ID NO: 18044 - DNA, 1056 bp, Glycine max
  Peptide Sequence Number=SeqID_109729
atgccgaagacccagcaggaaatcttgcgtttgacccgtgatgtacaggcagggcaagagatctacatgcagttgctgaataaacagcaagaactgggcatcaccaaggcaagcacagttggtaacgtacgtatcgtggatcctgccgttacgcagcctcgtccggttaaaccgcaaaaaaccattatcgttctgatagtcacgttgctaggcggtctattctccaccggtttcgttttgcttaaaaccatgctgcatcgtggcatcgaaagtccggaacagttggaacagcaggggatcaacgtttacgcgagtattccgctgtccgaatggcagcaaaagagcgaccgcgagaccatgctgtccggcaagcgcagcagtaacaggagttacaccctacttgccgtgggcaacccggcggacttggcgattgaagccgtcagaagcttgcgtaccagtctgcattttgcctcgctggaagccaaaaataacgttctgatgatttccggtgccagcccaagcatcggtaaaacgtttgtcagcattaacctggcggcggtgatcgcccaggcgggtcagcgcattttggttgttgacgccgatatgcgcaaaggttatgcccactcgttgttgaactgtgaattgggattggggttgtctgacgtgttgtccggccaggcgtcggcgcagcaagcgatcaagcaaacatcgatcgagaatctcagctttatctcgcgcggcaagattcctccgaacccatcggagttgttgatgcacaaccgcctgacagagttcctggaatgggcgggcaaagagtatgacatcgtgttggtcgataccccaccgatcctggcggtaacggatgccgctattgtggcgcgcaatgtcggcacgacgctgttggttgcacgttacggcgtgaactcgctgaaagagattgaggtgagtattcgtcgcttcgaacaaaatggcatggaaattaaaggtattatccttaacgccgttgaaaataaatcgggtagcgcctacggctactacgcttacgaatataaataa

SEQ ID NO: 18045 - DNA, 404 bp, Glycine max
  Peptide Sequence Number=SeqID_109730
ccatccggtatgccgagcttgcggacagcgcggtagctgtgatcgtcagtacccgcggtgtcatcgactactgtttcatgtccgatgccatgaagtcgctgcccaaactggactggattcgcaaaggtacgcccctgccatcaggcacggcgaccgccgcgcttgccgccgacccggaccgcgttgtcgggggcgaccgtgccgtcgatgaagtcgacgtgcgcgattggctcggcggcacgacccgcgccactgtttctgaagaagcgctgggtctgggaagctacggccgcgtgctcaccgtcctcacttcggggaccattggccaggaggatgagtctgacgaagatgccgatgacgaggaagctcttgtcgaaagctggacgccgcgctttcgccggtaa

SEQ ID NO: 18046 - DNA, 87 bp, Glycine max
  Peptide Sequence Number=SeqID_109731
atgcagaagaagcaagaagaatgcagggggaaagtttacaaagcacaggcacaaaagtcactcacacacagggaaggaattgcaaag

SEQ ID NO: 18047 - DNA, 2136 bp, Glycine max
  Peptide Sequence Number=SeqID_109732
atggccctgacagcagcgataaaaagccagattgcgcaatggtataaggcgctgcagcagcaggttcctgactttatcccgcgcgcgccgcagcgccagatgatcgccgaagtggcgaagagtctggccggcgacgacggccgccatctggcgatcgaagcgccgaccggcgtcggcaaaaccttgtcctatctgattcccggcattgcggtcagccgcgccgaagagaaacgtttagtcatcagcaccgccaatgtggcgttgcaggatcagatcttcagcaaagatctgccgctattaaagaaaattattccggacctcaccttcaccgcggcttttggccgcgggcgctatgtctgtccgcgcaatctgaccgcgctggccgcaacggacgatcagcagggcgatctgctgctgtatctcgacgaacaggcggtgaccggttcgaaagaggagcagaaattctgcgcgcggctggagaaagacctcagcagctataagtgggatggcctgcgcgatcacagcgacgtggcgattgacgacagcctgtggcagcgcctttccactgataaagcgaactgcctggcacaccactgtcgctggtatcgcgaatgcccgttctttgtggcgcgacgcgaaatcgagcaggccgatgtggtagtggcgaaccatgcgctggtgatggcggcaatggagaatgagtcggtgctgccgccggccaaacacctgatgctggtgctggatgaagggcaccatctgccggaagtggcgcgtgatgcgctggagatgagcgcggagattacgccgggctggagcagcctgcagctcgatctgtttgtgcggctggtggagaccatcatggcgcagttccggccgaaatccccgccgccgctgagcaatcccgagcgcctgaaaggacactgtgatgagatgcgcgagcagctgcagacgctgtgcaacgcgctcaatcctctgctgccgcgcgacaatcagcctggcgagtttcgctttgtgctcggtgagctgccgccagaactgctgaccctgtgcgcgcggctgtttaagctgagtgatgcgctgcgtggcctgagcgaagggctgctcaacgagctgggcgaacagaccggcaaggccgatatcatgcggctgcacaaagccatcctgcagctcaatcgccacttcggctggtttgaatccatcagcaaactgtggcggctggcggcgatggaaaaagcgtccaacgcgccggtgtcgaaatgggtgacgcgtgaaattcgtgacggccaggcgcatctgctgtttcactgcgccgggattcgcgtcagcgaccagctggaaaagctgctgtggcgcaaaatcccgcacgtggtggtgacctcggctacgctgcgttcgctaaacagctttaatcgcctgcaggagatgtccggcctgaaccaaaaggccggcgaccgctttgtggcactcgactcgccgtttaatcatgtcgatcagggcaagctgatcatcccgcaaatgcgctatgagccgctgctggccaatgaagcggagcacattgctgagatggcgcgcttcttccgccagcaaatgcaggcgcagcagcacaaaggcgtgctggtgctgtttgccagcgggcgtgcaatgcagcagtttgtcagcctggtgccggagctgcgtctgtcgatgctggtgcagggcgatcagccgcgttcacggctggtggagcttcaccggcaacgggtgaccgccggacaaagcagcattctggttggcctgcaatcttttgccgaagggctcgatttgaaaggcgatctgttgtcgcaggtgcacatccataaaattgcttttccgccggtagacagtccggtaattttgaccgaaggggagtggctgaagagcctcaaacgctacccgtttgaagtacaaagtttacccagcgcatcgtttacgctgatccagcaggtcgggcgtctgatccgcagccatcagtgttttggtgaaatcgtcatttacgatcgccggctgctgagcaaaacctacggcagccgcctgctggccgcgctgccggtgtttccgattgaacaaccgccggtgccggaagtggacaaaccggcgaagcgcagcaagaaatcctga

SEQ ID NO: 18048 - DNA, 87 bp, Glycine max
  Peptide Sequence Number=SeqID_109733
atggcgattaatcaaccagcccgccagcaaggtgcccacgggttacagggcttgagaaaggtcttatatctgaatctatctacatga

SEQ ID NO: 18049 - DNA, 639 bp, Glycine max
  Peptide Sequence Number=SeqID_109734
atgggcatggtgctgctggacggcttttacagctggacgctgctgcgcttcaccgcgggcgtaggctgtgcactgatttgggtggtggttgagagtgcactattgtgcagcggtaccgtgcgcaatcgcggtcagctgctggccgcttacatgatcatctactatcttggcaccgttgccggtcagctgctggtgagccgtgtctcgacagaactgctgcacgtcattccctgggtgagcgcgctgatcgtctgtgccgtgctgcccgtggtgtttgtgcaggtcaacgccggtgcggctactgaagaagcctcaaccgggcgtatctggagcatgctgcgccgccgcagttcgcgtttgggtatcaacggctgcattatctccggtatagtgctcggttcgctctacggcctgatgccgctttatctttcgcatcagggtatgagcgatgccaccgtggtggccggtaggccgtcttgccgaccgctttggtcgcctgatggtgctgcgcgtgcaggtgttcgtggtgattctgggtgcgattgctatgctgagcggaacggcaatggcaccggcactgtttgtgctggggctggctggctttacgctttatccggtggcgatgtcctgggcgtgtga

SEQ ID NO: 18050 - DNA, 819 bp, Glycine max
  Peptide Sequence Number=SeqID_109735
atggcaaaagtcgcagaagatgccggtgtctataaagcgacgaaacatcccttaaccaccttctttctggctatcaccgctggcgtctttatttccattgcctttgtgttttatatcaccgccaccaccggcagcggcactatgccgtacggcatggccaaattgatcggcggcatctgcttctcactgggtttaatgctggttgtggtctgcggcgctgatttgtttacttcaacggtgctgattgtggtggctaaagccagcggacgcattacctggctgcaactgggtcgtcactggctcaatgtctacgttggcaacctgtgcggcgcgctgttttttgtggcgctgatttggctggccggtgagcatatggtcgcaaatggtgcctggggattaaatgtcttacagaccgccgaccacaaaatgcatcatacgtttatcgaagcggtaagcctcggtacactggctaacctgatggtgtgtctggctgtgtggatgagctactccggccgcagcctgctcgacaaaatggtggcgatgattttaccggttgcgatgttcgtagccagcggctttgagcacagcatcgccaatatgttcctgatcccgatggccattatgattcgcgattttgccagcccggaattctggcagatgaccggtgccagcgcggcgcaatttcctgcactgggcattggcgattttattgttaataacctgattcccgtgaccatcggcaacatcattggcggcggtctgttagtcgggttgacctattgggttatctatctgcgcgacggtgagtccgcgcactga

SEQ ID NO: 18051 - DNA, 1569 bp, Glycine max
  Peptide Sequence Number=SeqID_109736
atgactgaatcttttgctcaactctttgaagagtccctgaaagaaatcgaaacccgtccgggttccatcgttcgtggcgtcgttgttgctatcgacaaagacgtcgtgctggttgatgcgggtctgaaatctgaatctgctatccctgcagaacagttcaagaacgcagccggcgaactggaaatccaggtgggcgacgaagttgacgttgctctggatgcagtagaagacggcttcggtgaaaccctgctgtcccgtgagaaagctaaacgtcacgaagcttggatcacgctggaaaaagcttacgaagacgctgaaactgttaccggtgttatcaacggcaaagttaaaggtggcttcacagttgagctgaacggtattcgtgcgttcctgccaggttcactggttgacgttcgtccggtccgcgacactctgcacctggaaggcaaagagcttgaattcaaagtaatcaagcttgatcagaagcgtaacaacgtcgtggtttctcgccgcgcggttatcgaatctgaaaacagcgctgagcgcgatcagctgctggaaaacctgcaggaaggcatggaagtcaaaggtatcgttaagaacctcactgactacggcgcattcgttgacctgggtggcgttgacggcctgctgcacatcaccgatatggcgtggaagcgcgttaagcatccaagcgaaatcgtcaacgtgggcgacgaaatcactgttaaagtgctgaagttcgaccgcgagcgtactcgtgtatctctgggcctgaaacagctgggtgaagatccatgggttgctatcgctaagcgttatccggaaggtaccaaactgaccggtcgcgtgaccaacctgactgactacggctgcttcgttgaaatcgaagaaggcgttgaaggcctgcgtcgtcgtatctccctgggtctgaagcagtgcaaatctaacccatggcagcagttcgcagagacccacaacaaaggcgatcgcgttgaaggtaaaatcaagtcaatcactgacttcggtatcttcatcggcctggacggtggcatcgacggtctggttcacctgtctgacatctcctggaacgcgactggcgaagaagccgttcgtgagtacaagaaaggcgacgaaatcgctgccgttgtactgcaggttgacgcagagcgtgagcgtatttctctgggcgtgaagcagctggctgaagatccattcaacaactacatcaccctgaacaagaaaggcgcaatcgtgacgggtaaagtcactgcagttgacgctaaaggtgctacagtagaattagctgacggcgtagaaggttacctgcgcgcttctgaagcttctctggaccgcatcgaagacgccactcaggttctgagcgtaggcgacgacgttgaagcgaaattcaccggcgttgaccgtaagaaccgcgttgtgagcctgtctgttcgtgctaaagaccaggctgacgagaaagaagctatcaacactgttaacaccaaacaggaagatggcaacttctctaacgcaatggctgaagcgttcaaagcggctaaaggcgagtaa

SEQ ID NO: 18052 - DNA, 1452 bp, Glycine max
  Peptide Sequence Number=SeqID_109737
atgatgaagcgcaacattcttgcagtggttatccctgctctgttagctgccggcgcagcaaacgcagcagaaatctataacaaagacggcaacaaactggacctctacggtaaagttgatgcgcgccatcagttctctgatgactcaagctcagacggcgacaaatcttacgttcgtttcggcttcaagggtgaaactcagattaccgaccagctgaccggttacggccagtgggaatacaacgtacaggctaacgtagctgaatcacagggcacttctggttctaaaactcgtgttggcttcgccggtctgaaatttgctgatgcaggctccttcgactacggccgtaactacggcgttctgtacgacgcaatgtcctacactgaccagctgccagtattcggtgacgataccctgtatcaggacaacgacaacttcatggccggtcgttctaacggcctggcgacttaccgtaacagcaacttcttcggtctggttgacggtctggcattcgctgttcagtatcagggcaaaaacgaaggtcgcggtccacgttatgacaacggtgacggctggggtacctctctgtcctatgacactggtatgggcatcagcgcagtgggtgcatacttctcttcagatcgtaccaatcagcagcagctggatggcaacggtgagaaagcagatgcatacggtttcggtctgaaatacgacgccaacaacgtctacctggctgccttctatggtgagtctcgtaacctgactcaatatggcaataacaacgacggcactggcgctaccggccctgacttcaacttcgctgccaacaaagcgcaggctttcgaagtggttgctcagtaccagttcgacttcggtctgcgtccatccatcgcttacctgcagtctaaaggcaaggacctgaacggcgcgactggccacggttcaaccttcgctggcggcgatgctgacctggttaaatatatcgaaatcggtacctactactacttcaacaaaaacatgtccacctacgttgactacaaaatcaacctgctggacgacaacgacttcacccgcgctaccggtacttctaccgacgacgtggttggcgttggcctgcggttggcaagcgttgcgtctgacgttaacctgatagctcattttgctaaagttcacccaaacggaactgactcatatgaaaccggcaaaacgccggtgctgaccagtgtgaaaaaagctgagcagtatctgctggagaacgagaccaccaaaaactacctcagcattgatggtctggctgatttcgcgcgctgcacgcaggaactgctgtttggcaaagagaacgcgctgattagcgctggccgcgcctgcaccgcgcagacgccgggcggtaccggtgcgctgcgcgtcgccgcggatttcctcgctacgcaaaccaacgtcaaacgcgtctgg

SEQ ID NO: 18053 - DNA, 1008 bp, Glycine max
  Peptide Sequence Number=SeqID_109738
atggcacagagcaccgtttctgccggctacgcgcagagcgactatcagggcgttgctaacaaagctaacggcttcaacctgaaataccgctacgaagacggttctaacccactgggttggatcggttctttcacctacaccgaaaaagatcgcactgaagatggcgtgtacaacaaaggtcagtactacggcatcaccggtggtccggcttaccgtctgaacgactgggccagcatctacggcgtagtaggtatcggctacggcaaataccagcagaaccagactgccggtcagtctaaaaccgacagcagcgacgtaggcttctcttacggcgcaggtatgcagttcaacccaatccagaacgttgctctggacgtgggctacgagcagagccgcatccgtaacgtcgacgtgggcacctggattgctggcgtaggaaactcagccgcgccagatcagattcgggcagggctgcgcggcgatttttttgccggtcagtttctcaagcagcatcaggcgcagggcaaaaggcgagcggctaaacagacacaacagcgacttcagctcaaaagccggtttgctttgtacggtctggaagcatttgccgcagtcgaggcagcttttcatcgtgctcatctttacctcctggaaaacggcgccacccacatgccccaggggccgctgaaagatattgaggagcatgtcgaaggatttcgccaggtacgcgaagcgcatcgccgtgagctgattgatgattacgttgagttaatctctgatttaattcgtgaatttggcgaggcgcgccaggtcgatatggcggcacgcttgggcgtttcgcagccgaccgtggccaaaatgctgaagcgtctcagtaccaccggtctggttgagcaggtgccgtatcgcggcgtcccggaaaacccccccgccgggaattccgaagggctcgagcatcacgtcagtgatgaaaccctcgccgtgttccagaaattttacgagaatcgctaa

SEQ ID NO: 18054 - DNA, 2658 bp, Glycine max
  Peptide Sequence Number=SeqID_109739
tgctgctgggcaaacgccgggcgcgctggataacgaactgatgagcagcaaagcgctgccggcgttgccgaagctggtggcggtgggcattccctcgacgctggcgcgtcgtcgtccggatatccgccaggctgaagcgaatctgcatgcgcagaccgccaatatcggcgtatcagtcgcgaacctgttccccagcctgtcgctcaccgggcagctgggcgtgcgtaacaccgatgccagctaccttgacgactggagcagccacttcttcagcgtcggcccggcgctgtcgatcccgatttttcagggcggacgtctggtttccagcgtgaaactggcgcgcgcgcagcaggcgagcgcggcgctcgattatcgccagacggtattgacggcgctgcaggatgtggaaaatgcgctggtcagctaccgcgccgatcagcaacaggttactgcgctggatgagaccactggcgcactgcagcgcgcctttgacctcgccagtgacagttacaaacagggcatctctaccttccttgaggtgctggatgctcagcgtcagctggcacagtcgcaggcgcaatccacccaggcgcgcatgcaaagcgcgctggacctggtagcgctgtataaagcgctgggtggcggctgggagccgtatcagcaggtgacgctgccggactatgacgtttttggaaaggagttggttatgtcccgcgaaacctggatgacgcctaatccggcatcagggccaaacagcagcacgcgcaccgagccttttgtgaaagcgcgtccgcgtcattgcgctgattgccaccctcggtggtttgctgtttggctacgataccggcgtgatctccggcgcactgttattcatgggcgacgatctgcatctcaccccatttaccaccgggctggtgaccagcagtctgctgtttggcgcggcgtttggcgcactggcttccggcactttgccgccgcgggagtttggtctgtaccgcctggtctggtgtttattggcaccgtcagttaccgggcgcgtatcgccggtgacctggctgctgctgtcagaaattttcccgacgcggttacgcggtatttttatgggcggcgcggtatttgcgttgtggatcgccaattttcttatttctctgctgttcccggttctgctggcgtcggcggcgcgatttttgttattcgctgggtaccggaaacacgccatcgttcgctggagcagattgaacattatttgcacgaccggctgtctgatgcgtcggtgccccaggctcgtgaactgccactgagcgatctggaagaaattctggaaaaattaaccgtcgtggtgactgagcgccgcgacgaagttgaagcggaagaagcgcagaaccgcgaaaaagaagagaagctgtctaaataccgtgaaatgctgctggcagacggtatcgacccgaacgaattactgggtgcactggaaaccggtaaaaaacgcgccaagcgtgcgccgcgtccggcgaaatattcttacaccgacgaaaacggtgaagagaaatcatggaccggtcagggccgtaccccagctgcgattaaaaaagcgctggatgcaggtgttctccgccttgcctctgcgtatccgggtgcagaggtggctcatccaggccgcttctggcataatgcccgctgttttttcctccactgcgtaacaaaggtcaatgccgtgttagtttccagcaatatcactatgcagttcggcagtaagccactgtttgagaatatctccgttaaatttggcggcggtaatcgttacggtttaatcggtgcgaacggcagcggtaaatcgaccttcatgaaaatactgggcggcgacctggttccgactaacggaaatgtttccctcgaccccaatgagcgcatcggtaagcttcgccaggatcagtttgctttcgagcaatatagcgtgctggataccgtgattatggggcaccaggaattgtgggcggtgaagcaggagcgcgatcgcatatatgcattgccggaaatgagcgaagaggaaggctataaagtcgccgaccttgaggtcgcctacggtgaaatggacggttacagtgccgaatcacgtgccggagaattattactcggcgtgggcattccggtggagcagcattacggtccgatgagtgaaattgccccaggctggaaattgcgtgtgctgctggcgcaggcattatttgctaacccggatattttgttactcgacgaaccgaccaacaacctggatattgacaccattcgctggctggagcaggtgcttaacgaacgtgacagtaccatgatcatcatttcgcatgaccgtcacttcctgaatatggtgtgtacgcacatggcggatctggattacggtgagctgcgcgtttatcccggcaattatgacgaatatatgacggcggcgacccaggcgcgcgagcgtttattaacggataacgccaagaaaaaagcgcaaattgccgatctgcaatccttcgttagccgctttagcgccaacgcttcaaaatcacggcaggccacttcgcgcgcgaagcagattgataaaatcaaactggatgaagtaaaagcctccagccgtcagaacccgtatatcgtttcgagcaggataaaagctgttcc

SEQ ID NO: 18055 - DNA, 2747 bp, Glycine max
  Peptide Sequence Number=SeqID_109740
tactcgatgaagctaaacgtctggtagaagcgggcgtaaaagagctgctggtgatctcgcaggacacctccgcgtacggcgtcgatgttaaacaccgcaccggtttctggaacggttcgccggtaaaaaccagcatggtcagcctgtgtgagcaactggcgaaactcggcgtctgggtgcgtctgcactacgtttatccgtatccgcacgtggatgacgtgatcccgctgatggccgaaggcaaaatcctgccttacctcgatattccactgcagcacgccagcccgcgcatcctgaagctgatgaagcgtccgggcgcggttgagcgcacgctggagcgcatcaaacgctggcgtgaaatctgtccggagctgacgctgcgttccaccttcatcgtgggtttcccgggcgaaaccgaagaagatttccagatgctgctcgacttcctgcgtgaagcgcgcctcgatcgcgttggctgcttccagtacagcccggttgaaggcgccacggctaaccagctgccggatcaggttccggacgacgtcaagcaggcgcgttttgatcgcttcatgcagttgcagcagcagatctccgcagagcgtctgcaggagaaaatcggtcgcgagattctggtgatcattgatgaagtggatgaagaaggcgcggtcggccgcagcatggccgacgccccggaaatcgacggtgcggtctatctgaatggcgatcgccaggtgaaggtcggcgaggtggtgcggataatcgttatcggcgcgcagccggtcccagcacgctttgaatacggccgccgcagcggccttttctttttctaccgtccgcggcagctctttgccgtcagcaccgtatttccgtccgccctgatgattgctgtagcggcgcgcgcgggtctcgacggtgcgaaagcgccagtgcggcagaatttcgcttttataaggttccaccatcagcaccccctgctcgccgcgtccgacctgatacagctccggatgctgacggaagtcgagctgtttaaaatcctgctggtaattgaagggtttcatcccctggcctcctatgctcacatgttcaacaagatgaaaattgtgaccgccattgtggttattctggtggtattcacagccatgcaggccatatccggctcgctctttttctcctcgctgcgcgcgggacaacataatttcaccgccagcaatcagttgtctcatcagcagcgcgagctgggcgacggctggcaaacgctggtgaaaacccgcgtcaccatcaaccgcgtggcgatccgtattctgaaaaatcagactgacgagcagtcgctggcggcgatcaacaagctgctgctggcagccggtgcctcgctggaagcggcgcagcagcacttcaatcagtatagaagctatccgcgcatcgacggccagagtgcgtcgaccgccgatctgatcgacaaaaaattcaaagcgtttgccgcgctgctgcagcagtccgccgtgtttctgaaagccaataactacgcggcatacggcaacctcgatgcgcagcaggcgcaggatgaactggaacaggcttatcagcagtggcgcgatgaaaacatgcagctgatcaatcagcgcagcctgcaaaatgacagcaactatcagcaggtgctgatcatgattgccgtcatcgcactggtggtggtgctgatggtggcggcggtatggacgctggtgcgccgcgtgctgctggcaccgatgcagcaggtgcagcagcagatcgagcgctttgccgaaggcgatttgtcagccagcctgcaggtggcaggccgcagtgaaatggcggccattgccgccagcctgaatcatatgcagcaggcgctgctcggtaccatcaacaacgtgcgcgacagcgcggatgccatttttggcagcgccagcgccatcgccaacggtaataacgatctctcggcgcggaccgaacagcaggctgcttcactggaagagaccgccgccagtatggaacagctgaccgcgaccgtgaagcagaacgctgacaacgcgcgtcaggctacgcagctggcgaaaaccgcgtcggacaccgccgataaaggcggtaacgtggtggaaggcgtggtgaaaaccatgcgcgacattgcggacagctcgaagaaaatcgccgacattaccagcgtcatcgacggtatcgctttccagaccaacattctggcgcttaacgccgcggtagaagcggcgcgtgccggcgagcaggggcgtggctttgcagtggtggcgggcgaagtgcgcaacctggcccagcgcagcgcgcaggcggcgaaagagatcaaattgctgattgaaaactccgtgcagcgcgtggacctcggttcgcagcaggtcagcagcgctggcgataccatgcaggagattgtcagcgcggtgacgcgcgtcaccgatatcatgggtgagattgcctcggcttccgatgagcagagccgcggtattgaccagattggccaggcggtgaatgagatggatcgcgtgacgcagcagaacgccacgctggtgcaggaatcggccagcgcctcggcgtcgctggagcagcaggccagccgattgtcatcggcggtggcacgtttcaacaccggcgcgcgcgcgcccgctgcggtaaccgagcggatggtgaaaccggtggtgcccgccccggcccgcgctctgcccgcggcggtgagccacggtaacgataactgggaaacgttttga

SEQ ID NO: 18056 - DNA, 984 bp, Glycine max
  Peptide Sequence Number=SeqID_109741
atgatgaccagctacgtggtcggccaggcgctgaaatccggcaaaatcaccagtaacgacatggtgaccatcggccaggatgcctgggccaccggcaatccgaaactgcgcgggtcgtcgctgatgttcctcaagccgggcgaccgcatcccggtctcggaactgaataagggcgtggtgatccagtcggggaatgatgcctgtatcgcgctggcggactatgtcgccggcagtcaggatgcctttattggcctgatgaacaattacgttaaagcctttggcctgcaaaacacccacttcatgacggtgcacggtctggacgccgaaggccagtacagcaccgcacgcgatatggcgattatcggccagcgcctgattgctgatgtgccggaagagtatgcgctgaacagcgaaaaagaatttacctttaataatatcaaacagatgaaccgcaaccggctgctgtggagcagcaacctcaaggttgacggcatcaaaaccgggcatacctcgggggcgggcaataatctggttgcttcagcggtggacggcgatatgcgcctgatttcggtggtactgggcgcgcagaccgatgccattcgcttccgcgagagtgagaagctgctgacgtggggcttccgtttctatgaaaccgttacgccgattaaagcggataaaccgtttgcccagcagcgcgtgtggtttggcgaaaacagccaggtcaacctcggcgtggcgaaggatgcggcgatcactatcccgaaagggcagatgaaaaatctcaaggccagctttaccctcaacgcaccgcagctggaagcgccgctgaaaaagaaccaggtagtgggcactatcgatttccagctggatggcaaaaccattgagcagcgtccgctggtagcgatggaggatgtaccggaagccggctttattgttaatctcaggacggcgggtcaacccgtggctaacccgcctgccggctga

SEQ ID NO: 18057 - DNA, 2283 bp, Glycine max
  Peptide Sequence Number=SeqID_109742
ttcgagatgctcggcagctatccgctcaacgagtcagtggccattacccgcgcacgcgacaagctgcgctcgctgcagttgctggcgcgcgaaggcatcgacatgccggttaccggctttgcctcgtcgccggatgatacgcaggatgtgatcgccatggtcggcggcgcgccgctggtggtgaaactggtagaggggacgcaggggatcggcgtggtgctggcggaaacccgccaggcggcagagagcgtgatcgatgcgtttcgcggtctcaatgcgcatattctggtgcaggagttcattaaagaggcgcgcgggcgcgacatccgctgcctggtgattggtgacgaagtggtggcggcgattgagcgggaagcgaaagagggcgatttccgctctaatctgcaccgcggcggcagcgcccgcgccgtcaccattaccgatcaggagcgcgagatcgcggtcaaagcggccacgacactgggattagccgtggcgggtgtggatattctgcgcgccaaccggggtccgctggtgatggaggtcaatgcttctccggggctggagggcatcgaaggcagcaccggtttagacattgccgccatgatgatccgctggattgagcagcacgcctgtcccggcgcttatttattcaccccacaggatacaacgatggattcactggtcgttcctgacatcgacatgctgcgtcgctggctggatcaacaaaatatcacctggttcgaatgcgatgcctgccaggctttgcatctgccgcatatgcagaattttgacggggtgtttgacgcgaaaatcgacctggtggataacgttatcctcttctcggcgctggcagaagtaaagcccaccgcgctgatcccgctggttggtgaactgtcgcaaatcaatgccagttcgctgacggtgaaagcctttatcgatatacaggatgacaacctgccgaagctgattgtctgccagtcaatcagcgtaagcgccggcatcaccttgggtcagttcacccacttcatgaagcagagcgaagaggggatttcgatggtgatcatggaagcgttcgccaatcatctgctgatgatgggcgaagacgaggagcgaatcaggggggctattcttgcggggctgtctgatacgtgcaactacggcgcagctataggtgtgctgatggctgcggccgtgggcgctcaggcagaggataaaacgctgcacgtttataactggtccgattatatttcggccgacaccgtgcccaattttgaaaagcagaccggcatcaaagtggtctacgacgtgtttgactccaacgaagtgctggaaggcaaactgatggccggcagcaccggctatgacgtggtggtaccgtcgtcgagcttcctcgcgcgtcagctgcagtctggtgtgttccaagagctggataagagcaagctgcctaactataaaaacctcgatcccgatctgatggcgaaagtggcccagcacgatccgggtaacaaatacgccattccttacctgtggggcaccaccggtattggctataacatcgataaagtcaaagcggcactgggcgccgatgcgccggtgaacagctgggatctggtgctgaagccggaaaacctggaaaaactgaagagctgcggcgtttcgttcctcgatgcgccagaagagatttttgccaccgtgctgaactacctcggcaaagatccgaacagctctgacgcgaaagattacaccggtgcggcgaccgatctgctgctgaagctgcggccgaatatccgctacttccactcttcgcagtacatcaatgacctcgccaacggcaacatttgcgtcgccatcggctggtctggcgatattctgcaggcgaaagatcgcgcggtgaaagccaacaacggtgtccatctcggttacagcgtaccgaaagagggcgcgctggcgttcttcgacatgatggccattccaaaagacgcgaaaaatctggatgcggcttatcagtggctgaactacatcatggatccgaaagtgattgccgacgtctccaacaagatgaactacgccaacggcaacaaagcgtcgctgccgctgatcaatgcggatgtgcgcaacaatccgggtatcttcccgacgccggaagcgatggccaaactgtttgtgctcaaggtccaggatccgaaactggatcgtgcgcgtacccgtgcatggactaaagtaaaaagtgcggctggctgtgccgcgctatcccgcttagcgccggagacatgtgagtga

SEQ ID NO: 18058 - DNA, 328 bp, Glycine max
  Peptide Sequence Number=SeqID_109743
gtcgactctagaggatcccacccctacaatgctcaatggaatgccccggggcttctccatgacaagcacacattgcgttcgagtcgtattctcggagaaatggaggttgatgaaccttggttggggttatggctaccattgaattatcaagtaggcatgggagcaagtgatgttcgtcattggaagtgcgatagacagactttgtggttgattttagggatggcctttgtggataactgggcggtgggtaaggagaagacccacatcgatcctttcactggcaaagaccagatccgcaaagctttgaaggtgccacttaagctgccag

SEQ ID NO: 18059 - DNA, 204 bp, Glycine max
  Peptide Sequence Number=SeqID_109744
atgggtgaccaagaggagatacaggaacagatgaaagccgacatgtcggctttgaaagagcaaatggcttccatgatggatgccatgttaggaatgagacaactcatggaggataacgtggccaccgctgccgctaaggaaaattatcactatagagtcctgaatggccagttcacaactctattcgaattcatttctttctaa

SEQ ID NO: 18060 - DNA, 198 bp, Glycine max
  Peptide Sequence Number=SeqID_109745
atggctaagtttgacccagatatagtcctggagttttatgctaatgcttggcccacggaagagggatggattccctttgacgcagatgccctcagccagttcctgggtgacccgctagtgttagaggaaggccaggagtgcgagtttagtcagaggaggaacagggccgatgggttcgacaaagaggccattgcctag

SEQ ID NO: 18061 - DNA, 561 bp, Glycine max
  Peptide Sequence Number=SeqID_109746
atggcatcgttcaaccagatgcagtcccagtttcaatcccagatgcaatctcagggacttgcactgcctccggagcctttggttggtccctcaggtcctcgagtaagcacaaaggagagttatgttgatccctcaagaaacgatcctgagacgggtgactcagagaggtgcggcttgtacatcgaagcaaattctgactgcctagttgccctgggaagagtttatgagggatccactgttgttcataacactcgtttgttacctggcaaagtaaaggcaattcacactttctttgcttggccgacacatctggtcaagcctttatcacagcaggcagttgtgcctctggcaaaaccacctgaaaagccggatctggaggtcgatgatccactttatctgatgacattgaccatcccagagcttttcttgaggccttaccaggttacatgggatgctgccgtgttcaaggtctttaatccagacttcctactctacataaagcacgaagacctcttcgaaatcgcacacggtggtcaatgtctttttttatcagtgttatag

SEQ ID NO: 18062 - DNA, 126 bp, Glycine max
  Peptide Sequence Number=SeqID_109747
ggacaggcatacatccccatagttaggttgatgcaatcctaccccccaagggcattggatagaagactccaagaagattgggccaaagatgcaagagaaggccctaaggttctcatgagccttaag

SEQ ID NO: 18063 - DNA, 387 bp, Glycine max
  Peptide Sequence Number=SeqID_109748
atggcaagtctgatgacacgtggagaccaatatggtcatctgcaccctttgtcgaagactcgatgtctatcaaccgagactactttagtctcccttcatcatccagagacggtaagtccgatgacacgtagagaccaatatggtaatctgctccctttgtctaagactcgatgtctatcaaccgagactactttagtctcccttcatcatccagagacggcaagtttgatgacacgtagagaccaatatggtcatctgctccttttgtcgaagactcgatgtctatcgaccgagactactttagtctcccttcgtcatccagagacggcaagtccaatgactcgcagagaccaatatggtcatctgttccctttgtcgaagacttga

SEQ ID NO: 18064 - DNA, 167 bp, Glycine max
  Peptide Sequence Number=SeqID_109749
atgtggataccgtatcgacgaggcgggtcgttacatttagtggtatcagagcagggagtgttggctggacggaatgatcgtgcgatagctgatgcccttcaagccttagctcaggctatagggaatccgaataggggagaagctggtggagttgttgagtaccaggg

SEQ ID NO: 18065 - DNA, 63 bp, Glycine max
  Peptide Sequence Number=SeqID_109750
gattgggctagagctgctaaagagggtcctagggttctcatgaacctcagggtagacttctga

SEQ ID NO: 18066 - DNA, 294 bp, Glycine max
  Peptide Sequence Number=SeqID_109751
atgagtgataaatgtgcaggggacaaaattctcgcccctttccatttcaggagtagcgagttgagtgagacagattctgtgccctttatcattcaggaacaacaagctgagtgggtaaacacgcagagacagattctgcaccctttatcattcaggaacaacaagttgggtggtaaacgcgcagagacagattttgtgccctttatcattcaggaacaacaagctgagtgggtaaacgcgcagagacagattctgcgccctttatcattcaggaatagcaagctgagtgggtaa

SEQ ID NO: 18067 - DNA, 420 bp, Glycine max
  Peptide Sequence Number=SeqID_109752
atggcagaaccatcgaagaagagaaagggatcatcctccaccgccgctgctattgcccatcgccgccacgaaccatccggagcacccacagcacctattcatccctctttgtcatctccaagatcatccactttgttttcatccgatgatcagcgtctacgtcaaggtacaccttttgagggcaccattgttgatgactggaaatttgattattctagtcatgatgctcgccgtatggtctgcaatgaccaggctgaaatgatcggtagattgctgaccgggccattgacatttgataatcgcatcaagcactatataattgttagaatttttcttccccggtcttcaaatttggcacaagcctctgaggaggatttgattctgatgtgggctttccttaccggttgtcagatcgactag

SEQ ID NO: 18068 - DNA, 129 bp, Glycine max
  Peptide Sequence Number=SeqID_109753
atggttcccgcacgtcattgggcctgccgcctctggatgacaaaaggtgcagaagacgacggtcagtatgacagagattgtggggcggccgacaaaagcgaggctcttgctcctacgtaccctcaatga

SEQ ID NO: 18069 - DNA, 99 bp, Glycine max
  Peptide Sequence Number=SeqID_109754
atgaggaatggcctgagaatagtgataagaaaagagaaggagatcaaccttctaaccaaggactataagagtgatgagaatatctctcaagaagattaa

SEQ ID NO: 18070 - DNA, 400 bp, Glycine max
  Peptide Sequence Number=SeqID_109755
gtcgacatctagaggatcccacttacgtgccaatgcacctcttccatatcctcaattggtcaccctctttgtccgtcattttcaaatttctcttgatgatgaaccttttgttcaagtcaagcgttcctttgctataggtgctggtgctgtcacttcatttggttaccgtaaggatcacaatggtcaatggctgaagaaagatgcactccctccacaagacaagcatactccttctcctcctcctcagcgagatgattcagcccttatgactgaagttctttcagagttacggggtcttcgcacttatgtaggaatggatatccgtctcatgcagcttgaagaggatgtgggttatattcatcagagcttcgatcttccaccaccaccaccaccctcttag

SEQ ID NO: 18071 - DNA, 255 bp, Glycine max
  Peptide Sequence Number=SeqID_109756
atgaaaataaaggaaataacagaagaaaggaaagaaggattcccgatcaaagatcgaaaagaagtgaaaaaggaaaagaagcaattctcgatcaatgaaggaaagagggcgaaaattcttcaagccagattgccactcaaaatcatttttctactggcaatattccaccccacatggacaaagaggaaaagaccgaaacacccaacatcctctccaaaaacactaccctcaagaaattcctattggtccgtgatc

SEQ ID NO: 18072 - DNA, 310 bp, Glycine max
  Peptide Sequence Number=SeqID_109757
gcatctcactgatacaagtatgcgagcggggaattctgatatctatggattccttgagccacagtccattcagaggtctgggcaatcgcagtttgagtctgaaagttacataaagacttggatgcagagttcaaaatgcgatgtctatcttggagcctacctaaatgggccagaaaactaccataaggggattattaacagcctaaatcaaaggctcctgctaggtggattgtcgtcaagtgtaataaacaaaaaggaagtactgagtgcggctactatgtcatgcactggatgtccaccatcattttag

SEQ ID NO: 18073 - DNA, 798 bp, Glycine max
  Peptide Sequence Number=SeqID_109758
atgaagatagtgagttacaacgtgaacggtctgagacagcgcatagcgcagttcgggtctctccggaacctgctaaattcattcgacgccgacatcatttgttttcaggagacgaaactgcggaggcaggaagtcacagcggatttggtcatggctgacggatacgaatcgttcttttcatgcacccgcacctcccagaagggccgaaccggctattccggtgtcattacattttgtcgtgtaaagtctgcattttcgagtaatgaagtggtgttgccgctggcagcagaggaagggtttactggtcttttgggaaactctcaaactagcaacgacaaattgccattcttgatggaagatcttgaggaattttcaaaagatgagcttctaagtcttgatagtgaggggcgctgcataatcacagatcacactcactttggtgagtattctctgtatatgccttttatttgcccaagagaggaggggggggggggggggggggctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 18074 - DNA, 1188 bp, Glycine max
  Peptide Sequence Number=SeqID_109759
atggcggcagatgaagatatgtctttgaagtctaatctgagtcaatcaaatgaaacttggaagcaggagatggaaagaagtcaatctcaagtggatgtattgcaggcaaggataatggaggtaaaggcacaaatacaaggctcaaaggaagatgcaaaaaaggagttagaggttctatggagaagagtcaagactacttctaccctgttgacctacttaaaatcaaaatctagaatcatggctgttcctcatctagcccacacttcttgtggcataaaaaagttagatggggtagggcttgttgacaaagatgggattccattatcaggttggtctaggaatgttgatctttcttcatttgatgatccagatgaagaatcttggataggaattaaccgtcagcatggttccttagacgaacaggatgcagtttatataggtgagatactgaagtctgttcagatggtcacggatgtgatggaatcccttgtcaaaagggttttattggcagaatcagaaactactattgagaaggaaaaagtgattttaggtcaggaagaaattatgcaaaagtctgctcagttagagaatatgtccatgaaattagaggagatggagcgctttgctttgggtacaaatggtattttgaatgacatgcggcaaagagttgcagatttggttgaagaaacaactagacagagacagcgtgctgctgaaaatgaagaagagctttctagagtgaaacgggaatttgagtctctgaagtcatatgttagtagtctaatcacagtaagagaaaccttactgtcttcagagaagcaattccaaactattgagaagctgtttgaacggctagttggaaagactacccaattggagggtgagaaaatgcagaaagaggctgaagttcagaaacttatggaagagaatgtgaggttgagtgctctgcttgacaagaaagaggctcaacttctagcattgaatgaacaatgtaaaatgatggccttgagtgcttcaaacatgatttcggacgacaagagtaacatggcatcacctcccctctctcttgttgctggatttgtttgcaaggtcgcttttgcggcttatatctttggatctgtgagcatgaaatacggaaggagtgaaaggaacaaagatgagctaagcttcaaccatcttgagtcttag

SEQ ID NO: 18075 - DNA, 1974 bp, Glycine max
  Peptide Sequence Number=SeqID_109760
atggaggtggaggtgccaatctcgcttgattcgaataatcaacttcagccagagactgtagtttcagttcaaattggggatcctggtgtttccttatctgttgcaaatgctgttaacccgcagcaacaagctacaaaaaaaccgaccaggcagtgggctgcgtggactcgacaagaggaggaaagtttcttcaccgcgttacgacaagttgggaagaattttgagaaaatcacttcccgtgtacaaagtaaaaacaaggatcaggtcaggcattattactaccgacttgtgagacggatgaacaaacttcttggtccaggattatgtttggatgccaaaaactctaaagatactaatgctgcaatgcttcgctggtgcgggtgtgactgcacactcgtgtggtctttattagaaaagtatagctgcaaagcctcaaagcttcacctgaagccccggagatttaaaatttttttagaagccttggaacaccaattattgaaggaccggaagaagaatgtgaggaagcgacccttacagggggggaattgtcttccttctgcgcctaccacagtctcaaatcaaagtagagcatcaggaaatgatgcctatgcagttaaactggtacttgttgacagtcaaaatattttaaaattgggaccttctaaaccatcaacgaagcgcaatgtaaacatgggtgttaaccgtagtaacactaagggagattcaaataccatgaaaccaacaaggcaacgaaagaaatctggtacgatttcaacggctgcttatagaaaatgggagaaggctgcaattgctggtgtttctttagttgcagatgctgctgagcatttggagcgagctgcaactgttaaaggaattgaacaagaccaggagaatccaggagaaaaatgttctgatcccgctgattatgtcctgccctctttacccacatgtccacaaaatcaatttgttgataacaatgtgaacaatattatgaaacttaagctccagttatttccaattgatgaacctactcgaagagcattggaaatggataagcataatccacacctggagcttacacttagtactcgaaagaagatatcatcaattttagaacatctaaaccgtaaatggggtaattcaagcatagcagctggagaagtaatgctttttccttatggtattcaaagggaaaacttggttaattgtccgagatggacccaggaatctactcttagtgcagcagatatatatgcaatgattggaagtccacccatcttccgtttaaggtatggctggttctccaatactgagcttgggttattaaatatgcaagtgcctgtagcatctggctccatgctcagacaatacaaaagtactgtggacaatgctaaggatcagattgtgaattcagtttcatttcctacaccattgactaatactcattccatggagctctctgaagattgcagaacatccatgaacagaaaccgtactcttatcactgcttcaactgaggaatctcgtgatcctacagccaatacactgtggcatggaaaagatgttagggatggagctgtgtctacacagttggaagacatggatgagttgaaaataagcagtggagcaggactgtcagctggagagtgggctgatagccttaccaacattagtgtgggggatctactttcaggagtgtcccaggatcttgataactgcatcgatcctcctattgcagagaattttcatgatattcagcaaattccttttagtagtgattcttttgatgctgctattgctgctcacatatctagacaccaagacaggatgggacaatcatctctggcatcccatatgtcttccatctgggatgccgaagaaacttgtgatgcctttttatttaaaaaagatcctattcttcacgaagatcatcctcgtttatctccagttgcttctttagagtctgagaaaaag

SEQ ID NO: 18076 - DNA, 1935 bp, Glycine max
  Peptide Sequence Number=SeqID_109761
atggctgacatagtgaagcagctgttggcaaagccgatccagctggcggaccaagtggccaaggcagcggaggaggccagttcctccttcaagcaagagtgcttagagctcaaatccaaggccgacaagctcgcggcgctgctgcggctggcggcgcgtgcgagctccgacctctacgagcgccccacgcgccgcatcatcgccgacaccgagctcgtcctcgacaaggccctctccctaaccctaaaatgccgcgccaacggcctcatgaagcgcgtctttagcatcatccccaccgccgccttccgcaagatgtcctcccagctcgagaactccatcggcgacgtctcctggctcctccgcgtctccactccggctgaggagcgcgccgacaccgagtacctcggcctccccccaatcgccgccaacgagcccatcctcggcctcatctgggagcaggtcgccgtcctccacaccggctccctcgacgaccgctccgatgccgccgcctccctcgtgtcgctcgcacgtgacaacgaccgctacgggaaattaatcatcgaagaaggcggcgtcggacctttactgaagctcatcaaagaaggaaagaaagaagggcaagaaaacgctgcgagagcaattgggcttcttggccgtgacctcgagagtgtagaactcatgatccacgccggtgtttgctctgtcttcgccaaagtcctcaaagaaggtcccatgaaagtgcaagctgtggttgcttgggctgtttctgaattagccgccaagtaccctaaatgccaggatcttttcgctcagcataacattgttcgcttacttgtgagtcatctcgcgtttgaaaccgttcaggagcatagtaaatacgccattgttagcaacaaacctacttcaatccatgctgttgtgatggctaatagtaataattctaatggcaatggtgcgaggaaggagagtgaagacgaggaaaaacagatgcagagtaggatgcagcatcccttgggtgataggtctacaaatcagatgcatagagtggtcacaagtaccatggcaatgcatgctgccaacaagaagcagcaacaggttaatggtggtaatgggaagcaaagctattcgtattccgggattaacatgaaggggagggaaattgaggaccctgataataaggcttacatgaaagcaatggcggctagggcgctccggcagctggcaaaggggaacgcggccatttgtcggagcataacagagtcgagggcgctgttgtgcttggccatactgcttgagaaaggaactgaggatgtgatgtacaactctgccttggcggtgaaggagataacagctgtggcggagaaagatgcagaattgagaagatccgcgttcaagccgaattctccggcctgcaaggcggttgttgatcaagtgcttaagatcattgagaaggaagatagaaaactcttgattccttgtgtaaaggctattgggaatctggccaggaccttccgggcgacggagaccaggataatcggtcccttggtccggcttctcgacgaaagagaggcagaagtgtccagggaagcagccatatctctcacgaaattggcctgctcggagaactacctccaccttgatcactccaaggcaatcataagtgccagtggtgccaaacacttggtccagcttgtgtatcttggagaacagacagtgcagatttcagcactagtcctgctctcctacattgcattgcatgtgcctgacagtgaggaacttgctcgggccgaggtgctcggagttcttgaatgggcttccaagcaacctaacctgacgcaggaccaaaccctcgaggcattgttgcaggattccaagggtaggctggagctttatcagtctagaggttcaagaggattccaaaaattacatcactag

SEQ ID NO: 18077 - DNA, 69 bp, Glycine max
  Peptide Sequence Number=SeqID_109762
atggcaggatttgctattggtttctgcacttcaacttttgacagaaaaaagcttccttatcttcgttga

SEQ ID NO: 18078 - DNA, 600 bp, Glycine max
  Peptide Sequence Number=SeqID_109763
atgactaagttcgggaggcctgctccaaagattgaaggccttgtggctgccatcggactaagtcatttgatcgcatgttccctagatacgagcgatcgaggactaatttttcttttgcccgtcggagaggtaactatcaccttggatgatgtggcgtcgttgctacatttgcctatcgtaggggcgttccatagcttcgagcaacttcatgtagacaacgctgtcaatatgttggtggaattactcgagttgcgagacgtgtatcaaacgaaaatcgaggcatgtcactggattgtagcagcgcgagcgtatttgttgcatctacttagattcacactttttgctaacaagagtgtcacacacgtgtacatggtattcttggatgcactgcgtgacttgaggcagagtaggacttatgcttggggcgctactgcacttgtgcatatgtatgataatttaaatgaggcatcaaagagcacgacgagacagcttgcaggatatatcactctattacagtgttggatctacaagcatttcccgtctattggttccgccctatttgccgaggattatgtttgcaaatttgtaagaacatggtga

SEQ ID NO: 18079 - DNA, 775 bp, Glycine max
  Peptide Sequence Number=SeqID_109764
gggtcatggtggagttgtccacgacgcagacagtgatggtggttttgttgttgatttcgagaaacagattgggatggcttcgacgaagaagatcacactgaagagttcggacggcgaggccttcgaggtggaggaggcggtggcggtggagtcccagacgatcaagcacatgatcgaggacaactgcgccgacagcggaattcctctccccaatgttaccagcaagattctggccaaggttatcgagtattgcaagaagcacgttgaggccaattgcgctgatgagaagcccagtgaggatgaactcaaggcttgggacgctgatttcgtcaaggttgatcaggccacactctttgatctcattctgggttacgtgttgtcgtggcctgaagagtggagttgtggaaccgcaagaatcatttgggataaatgtggccccagtgtgactttagaggctaggaacttcaccgacatggacgccggacacggacacgtggacacctatgatgtccaaaatataaaacgtagtatggatgtcatgtcgacgtcggatattgacacagacatgtgtcggacaccggacatgggaaggagctggagtgctgcaaattacttgaatatcaagagccttttggaccttacttgccagacagtagcagacatgatcaagggaaagactcctgaggaaattcgcaagacattcaacatcaagaatgacttcacccctgaggaagaggaggaagttcgtagggaaaaccaatgggcctttgaatga

SEQ ID NO: 18080 - DNA, 1548 bp, Glycine max
  Peptide Sequence Number=SeqID_109765
atggcttgtaaccatggccatggttgtgtgatgttggtgtatttggtggtgttgagtttatctgcttcacaaagttgttatggtttgggcacatttgggtttgacatacaccacaggttctcggatccggttaaggggatgcttggcattgatgatgttccacaaaagggaactcctcaatactatgctgttatggcccacagagatcgcatattccggggccggaaactcgccggggctgatcaccacgcgcctctcaccttcaccgccggcaatgtcacttaccggattgcctcctctggatttttgcattttgccaatgtttcggttgggacaccacctttatggtttttggtagcattggatacagggagtgacttgttttggttaccttgtgattgtatcagttgtgtgcaaagtggtttaaagacaagaaccggaaagatacttaaatttaatacctatgatcctgacaagtcatccacaagcaataaagtttcatgcaacaataacaccttttgtagacaaagacaacagtgtccttcagctggcagtacttgtcgatatcaaattgattatctttcaaatgatacttcatctaggggattcgtggtagaggatgtgttgcacttaattacagatgatgttcaaacaaaagatgctgacacaagaattgcttttggttgtggccaagttcaaactggggtgtttctaaatggggcagctccaaatggcctatttggacttggattggataatatatctgttcctagtatcctagccaaagaagggcttatttcaaattccttttcaatgtgctttggacctgatggtgctggaagaatcacgttcggtgatactggcagcccggaccaacgaaaaacaccattcaacgtcaggaaattgcatccaacttataacatcaccataacacaaattgttgtggaagatagtgttgctgatcttgagtttcatgcaatttttgactctggtacctcttttacatacataaatgacccagcttatacacgacttggtgagatgtacaattcaaaagtcaaagcaaatcggcactcatctcaatcacctgattctaatatcccctttgagtattgttatgacataagtataaatcagacaattgaagttccctttttgaatctaacaatgaaaggtggagatgattattatgtcatggatcctatagtacaagtttttagtgaggaggaaggagaccttctttgtttgggaatccagaaaagtgacagcgtgaatatcattggacaaaacttcatgattggttacaaaattgtctttgatcgtgacaacatgaatcttggttggaaggaaactaattgttctgatgatgtgctctcaaatacatcaccaattaacacaccatcgccctctcctgctgtttctcctgctatcgctgtgaatcccgtggctacatcgaatccatcgattaacccacctaatcgatcattcaggattaaacctacctttacatttgtggtggtccttttgccacttatagccattttttga

SEQ ID NO: 18081 - DNA, 1362 bp, Glycine max
  Peptide Sequence Number=SeqID_109766
atgagttctagttcttatgatatccctttgccatcgtcccttttgccaagcgaggcatcgccggagtggaacaacaaagcagacaacgcgtggcagctcacggcggcaaccctagtgggcctccagagcgttcccgggctcgtgatcctatatggcagcatggtaaagcgcaaatgggccgtgaactcggcgttcatggccctgtacgccttcgcgtgtgtgctcatttgttgggtttcatgggcacaccgcatggcgttcggggccaggcttttaccctttgtgggagcgcccaaccatgccttggccgagaagtttctcctcgcaaagtcaacaattgggtattttccaatggctgactttgtgttctaccagtttgcttttgccgcaattactcttgtgttgcttgcagggtccttgcttgggagaatgaacttctatgcgtggatgatgtttgtccctttgtggcttacgttgtcttataccgttggtgccttcagcatatgggacgatgatgggttccttcagggaaaaataattgactatgctggtggtatttgtccaacaccatggcttgaagagtcatcatcaaacatcgatctaatatggcatgcaggtttcaatggtggagctccatttcaagtgggagaaatcgcatccttggccatttacaatacccatctttgcactgccacaagcctactcgtttggcttacgcttgacatgattgtatataccaagagctcagtcataggtgctgtccagggaatgatcactggcctcgtctgcatcacaccaggtgcaggcttggtggatccatgggcagcagtattgatgggagcattgtctggttccattccatggtacacaatgatggtgctacacaaaaaatccgcattctttcaaagtgtagatgacacattaggagtctttcacactcatgctgtggctggtcttcttgggggtatcctttctggcgtgtttgccaaacccgaccttctaagaataatgtatcaagatacaaattattgccccggcttattctacaccttttttaagggggaagtggaccatggctttaggcaaatttggtaccaattacttggagcaggttttattattgtttggaatgttgttattactagcctcatttgtattctcataagccgcattgtggatcttaggatgaaagaagaggatcttgaggttggtgatgatgctgcccatggggaagaagcatatgcattgtggggtgatggagagagaatgaggatccctcttcgtcttcatataggtccaacaattccttccttgtgccgaaaaaggttttcaattcctctcactaggaaagaaggagaatag

SEQ ID NO: 18082 - DNA, 2034 bp, Glycine max
  Peptide Sequence Number=SeqID_109767
atggtagcgttggtttcggttctctactggctcggctcattaggcccggcccatgagtggagtcggcccattggatcagaagttgtggcggtgggagaggtgtcggggcccgaagacttggcttacgacaagagacggcgcgtgatttacaccggctgcgaggatgggtggatcaagcgagtcacggtgactgactcggtggctgacacggtggtaaaaaactgggtcaacacgggcggaagacctcttggacttgctcttgaaaaaagtggggaactcatggttgcggacgcgtttaagggattgttgagagtgacaaggaaaaagaaagttgaggtactggcagatgaagttgagggcttgaaattcaatttaacagatggtgttgatgtagcagaagatggtaccatttatttcacagatgccacatacaaacactctttggatgattactacaatgacataattgaaggcaagcctcatggtaggttcatgaactataatccagaaacaaaaaaggtaactgtgcttgcccgcaacctgtactttcctaatggagttgtagtctcacatgatcaacatttcgtgatatactgtgaaactatcatgaagaggtgtagaaaatattatatagagggtcctaaaaagggaagaataggggaattttgccgcgacctacctggcatgccagataatattcattatgttggacagggacaatattatattgcaatggccacgtccttaactcctgaatgggatttattacttagataccctttcattcaaaaagttgcggcaatggttacaaagtatgtactacaaccaaaggagaatggaggagtccttgttgtggatttggaaggaaaaccaactgcacactattatgattctgaattatcattaatctcaaccaccaccactcttctaatgtctaggttatggttttccacaccattctttgttatcattctccccgtggcggtggctgcgcttttcttccggctcgaaccgttcgatccgggttttttgccggttcagctgggccggtccaccgtggcggttccggcaagtaacggccacgtgcgagttggatcggaagctatgggcgagggacacttggagggccccgaagacttggcctacgacgccgcggcacgtgtcgtctatactgggtgtgaggatgggtggatcaagcgagtcacggtgaatgactcggtgcttgactcggcggttgaagattgggtcaacacaggaggaaggccacttgggctaactctgaagccgaatggtgaactcatagttgctgacgcggaaaagggactgctgagagtgtcaagtgaaagggagattgagctgctggtagatgagtatgagggcttaaagttcaaactaacagatggtgttgatgtagcagatgatggtaccatttatttcacagatgcatctcacaaataccctgtgaaagatgctgtgttagacatcttggaagggaagccaaatggaagattcttcagctataacccagcaacaaagaagacaaccctgcttgccaaagatctctactttgccaatggcgttgcagtttctgcagatcaacaatttgtggtcttctgtgaatctgtcctgatgatatgcgagaaatattacgtacagggccctaaaaaaggaaccatagagaagttttgtgacctacctggcatgcctgataacattcattatgatggacaagggcactatttgattgcaatggtcacggcccttactcctgaattggaattggcatatagataccctttcattaggaagacttttgcaattgttacaaagtatgtagggagtctacctatctcgaagaatggaggagttctagtcgtggatttagaaggaaaaccaactgcacattattatgatcccaaattatcattgactagtgcgattaaaattgggaatcatatatatggtggttccattttctacccctttgtaacacgttttgatattgagaagtaccctgctctccccacagtttga

SEQ ID NO: 18083 - DNA, 1317 bp, Glycine max
  Peptide Sequence Number=SeqID_109768
atgacggtcgccagcaccaagagactcttcaagatcacgctctctctcctccgcctcggcttcaactcctccaaatgcaaaacggcagccaagatggccgtggccaggatcaagctgctgaggaacaagcgagaggtggtcgtgaggcagatgcgtcgcgacattgctcttcttctccagtctggtcaagacgccaccgctcgcatcagggttgagcatgtcatgagagagcaaaatgttttggctgcaaatgagttcattgaactcttctgtgaattagtggtggccaggctcgcaatcatttcaaagcaaaaggaatgtccagcagatttgaaagaaggaattgctagcttgatatttgcagcccctaggtgctctgaaatcccagaacttgtggcacttaagaatatctttgagaagaaatatgggaaagattttgtatctgcagctgttgatctaagacctagctgcggtgtaaatcgccagttgatcgaaaagctctcagtacgaacaccacctggtgaagtaaaattgaaagtgttgaaggaaatagctaaggaacatcatattgattgggatactacagatagcgagaaagaacttctcaagcctccagaagagctaatagtagggccaagtgcttttgtcagtgccagcagcctaccagtgaagccttctacagttatgtcggtggattcaaataaacccgctactagattatcgaggggtggaaaacccgatgccgagcattacaaagattctaagtctgctgccgaagcagcagctgaggcagctaagcaagcaattgctgctgctgaagttgctgcttatatggctatgaaggactataataatgaagctcctcaaccatatgcttacaatgataagttgtataactcaggagtcaactctgggaccttccaatcaaacaatcctgcaaaatgcaccctgaacatgacacctaaatctttaactgaggagaaaatgtacaggtcacagagcttaccaagatctgatcatatgaacaatgaggaggatgcattgcctaaccaatatggtggaaatgattataggaggcacagctaccatccagcttccgcacattcagatattaagtttgatgaatcaagttgtgatgaagaaattgaagcagaagagcctcctccggttactatgccccctaatcggcttccaccaccggtaccctcatctctggctaaacaggaaagccacattcgtgttcatcccaaattgccagattatgatgaacttgctgcccgctttgatgcactaaaattcaagaagtcacaatcctga

SEQ ID NO: 18084 - DNA, 786 bp, Glycine max
  Peptide Sequence Number=SeqID_109769
atggctgaagcatgtggtaaccccctaaactttcacaatgctcgtaaaatccgggacattgttgtcttgcaagtcgagactgctgctattgtaaataagaattcactagttggtgacccccctacggatgttgtacctcctttagtgttcaagaagaaaaacaaggataagttgaaaaggaaacaccataaacatcaaaaatcattcgaggattcttccgaccaccatcgctcaaatcctatggtgtgtgccaaaacgtactcgcctaaaggtagtgagcgcaatggcacgaagatccctccctctcctaaagcacctcctcctctcgcggcggatcccggcccgatccgtgacgtcatggaggccatgcatgcgcccgtctactttgagaagttcgaggtccacggccacatgaaggccgtgccgccggaggtcctcgattcgattcggaagaacaaggtctgtctcaagggtggactcgtcacccccatgggcggtggcgtcagttccctcaatgttcagcttcggaaggagcttgatctctatgcttctcttgttaattgtttcaacctccctggccttcccacgcgccatgataatgttgatattgttgtcatcagggagaacaccgaaggcgagtactccggcctcgaacacgaggtcgttcccggcgttgttgaaagccttaaggttgctacaaagtaccctggaatcaagtataacgaaattattgtggataactgctgtatgcagcttgtttcaaagcctgaacagtttgatgtcatg

SEQ ID NO: 18085 - DNA, 1284 bp, Glycine max
  Peptide Sequence Number=SeqID_109770
atgtcatcaatctcaacctcacctcactcacaccttcttcttccccaaaaccagaatcactttctctccgaaagtgggacccacgcctcattcacaccctctccgcgccctttccggcccatctccattaaatgcacctccaccccggcccaagttcagacccatgaccccctcccggcccaaacccgggcccaagagcgcgtcttcaacttcgccgctgggcccgccaccctcccggagaccgtcctccgccgcgcccagtcggagctccacgtctggcgcggatccggcatgagcgtcatggagatgagccaccgcggcaaggaattcaagtccatcatcgaaaaagccgagtccgatctccgtaccctcctccaaatcccgtcggaatattccgtcctcttcctccagggcggcgccaccacccagttcgccgccgtcccgctcaacctctgttcccccgccgacgccgtcgattatatcatcaccggctcctggagcgacaaggccttcaaggaggcccagaaattctccaagcccactataatctggtctggaaaacccgaaaaatacacaaaggttccatctttcgaagctttgcagcaaaacccagatgcaaagtatttacacatatgcgcaaatgagacaattcatggggttgagtataagaactacccaaccccaaagaaccctaatgcggttcttgttgctgacatgtcttcaaatttctgttccaaacccgtggacgtgtcaaaatttggtgtcatctatgctggcgcgcagaagaacgtggggccctctggggtcaccattgtgatcataagaaacgatctaatcggacatgcacaagaatcgaccccaataatgcttgattacaagattcacgccgagaacaattctctctacaacaccccaccgtgctacgggatttacatgtgtgggttggtttttgaggacttgttggagcagggtgggttgggtgaggttgagaagaagaatgtgaagaaagctgaggttttgtataacacaattgatggaagcaatggtttttataagtgtccggtggagaagtcggtgaggtcgttgatgaatgtgccgtttacgttggagaagccggagctggagggcgagtttatcaaggaggctgcgaaggagaacatggttcagcttaaagggcataggtctgtgggaggtatgagagcttctatttacaatgctatgcctttggctggggttcagaaattggtcgctttcatgaaggattttcaggccaggcatgcttag

SEQ ID NO: 18086 - DNA, 96 bp, Glycine max
  Peptide Sequence Number=SeqID_109771
atggaggatcttgccacgcttgtggaagaatcagaaggctctgataccatagcaaagttcacaatgaggcctaactctaactctaacaattactaa

SEQ ID NO: 18087 - DNA, 300 bp, Glycine max
  Peptide Sequence Number=SeqID_109772
atgtccctgcttcccaaaacagagcaaaacgacgtccccgtcgtcgacattgacagcgacgacgacggcggcgccgcggtagctccggccaaaaacgacgcgtcgtcgcataagactccgtcgccacaagttgagcttgtgcagcaagaaaccccttcgtcgagttcctctctgtctgcctccgacggcctgtcccgaagcttctggaaagccggggactacgttgttggtccctcctcgaagcccgctcccttccaagcaattgctgagcttgtggataatgctgttgacgaggtatga

SEQ ID NO: 18088 - DNA, 828 bp, Glycine max
  Peptide Sequence Number=SeqID_109773
atgacagaaaatcagttaaggtggtttggaaaggccattggaagcaacattgaggagagtttggaggcagatcacactgtccatttggttcgtggctctgctcttgccaatccaactggtgggactaatactagtagcaccgataccaataccaataccaatatcccaacagataatgctagagttgctggtgcgaatgaaggtgagggtttgggagggcttggttttggagcttcactattccctggactaggtgtcaatgggactgggggcaatggtttatttggcgagggatttcctgatcttgaacagatgcagcaaccatttatttcaaatcccaatttagtgagagaaataatgaattcacccaccatgcagaatctaataaataatcctgaaatagtgcggaatcttataatgaataatccgcaaatgcaagagctcatggatcgaaacccggagctagcacacatacttaatgatcccagcactcttcgccagacccttgaagctacaaggaaccctgagatcatgcgtgaaatgatgagaaatacagacagagcaatgagcaacattgaatcttctcctgagggattcaacatgctgaggcgcatgtatgaaaatattcaagaaccatttttgaatgccactacaatggctggtaatacaggaaataataatgcagcagtttcagggactcatggtggccatgcaagggacccctcaactaatccctccaccactagttctgaagcaactgctggttctcctttacccaatactaacccgcttccaaatccttggtcctctacgggaagtaagttctga

SEQ ID NO: 18089 - DNA, 129 bp, Glycine max
  Peptide Sequence Number=SeqID_109774
atgtgggatcagcacatgcttaaaggagcactcaaaccgggtgtatttacccccaaggctgacactccgaagagtccgtcagagcctctccctcctgattcagttttatctcgtcgcacttgtgattaa

SEQ ID NO: 18090 - DNA, 480 bp, Glycine max
  Peptide Sequence Number=SeqID_109775
atggttattgttgttccagggaagtttctagaagattcatctgaagccactaactccatggcgacatgcttgggtcgcgcgtatgcgagtcgcgcatcgttaggcggtgtttggatttggtggggtggtgcgtcaggtccggacatggagctcaggtcgatgagctccgaccatgggcggcactgcgcaaagacgtggcggagggacgaggagatgcacgacatgaaggggcgcggaacaccagtgtcagatcagaggctggaactgcgagacagcgtcaccggaggcgctgaatttggaggagtggccatgttcgatttcaacaaggcagtgcatcacaacttggatttggtgggggtgggtggccacaacttggatttggttagggacttggggtggctggtcgtggtgcaacacgaaggagatggggaagtcgtaagggaaggggagagggcagggtggcacaagggaggaatatga

SEQ ID NO: 18091 - DNA, 297 bp, Glycine max
  Peptide Sequence Number=SeqID_109776
atggagggtaaggctagttcctgcatctccaatttgcttctcgaaatgtcttttcgaaatgtgttttggaagcttaaaagagatgcaggaagtaccattggaggtgcaggaagcaactggctattgggtaatcttaaaacttgtttaggcctaactcaatttgtttgtaaggaactggtgtccttgaatcccaggtttctctttaaatcaaagttggatttgaggcccagacttacagatacattgcggcattttgggtcatcaaaagggttagtatcgcaggaaaaaaaaggctag

SEQ ID NO: 18092 - DNA, 909 bp, Glycine max
  Peptide Sequence Number=SeqID_109777
atggcaaatattgtcaatgccatttggagaaaagcagtcaaagatgtagatattaaagggtacctaattcctaaggactggtgtgttgtggcatctcttacttctgttcatatggatggcatgaattatgaaaacccttttgaatttaatccagggagatgggagaatattgggactgggactaataacaattgctttacaccatttggtggtggacagagactatgccctggcatagaactctcaaggctagagctctctattttccttcatcatcttgttacaacttacagggttggtggaagacaagaggtgaatctggtggttaattgggcaaggtgggggaagggtggtcggggtttggaagagggagacaaatatggtgaggagggtctcgatgacgggaagaaggtgttcggaatggtggatcgggttaaaggtcaggtgtgggtagtaaggtcaagtggaaaagggccgagagggcatgggtttagtaaagctcatggtaagagtggaatagtccatggtaattggcctaagggttttcagtcgttacacgcccaaaacaatgagggtgccactaatggagccgttgcataccatgacccgcaagggaggggtcacaaggaagaaagacctaagaacttggcaacatggaaagggatccgcgacatcatcaatggacgaagtgcctggggtgggatcaggggattccaaaattggcccgggggtggcaccatggacagtatcagactcatcattagagatgaggagcaagaccttggccttgcaatggtggacgacttgaaggaagtagacgacgacatggatgggccggagaagatgaagtacaaaaagcatgatggcaattctgaatcttgtcctcgtggagtgtcaggccatatataa

SEQ ID NO: 18093 - DNA, 1170 bp, Glycine max
  Peptide Sequence Number=SeqID_109778
atgtcaataatgcacgcattgttaaatgacatgtactcttgtgctgggtggtctaacttattccctcatgcatttgtttatatttgtaactatcagattgacaaaaaatcgagttcctggggagaaccaaaggtgtatcctacaacttctgggaatttgaaagggttgccacaaggtatagttcatgctaattctgatttggagttaaaaccatcatggtcgacaagtagttcaaggtcaaaggctgttttctctaaccgtaacttattggcagttccagttggtattaaacaaaagcataatgttgatgttatggtgcaaaagtttcttcaagaaaactttacaattattttattccattatgacggcgaggttgatggatggtggaatcttgactggagtagcaatgtcatacaaattgttgctcggaatcaaacaaagtggtggtttgcaaaaagatttctacatccgaatatagtctccatttatgattttatctttctttgggatgaggatctaggggtggagcatttttcaccatcaagatatattgaaattataaagcaagaaggtttggagatatctcaaccagctcttgatccacattcaacagagatacatcatagaattacaattagatctataaccaagaaatttcataggagagtctatgaacgacgcaaacgccgtgcaaggtgttcagattcaagtgaggaaccgccatgcactgggttcgtggaaggtatggctccggttttctctcgatcagcctggtactgtacttggcatcttatacagaatgaccttgtccatggatggggactggatttgaaactaggatattgtgcacagggacgtcgaactaaaaaagtgggagttgttgatagcgaatatgtttttcataagggaatacaaactttgggtgggagtggtcacagaatgacaaaggtttcaaaactacaaaagacaactatgaaacaaggtggagtgggaattgatgtgcgaactgagataagaagacaatcaacaagggaatttgaaatcttccaagaacggtggaatcaagctatttctgaagacaaaacctgggttgatccatttaaaagtgaccaaagacgcataagaaaacaacgagacacacaacgcctttctaagcactttatatcttaa

SEQ ID NO: 18094 - DNA, 87 bp, Glycine max
  Peptide Sequence Number=SeqID_109779
atggtaatgtgtaagaacttgaaaagagtgagggttgcaaatgagcttggagctgggaacggaaaaggagccaagtttgctacaatg

SEQ ID NO: 18095 - DNA, 130 bp, Glycine max
  Peptide Sequence Number=SeqID_109780
atttggcaaattagacatagaagaactgaagaaggtatcagcatacatggcagtgacgaccaaaacagtggtggcggcagaatggcaagcttttgttttgttcgggggtaacagagatagcatgttatag

SEQ ID NO: 18096 - DNA, 693 bp, Glycine max
  Peptide Sequence Number=SeqID_109781
atggcaacttcgattaaggtcatgaaggggtttttttgtacaccaattcgccacggcaaccccgaaacagcagtcagcagcagaaaccatcaaaatgttgatctctctgggtcccactcgaggattctcccccaggcgttcgggaagattcgtgccctcgttgtgcttgatttgtctcagaatcagttaggggtgattcctgattcaatagcaggactaaagaagcttgtagagctggatgtttcatctaatgttttagagtccctacctgactccattggattgctagttaatctgaagatccttaatgtgtcagcgagcaagctaattgctcttcctgagtccattgctctttgcaggtcactagttgaactggatgcaagcttcaacaacctagtgtgtctgccaacgaacatgggttttggacctgttaaccttgagaagctcttgatccatttgaacaaaccaggggctgaggctgtgaaggatttcatggccaagtggtggcttgatctcatcgacgaagctcaacagaaaagcatggctgaaacacaaaatcatcaagcacagacgggatggcttgcgtggggagcctcattgttgaataatgttgctgaagtttcagaaagtgttgcagaatattttggcgctaaaaaagctcccagagacccatcgctggatcaacagctgtga

SEQ ID NO: 18097 - DNA, 681 bp, Glycine max
  Peptide Sequence Number=SeqID_109782
atggcgggatcaacctgtatcgccattgccactggcaaggtaatgatccaccaacccgctagttctttttatgaggcacaaacgggagaatttatcctggaagcggaagagctactgaaaatgagtgaaactatcacaagggtttatgtacaaagaacgggcaaacctttatgggttatatccgaagacatggaaatggatgtttttatgataacagaacatgaattttcagcacaagagtttaatattctccaatcaagtgttgaaactcaaggcatagccagacaaagagagactcttgaagcgggaccatatttgtacccacagatggtagagtgtggtcatggaatgtattacacaccaccagcattttctcagtattcggcacagatgtatcagtattcattcaaaggtcaaagtgatacttctgcaagcgaacattcattaggtggtgctgcggagacatatcccaattttccatggcctactatgagcccttcacaacaccatgatgatcgaattccaacaccaaatgccccgttaggtactcaatggaatgtacccggagcaatacctgatatggatgaattattaggtgttgatttacgtcaccaattttctgccgaggcagaccaagttgaattggggagacatcgtgacaaaagaaatcctgatggatag

SEQ ID NO: 18098 - DNA, 405 bp, Glycine max
  Peptide Sequence Number=SeqID_109783
atgtgtatcggagaaggaagaacagaggagaatcgcatggttgcggttgcttcagcttctgacttgaatatgcttggtgctgtttgctttaccacaaacaacacatgccatcaaccccaagtcattcattactgcaataaaaatgtgtttagaggaatgtcagagaatttcttactaacacttctctctcgaagttttttccttacgtatcaggaatttgatgatatgctagtagagtttcttcaagggacaaaactacttgcaagcaagtgccataagcaacatactgaaagcagagatgaagaagaggcgtgcaaacttaacacttggtggagttgccctttaagcctccttaaggctgtgtttgtttctgtcgttggaaactatacgccgcagacggaataa

SEQ ID NO: 18099 - DNA, 270 bp, Glycine max
  Peptide Sequence Number=SeqID_109784
atggaatggattattggactttggactctaatgggttttcttttatgttggtggtttctgtgtgtgagaaaggagaatcagaatagtaaggtgaagaagaagaagggtaaagttccaaaaggaaacactggttggcctctacttggagagacccttgagttcattgcttgtggctacacctccaaccctgtcagcttcatggaaaagcgcaagtctcttcctttacttatgatctcccccactaggacggttggagcattacatcattga

SEQ ID NO: 18100 - DNA, 1196 bp, Glycine max
  Peptide Sequence Number=SeqID_109785
atgcctaggtcgcgccgctcaaacccaaggctcgctgagagagaggttgagggttttgaggctgagagggagttcgtcggggatgttgccgaagatgtggttctgcacgacgttgagaatctgaaggctcgtgaagttcgccatcttcgcaagaagctctgtgacttcttgacaaggttctttgtgatcttttcttctcgttttgcatctttcttttggttttttatgtctatttcctttttctcagttttctcagcaaccaaaactggaaggtatgaattggttgaagagtgtgttgatgattacgatgcgaaacctggaatctgtgagttgaggaaggcagttctagaagagtgtgttgatgattacgatgcgaaacctggaatctgtgagttgaggaaggcagttctagaaggcagttctagaggagctgaagatgcacaactggctggtacaggtgagacgattttccatgagctagatccgggaaaatcaactcttttagcagcaattctcagagaaccccatcaaatccaaccacaactgggatccaccgcagttttcatcgccggcacccctgacatagctccgatcaccagcactggcgacttctatagggaattcatggtggagtccaagaagctcgggtacctcgccggccccgccatcttctccttcgtctcaaagtactccctcggcgccttcactcaaatctttgccggccacgtcggcaccattgacctcgccgccgtctccgtcgaaaactccctcatcgccggcttctcctacggcataatgctagggatgggaagcgcgttggaaacgctgtgtggacaagcggtgggagcagggaagcttgacatgctgggagtgtacatgcagcgggcaagacacccaaatttcggaggctgcgggaaccttcgccatttggatgattccgcagctgtttgcgtacgcgctgaattttccggtggcgaagttcctgcaggcgcaggtgctgagttggctgctcatggtgaagctcgagttggggctggtgggcgccgccgtcgtgctcaatggctcgtggtggtggctcagttggtttatgtgtttggtgggtggtgttggcctgcgtggaacggcttctcgggggaagcgtttcggaatctctgtggattctttcgcctctctcttgcttctgctgttatgctttg

SEQ ID NO: 18101 - DNA, 1137 bp, Glycine max
  Peptide Sequence Number=SeqID_109786
atgacaaggatcttccttagcaccctttccctgtgcctcttgctcctccagctgaatctctccaaggcccagcctggatctccccaaaaacttccatttacatttcattctctatttccatttttcggccgtccagaagacgccaacataccactaaagggtccacaggacgaccttcagaacgtgcctcaacaggccgccgaccaaaaacctcagaaactcagcccagatttctacataaaaacttgccccaatgcccaaaaaatcgtggccgatgcacttgcagacatcgttaagaagaatcccggcgctctcggaaacctacttcgccttcaattccatgactgcttcgttaatggatgcgatgcatcgatcttgctagattactcgccaagcggtgacaccgtggagaaaagttcaatggtgaatggtctactcctgaaaggagctgatatgatcgatgacataaagttgaagctggaggagcagtgtcctcaaactgtgtcatgtgctgacacattggcatttacagccaacgaggtaatgaccatggcgggtttgccccctcggaaacccctcggtggccgtagagacgcgctggtttccctttccagtgcggcagacgccgacaacctccctttgccagactggaccatggatcaaatggtaaaactcttcaccaaaaagggcttcaacatcgaagaaatggtgatcctactcggtgcacattctatcggcatggctcattgtgacttgttcatccaaagggcatacaacttccaaaacacagggaaacccgaccctacccttaccgtcgaagcggttgaggaattcaaaaaggcatgccccaatgttaatacacctaagtacaggaacccccctgtcaactttgatgcaacaccaactgtgcttgataacctcttctacatggaaatggtcgagagaaacagaacttttctcattacggattcccatttgttgacagatcagaggactttgccacttgtgcaacagtttgcacatgaccctagcttgttccccaggagatttcctgaggtcatgcttaagctcggttctttgaatgtcctcacagggaatgaaggcgagatcaggaagatttgtaggtccaccaattaa

SEQ ID NO: 18102 - DNA, 795 bp, Glycine max
  Peptide Sequence Number=SeqID_109787
atgggtaacatggaataccaagatgaggttgatattttgcgttcaggattgtatcaatgggctggtgatgctgcttcgtatgagaaaaatgaaccctacatagaggtggtaacctctccaaacaaccctgatgggactatgaggggtcctgtggtgaaatctgaagctgaagggaagctgattcatgatcttgcctattactggccacactacactcccattactcaccaagctgaccatgatatcatgatcttcacattctccaaatgcactggtcatgctggttcacgtttagggtgggccattgtgaaggacattgaggttgctaagaagatgacaaggtatgtgcagatgagctccattggagtctcaaaagaatcccaaactcgagttgctaagatcatgggagtgatttgcgatggctaccaaaactttgggtccatgaagtctgagctcttctttgaatatagcaaacgcatcttgaagcagaggtgggagaaattgtgggaagttattgaggaaagcaaggtcttctctgtggccaagtaccctaaggcctattgcaacttcactaacgagtcatctgaatctttccctggttttatatggttgaagtgtaaggagggcatagaagattgtgggagttatctgctggaaaaattgaagattcgtgcaagagaaggagaacgatttggtgttagtccaaagtatgctagaattagcatgataggaacggatgatgagttcaatgaatttctgaaaagggtgtcaaatgctaaaaaagaatgtgactag

SEQ ID NO: 18103 - DNA, 1152 bp, Glycine max
  Peptide Sequence Number=SeqID_109788
atggcggccacgccaccccctccgtctttctcgcttcattcaaacaaaccctctcactctcactctctgcttcgcctctcttccaacgaaaacagaacctttttctctttcaattcgaatctgaggtgcgagatcaaaggcttcgagagccaccgtggctggaccatcgagcgcgtctccgacatgagcaaagactccgccaattctcacatcaccaacccttcttctcccttcctctctgtctcctctgtcacctccgcttcccaattccccaccaaaaatgccaaaagagtcgtgcttttctactgccccgagaccaaggttctcgccgagaaaatcgccgcgcaaactgattccattgaacttcgtaacatctcttggggcaagtttccggatggcttccccaacattttcattccgaatgctcaaggaattcgtgggatgcacgtggcttttctagcctcattcagttctccagctgtgatttttgagcagattcctgttatttatgcgttgccaaaactgttcattgcttcatttacccttgtccttccgtttttcccaacgggaacttcagagcgtatggaggatgaaggagatattgccacagcttttacattggccagacttttgtcaaacatacctatttctaggggaggacctaccagtctggtgacatttgacattcatgccttgcaggagagattctactttggtgataacattttaccatgctttgagagtggcataccattgcttaaaagaaggctccaggatcttcctgattctgataacatatcaattgcttttcctgatgatggtgcttggaaacgatttcataagcaactgcagcattttccaacgatagtttgtgcaaaggttcgggaaggagatcaacggatggttcgtattaaggagggagaccctaggggtcggcatattgtgattgttgatgatttggttcaatcaggtggaactctgatagaatgccagaaagtcttggcagctcatggagcaacgaagattagtgcttatgtgactcatgggatttttccaaataaatcatgggcacgctttggacatgataatgggggtaatgcttgctttattttgttcattaagccaaagttcattgcctgctctttgttataa

SEQ ID NO: 18104 - DNA, 2604 bp, Glycine max
  Peptide Sequence Number=SeqID_109789
aaattcgacgttttcaaagaattggaaactggaaacttcactttcattcgatcaatcatgagaactcgaaacgccgattccgcctccaaatccgcaacccctaagaagacgccgccgaagaaatcccctgcggccaagcgcaccaccgccaccaaaaccagagccaccaagaagaacgagctctcgcccgcacccgattccaaccccgatcaatctcctctggaacagaaatcgttaggcagtgctagcagcgcaaaatctgtgaaaaagaagactccggggagatcgagaagtaaagcaatcaatactccgaattcggaagaacaatgtgaggcagtagctgatgaaactccaattgaagatgataccgaggtagcagagaaagtggaagatgttggagtggttgatgcagataatgttgagggtgagaaggaggggggaaaaggtgttggttctgttggattgtctgatgagacggatcgtaagtcgatggaagtggatgaacttgttcaaaaggtttgtgaatctgtgggaaaggaaaatgatgtaatggaagttgaagtagctgcttgctgggatgcttctgtttcttttaggcgaccagggcgacctattgtggatctcaatatatctgcggataatgaagattgtactggtgaaaaggagggagagaaatggaaggaagagttgaaagatcaagagggggacaaagggaaggaagagttgaaaaaacaggaaggagacaacgggaaggaagagttgaaagaactggaaggagagaaaggagaggaagagttgaaagaactggaaggagaaaaaggtgaggaagagttgacagaactggaaggagagaaaggaaatgttgaattgaaagaacagaaaggagacaaaggaaaggaaaagttgaaagagcaggagccagagaaagcaaagggagaggaaacaaacctttttggacatgaagagaactctgagtcttttggtgtagaaggtgaagcccagatgcaaaaagaagatgctaatcctattaaagatggcggtgaaggaccaaagattggtgaaaattcagatcttggagaacaagggaaggtggagcttgttgaagatccagaagaaaaccctgaagaagatccagaggaacctccagaagaaacttcggcattggaggaggagcatagggaattggaggctattgcaaatcagagaaagattaaaaaagaacacgagatttttgttggtggattggatcgtgatgctacagaggaagatctgagaaaggtttttcagaggatcggggagatagttgaagtcagattgcataagaattcttcaacaaataaaaacaagggctatgcttttgtgaagttttctgataaggagcatgcaaagaaagctttgtctgaaatgaagaaccctgttatacatggcaaacggtgtggcactgcacctagtgaggataatgacacattattcttgggaaatatttgcaatacttggaccaaagaagctaagctgaaggattatggtattgaaggggttgaaaacattatgcttgtcccagatgttcagcatgagggcttgagctggggctttgcattcctagagttctcttgtcatgcagatgccatgcttgcatataagaggcttcaaaagcccgatgttatgtttggccatgctgagcgaacagctaaggtagcctttgctgaacccatacgtgaaccagacccagagataatggcacaggtgaagtctgtgtttattaatggtctccctccacattgggacgaagatcatgtgagggagctgtttaaatcttatggtgaagttgtaagaattgtgctagcacggaatatgtcttcagctaagaggaaggattatggatttgttgatttttctacacatgaagctgctgtagcttgtgttgatggcgtaaataaatcagaattgggtgatggggcatcaaagataaaagtgagagctagactttcaaatcctctgcctaaaacacaggctgtcaaaggtggtatgtgtggtgggttccaaataagtcatgctaggagtggagccttttcaagaccagggggtttgggcggggaagacagcccttcaacaacagggggaatttcaacaggagcaggagtttctatcgtggatgaccatgattttagtatgcatccagatttccgtcaaaggcaatttggtccacaaggagctgtgaggggtggacattatgcaggtagccgaggtgctgcatttgctggaccatctagaccttatcatgatagagcatggtatggtattcccgatggaggccctattgagcctattcctccaaggaggccctactccccaggtggacagtttgacatgccttctatgggaaggcattttgatgatccatatctgtatgatgacaatatgcatggaatgaaacgtccattttatatgactgaccctgagcctgattacatggggcctaatagattacgtcctcgattggattatgcagatccacctatatttcatggaactcatcaccatgattcttttggggctggcagcagacagtaccctcctgactattacggttctgacgtgagttaa

SEQ ID NO: 18105 - DNA, 1056 bp, Glycine max
  Peptide Sequence Number=SeqID_109790
atggagtcatgtgtcccaccggggtttcggttccacccaacagatgaagagcttgtgggttactatctgaggaagaaagttgcttctcagaagattgatcttgacgttatcaaagagatcgacctatatcgtattgaaccatgggatctacaagagatatgcaggattgggtacgaggagcagaatgagtggtatttctttagccacaaagataagaaatatccaactgggacaagaaccaacagagccaccatggcagggttttggaaggcgacaggaagagacaaatcggtgtatgaaagcatcaaacttattggcatgagaaagaccctcgttttctacaaaggaagagcccctaatggacaaaaaactgattggatcatgcacgagtataggcttgaaaccgttgagaatggacctccacaggaggaaggatgggtggtatgcagagcattcaagaaaagaacaacaaacggccaaacaaagactattgaacgatgggatcgaaactacttatacgatgaacaagcatgtggtagtgtcagcagcactgtggtggaccataatattgaccttatggtaaggcaacaacaacctcagaggttttcagcagctcaaaatttcctgtacaagcaagaagagatcatagaagaagaacaacatttggtgcagcttcctcagctagaaagtccttctttgccactagcaaagaagcaaagctcagtaatgtccctaatatcagagaatattattaataacgaagatattgataatatttctcaaaagggtttatcccacaacactgcaaagaaagtgactactgattggagagctcttgacaagtttgtggcttctcagttgagtcaagaagagaggcatgaattcataggtgtgtcaagctttgcaactcatcacactactactagctcggacatggcattgttgctactgcagaataatagtagggaaaatgaaaggaattacaagttcaacccgtttttgaatacaagctcaacatcagactgtgacattgggatatgcgtatttgaaaaatga

SEQ ID NO: 18106 - DNA, 535 bp, Glycine max
  Peptide Sequence Number=SeqID_109791
aacttgtaaaaggaatttacaagttagtggaactctcaagcgggttgcttggggactggacgtaggcacaaggatatctgaggccacttgtctaacagctgcaagtactggcactaaggtggacccgactcacccatttggcctcaaccaagtaaatcacctagcctcggatgtgagcaagaattctttcccaccatatggcttgcctcccaactatacaccacccaatgttgcacatgctctcgatgagaatgtcgataactctgctcccatactcgttgagaggccacaaccccaatttggtcaagcatatgtccctcaacccataggggagacatatgaagtaccccgagaccacactctagctgacttcgagccgagcctcggatatgccactaagggggaggcgtttggtggcatagccctgccaaacactttgggggccctcagtatcgcccacaaccacaaccctgtcattttacggtggggagagtccctcctgctatggtggaaagggagaaatttgatcatatag

SEQ ID NO: 18107 - DNA, 816 bp, Glycine max
  Peptide Sequence Number=SeqID_109792
atggctggcaagattggttgggtctccttgaacaacatgtccaagaatctatttgagttcaactcaagcctcttttgctgcttcaaggtccttgctactgatgtcgtggctgatgatgacgatgctggggtgtcgggccataagaagtcgagggcccccttgagccttcgagccccaaggcatgttgcaaggttgacgcccagtttgagtcatccttcgagtttggaagatgggcctctagctctaacgactgtcgaggttcctggttccactattgttattgttgctactcctgctcctccacctcctcctaccattcatgctgctgcagttggtgtgctggctacttcagctggttttattatggcgtcttcgtccactgtggctacacccttgctaagtgttggtgtggcgaccatgaatgctcttgtgatgctgcctcctccttcttcggctccaccgattccaccatctgttgtgttggtggtggcatcgctttccttgtcttttcatccccatgtctctttggatcacttatacacctctagcaatgctgattcactgtgtggtgcaaattacaagctggagcagaagaccctgggtgcaaaacactacggactctgccaaagtcttcctccacagaagtttggtgattctggaggagaatggacaacgacaccaaaaggctctacacaaggtgtcgtccttgtggatagaccaaaaggagggctactacttgcacagtttggaaataggagtgccctaaggttggatggtgatgaattctacgcacgttgcaagggcttgcaggtatag

SEQ ID NO: 18108 - DNA, 438 bp, Glycine max
  Peptide Sequence Number=SeqID_109793
ctttaccaagtaagacaagttcgccgagagttcgatactcggttcttaccgttttatactacttgcacgatccggtgcacttgtcaaacaatcgaacaagtttttggtgccattgctgggaagcttctttctatttggagagttagttcagtcctagtgttttatatgcatagatctcccacaggcaatttagttcctctagacttggaaattgaagctacattgagaaggaacagagccgagaggagaaggaaattattgcaagacaaggcagtagcatccattcttgaggaaggagctcattcttttgattcatcatcatctgattcaccatcatcaagggaatctgcaacttacttgacagaagctgtttctatggcggatgaacatcagcagagagttacccttgaggattattcaagcagttcagtaccataa

SEQ ID NO: 18109 - DNA, 318 bp, Glycine max
  Peptide Sequence Number=SeqID_109794
atgaagctttgcttctacagtgttgtgcataagaagaaaactgctgacaagaaaagtactgatggcaagaaaaatgaggtgagaggtgaaagtaataaagaaaaagaggaacaaataatggtcaaaaataaagaattgaaggaccaagaaaaagaaaaagaaatagaaaatgaaaaagaagaaaaaaataataagaatgcaaagaagagtaggagtgaaaaagctgtggatgaaggtgtgacagtaccgtaccctgtggaaactggaaatcaccatgtccttcggagaagctttccagcaaatgccactctactctaa

SEQ ID NO: 18110 - DNA, 339 bp, Glycine max
  Peptide Sequence Number=SeqID_109795
atgaggcttaagaatcaaggaagtcactcagtccattatgtaagccaccaagggaatcaaggagctggaaagaaatttatcaagaagcatgataaaggcaaagggtcattaaagatcaatgacgattctttgcaaatccaaaaaaaggcattaatgggcaataattaccaattttgtgggaaatatagacattcccagaaggatttcctaaagcttaagtcttggtttgaaaagaagggtgagcttaatgctcttgtatgttttgaatcaaacttaacggaagttccccataataatgttggatcaagtggcctcggaataattaagaagggggattga

SEQ ID NO: 18111 - DNA, 491 bp, Glycine max
  Peptide Sequence Number=SeqID_109796
tggagctatggtttctcggccaaggtcaccacgaccacttggagaaaggtgttgaggcggttccaattgataaaagacctgaatgggagaagctggattatcagctctgtgctgttttatggcaatcggctgagccagacgcccgagaaatctttgtcaatgatattcagagtttgtttgatgcaaccatgaaggttacaacactcaagcaaaccagccatgacatgattgctcatataggaaaagttcgggctgcaatagaagagcttagagatcaagttccatcgatggattctcttatcactaggttgcttcgtgtgcctcatgcactgaaagaacaaaatccagttgatacagtggaaacatcagccatggttgcacctcgtgggagagggagaggtcgtaacagcagaagaggtcgtagtggaagaggtggacgtcctcaatgcacatattgcccgaggatgggccacactcaagagaattactaa

SEQ ID NO: 18112 - DNA, 537 bp, Glycine max
  Peptide Sequence Number=SeqID_109797
atggcgcctaccaggcaccctctggacccggataagtccaacagggccctgggatttcccgccttgatcacaggactctgccagtcgttcggcgtccccgtcacacctagcaaggtgattcggccgcccatcacccaagcttttattgagaagtactgcacgcagagacaggtccagggtgatgcaccacaggccacggacgcgccgccacctcatcaggctggtctagccggatcgtttgatacggagcagtatttgcggcatttggttcgccagcaggcggccaaccaccgagcacatgtacagacccatgattgtctttatcagatgagtctcagcctacagagccagggctttacttcttttccgtgccctactccggaccagttcagggtagaggtcgcatggcctggagattggcctgaggcccagccaggagaggcaccagcagaggctcccgacgaggcagatgaggcccacgaggacgaggagatgaccgatttacttgatttcttaggaggaagcggggccacatga

SEQ ID NO: 18113 - DNA, 183 bp, Glycine max
  Peptide Sequence Number=SeqID_109798
atggcgagggcgtgtagccctctgaaggtgaagacgtgtggtcctctgatggtgagggcctgtagccctacgaaggtgaggacatgcagtcctctgaagattgactgcccttttgaaaaaggtgataattcatgcaacctcatcctatctttttgcaaatctcttcgggaactccctcagagt

SEQ ID NO: 18114 - DNA, 246 bp, Glycine max
  Peptide Sequence Number=SeqID_109799
atgacattgaccatcctagagcttttcttgaggccttacccagttacatgggatgccaccgtgttcagggtctttaatccagatttcccgctttacataaagcacgaagaccacttcgaaatcgcacacggtggtcaatgtctcagcatatcagtgttacagttatggattcttatgcgagcggggaattctgatatccatggattccttgagccacagtccattcagaggtctgggcaatcatag

SEQ ID NO: 18115 - DNA, 309 bp, Glycine max
  Peptide Sequence Number=SeqID_109800
aacgaaaatgcaattcatagggctccgaaaaagggtagagaatggagaattgcactaaacaataactacgcatggctcagactcgtgggtgaaggatgcatgaacgaaaatgcaattcatggggctccgaaaaaaagtagagaatggagaattgcactaagcaataactacgcatggctcgaaactcgtgggtggaggatgcatgaacgaaaacgcaattcatggggctccgaaaaagtgttgagaatggagaattgcaataaggaatcactacgcatgactccaatcttgtgggtggaggacgcatga

SEQ ID NO: 18116 - DNA, 276 bp, Glycine max
  Peptide Sequence Number=SeqID_109801
atgtatatgtatggtaagtcttccattgatgagtgtcgcaacgtgcccttttgcgggcgagcgaggcgaggctcacgagtgcacttttcaaaggaggaaagatgcgcggagtcgccaccaacgtttatttgtggaaaacgtcggaaaaaccgaaggaaaccggtcaaaatgaaaattctaagttcgggagttgtatttacgtttgaggaaggtcgacaaaagcggggcttttgctcctacgtaccctccatcgaagaggaaatcagacctacgtag

SEQ ID NO: 18117 - DNA, 353 bp, Glycine max
  Peptide Sequence Number=SeqID_109802
caaggagaaatgggcccagttttgtcagagccgcagagacccctcgtgggaggatgtgcggaaaaaggcacaggccatccagaagcaaaacactgcccccacgtgttgtctcgtgggggccgtaattgaccctccatctcccatcagacgacacgtgaagtggaagattggccgcaccaagaaaattggccagatgacgtctgaggcagcaaacgaaattgctgagaagattgcaaacttattggaggagcaggcgtcacagggttcctttgtcccccatggatgccaggatgtcctgattgctgctattgggcgaccaaaacaccctggttgtgtgcgtgttgttggagccg

SEQ ID NO: 18118 - DNA, 208 bp, Glycine max
  Peptide Sequence Number=SeqID_109803
tgctttgaaaggacttgacgatactccacaacctaaatccaaggctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18119 - DNA, 373 bp, Glycine max
  Peptide Sequence Number=SeqID_109804
gttgtaccatctatggtgaggctcatgaaacatgccaatgtattcccgttgaagaaaacactcaagaagtttattatatgggaaatcaatagagacaaggatatactcaaggaggattctcatgcttccatcagggtccttataatcaacaaggacattggagatcacaccctggcaatcaattcaacaaagaccagggtaacaatgtcaaatcataaaagcactgagtcagcactgaaaaaccttgaggtccaggtgggacaactggccaagagtaagaggtttgtggaggcgagggatgaggatagtgttgtatccaagaagaaagttgctgaaaagaaaggtactgatgaaaagaaagatgatgtgagag

SEQ ID NO: 18120 - DNA, 222 bp, Glycine max
  Peptide Sequence Number=SeqID_109805
atgtcagagattcatgacacttactattttttttcccgcattctatgcaccaaaagaagcaagcttgtctgcataagcattgccttcgcgaggcagaacaacaaggaggaggtgaagcaaaagctaaggagaatgaaacccgagacgtcgctgaagatcaaggaggaggtgaaaaagcagttcgacgttgatttcttggcggtggctcgataccccgagtga

SEQ ID NO: 18121 - DNA, 351 bp, Glycine max
  Peptide Sequence Number=SeqID_109806
atgattatgaggggccaagacatttatagtagccaagatgaggctactacttcaccttcctctagtgaaagtgaagaagcaaaaggggaagaatctagtgaagaaatctacccccaagaagatggacaaccattagtggttaaagagaagtgtaaggaggtaaatgtctcctccaagagtgatcaaggggttcccatgaaccctaagagaataaaggtcattcctgagtggcccactccaccaagtgttgagggaaggagcccagagtatgaagaacctcgggatttgaggtcaaatcatttccaaggtggagggaatgatgcaatcctactccgtaagggcattgggtaa

SEQ ID NO: 18122 - DNA, 141 bp, Glycine max
  Peptide Sequence Number=SeqID_109807
atggacgaagatcaatggatgtatgacagtataatgtctgaagaagttgatatggatgatcaaaatgaacaagaatgtggtatgaatgaacatgttgattgttcggatgcgttcaatacttctcaggtgtttggtacctga

SEQ ID NO: 18123 - DNA, 1473 bp, Glycine max
  Peptide Sequence Number=SeqID_109808
atggttagaacgagagggttaggtcgtgccttaggcagagttataggtagagccctagggagaaaggatcatcatgattcatatgatgttccccagcgaccaaggcctacagcatctgcacgtaggcaacgagaagttgcccctattgctgaggatgatcctatgcttactgaagacatacatgcatatggtgaagaagttgttgatgatgctgagggatttctaggtaggccacatgacccatcagtgctgactgactatggtgaccttgttgcagtcattgtgtggaatggagaggaatgccctgaattgaagttatcctcccatggaaggaaggttcagaaatttgggaggtctgctctagaaattgaaaggttagtcgctgccacaggattaagtcctttgatcgcatgttcagtagacactggccatcagggactgatatccgcttttgtggagaggtggcataaggaaactagtagtttccatcttcctgttagagagctgaccatcaccctggatgatgtggcatctctacttcatcctccaattattggcgcattccacagctttgagcctcttcatgtcgacaaagcgtctcctgagaggaagctaaagctgagacaacacaatgtcatggggcatacgtatgcctatcgtggctacgagatatttatcagagtagatgtgagaccggacattggattgttgcagctcagtggaagctatgcatggggagcagccgccttagtgcatatctatgatcatttgaatgatgtttgtaagagcggcgaccgacagcttgctgactatgatgagatcccaccatgtgcctgccagtggattgctatgaaggcttctttgaagtcattacctgcatcgacgtacaggaaatgtctagatggactaatgagtcctaatgtttgctggatgccttacggtgagcaccatggagtgtgggactttgatttgatttcatgcttttcaggtcatctacaatcgggtcctgttgtggtcagacaccgaccagagagggtggtgcgacaatttggatacgttcagaccattcctccacagactacgacttccatgttatcatttgaagatattgacgataggtggatgcattactctgactatcttgcagtagcagggcagatttgtattgtgccaggacaatgtgcatccgattacatggagtggttcttcatgatttctcatccgttcatgacaccggcagagcctgctgatctgcccagacatccacctgcgatgcaggatgacacatatgtggagccatatatccctgaggtcccagtggcaccagcagcagcaccggcacatgccccttcttatgtggagcagcctcatacagtggaggcttgtcaagcaatcgcagaaaggttggaccgtctgctcaacctaaggatagttactgctggcacaaaaatacacgaggtcgtggaagactga

SEQ ID NO: 18124 - DNA, 534 bp, Glycine max
  Peptide Sequence Number=SeqID_109809
atggaggtttgcaactttgcatggaagggtgcaacgtttatggagaacaccagggagagaaggtggagggctctaactcaagccaccatcaatgtctccccgaattactcactcttaagcatttatgtgacaaggctcaatgcttggagggcttacaccatttgggatggatatttgggaacatcaaatttggtgaaaggagcaacttgccctcaagcatttatgccacaatgctcaatgcttggagggctatatactgtccaggataagtatcctgggaagaccaattttgacaaagggaacaactcacctttaagcatttgcaccactaggttcaatgcttggagagttgtatttttcgggatagatatcccgagaatactgactcaccccaagagtgtcaggtcttacaaccaggtcagggaaatgccacaatgtgaaatgtcagatgggcacaaccgcacacctcgtatcttgtatgaaggggacatgattgaatccgcagaatggcatggcaaaaaatggaaccaatga

SEQ ID NO: 18125 - DNA, 297 bp, Glycine max
  misc_feature (233)..(233): n is a, c, g, or t
  misc_feature (292)..(292): n is a, c, g, or t
  Peptide Sequence Number=SeqID_109810
atgtccggcttgcaaaagcatttcggaggcgcactggtggccggatttctgatcaaacgaattttgcaggcgttattcgtgcttgtcgcgaagacgctgctcgtcgctttcgcggtccgcctgacgggcgatccggcattgatgctgacgcaaggtgcgggcagtatcaccgaagccgatcttgcgcgcatccgcgaaggccttggtctcaaccagccgttcttcgtgcaatnctggcagttcctgaagggcctgttcccgatggatctggggcgcagtttcctcggcggtncgccc

SEQ ID NO: 18126 - DNA, 145 bp, Glycine max
  Peptide Sequence Number=SeqID_109811
atggctgctagtgatcacgctatcttgcgtgacaggacacacattcccaccaagagaagtgtgttagagctttcatcacaagacgctttgttggcacagaacaagttgctgtccaagcatcttgagaccttaacaaagacattaa

SEQ ID NO: 18127 - DNA, 315 bp, Glycine max
  Peptide Sequence Number=SeqID_109812
gagaggagcttgccacctagctcaccgaggcgagctcagctcgcccaggcgaaccaggttgcttcctccagaagcaaccgccttctggaggaacatcctggaaggcccaagtgggcctggttgctatttatatctcacatggctgtcgcaacctacccttttgcgggcgagcgaagcgaggttcacgggtgcgtcttccaaaggaggaaaatgcgcggagtcgccaccaacgtttatttatggaaaacgtcggaaaaaccgaaggaacccggtcatgaagaatattccagattcgggagttgtatttacgtttga

SEQ ID NO: 18128 - DNA, 318 bp, Glycine max
  Peptide Sequence Number=SeqID_109813
atgacgggatcgaaccgacgaccccctgcttgcaaagcaggtgctctcccagctgagctaatcccccgggatcctcgacaaccagacattggaatcttggtgggtctagttgggctcgaaccaacgacccccgccttatcaagacggtgctctaaccagctgagctacagacccagtccacgcaccctgctaccagggcacatggcttcagttttccagaaaggaggtgatccagccgcaccttccgatacggctaccttgttacgacttcaccccagtcacgaaccccgccgtggtaagcgccctccttgcggttag

SEQ ID NO: 18129 - DNA, 242 bp, Glycine max
  Peptide Sequence Number=SeqID_109814
aatcaagagatctcgctaacatgactcttgcaactctttttggaaagcttcaggaacacgaaatggaacatatgagactaaaccaacaagaagaaaatgacaagaaaaagaaaggaatttcacttaaagcctcatcttctattcaagaagaaagtgtcaaagaggacttgaatgaaatagaagaagatgatgatttcagactttttgtgaagagattgaataaatttcttagaaacaaatga

SEQ ID NO: 18130 - DNA, 783 bp, Glycine max
  Peptide Sequence Number=SeqID_109815
atgccgcgcgagacgctcaggccgtcgaattccagttgcgtggggcggtcaatcacattgccgatctgcttccagtgcaccagaaccggccgttcgcgcgcacgacgctgggatcggcatggaagccggccaggacaggattgcggtagtggccggccggcagcggcacttcaaacgcctggtcattgccgcggtactcgaaccagtcgaagtacaccgggggagcatccggcggcgcgctggcccgggtggttgcggccgacagcaggaacaacgcccccagcaggtggcgcgccatcgacctcaggccggccctgtcgcgggccagaggggactgcttggacaacgtcatcatcgtcgggcctcggcttcggcaatgggaagttcgaacgggccggccggcgccccgctgcggtcgcgcagcgtgcacaccgggccatcggcccagcagtagcgcacatgcgttgcgcgcgtggacagcgggccgcgcagcaggatccggcgcgcatccagtccggcatcggcgtactcgcagtggcgcgtatggcccctggcctcgcacagttcaaagccgatcggacgcagtgcgccggtcgcggtgagcgcgccttggacatcctcgaacgcaatggcgacgcccgtgggcgtccgcacggcggtgaccgctcgcgggccagacggtgctacgccctgctcgccgtacaccacatggcgcgccacgcgcgccaggcggcgcccgagctcctgcttgttcggcggatggaagtcctaggcgtcgccgat

SEQ ID NO: 18131 - DNA, 147 bp, Glycine max
  Peptide Sequence Number=SeqID_109816
atgaagaactggatgcaaaattcaaaatgggatgtctacttaggagcctacctgaatggtgctttgaaaggacttgacgatactccacaacctaaatccaaggctggtgctaggtggattattgttaaattaacgttgaatatctaa

SEQ ID NO: 18132 - DNA, 205 bp, Glycine max
  Peptide Sequence Number=SeqID_109817
gtggctgcgacgtggaaaccagcatattgacaatgatgatctcatagtttttcgtcgcaaattggatatcatgaaacgacatgagtttctgtgggagtcttacacaacaactgttatgtcggtgttgcctcccatttggcaagcccgaaggtgggatcgaccatgtggcacatcctcacgccatcacgcacaccataatgaatga

SEQ ID NO: 18133 - DNA, 247 bp, Glycine max
  Peptide Sequence Number=SeqID_109818
atgttggtgcgcatgatccgcactcgtcattttgcagcgggggtggcccaggaactgataaaaggaaactactggccccttaaccgggagtgcaagtctcggcgagggcgtgcagccctctgcatgatggcgaagacatatagtcctctaaaggtgataggtactagtacccaagggtccacctttatgagaaagcaagagatcgactcattgagagggccggtcatccaaaaagattggacacgag

SEQ ID NO: 18134 - DNA, 303 bp, Glycine max
  Peptide Sequence Number=SeqID_109819
atgggggtttttatcgtgggagcccgatctcgatatcgggggcaaaacaaatttgggtgtcaaggtgtcggtctcgggccaaacttccatattattccacaaggcacgcgtgacaatgatgatttgaaaacaacgtgcaaaattagtcatggctacatcctggtggacactcaagcattccatttatggccttatgatactacggttgggaatttacacaaacagacccaatgtttccaaattatgttctcccatcagttcaatgaattcatccattcttatttcggttatttcggaaaataa

SEQ ID NO: 18135 - DNA, 581 bp, Glycine max
  Peptide Sequence Number=SeqID_109820
atgtggtcggtcggcggcgtgatgtcgtggctgattctgccctgggcagtcagtgccgcgctgttaccgaacttctgggcgtactacagcagtttcagtttatcgcagctgctgccggtgtttctgtttggtgccatgtggggcatcggcaacatcaactatggtctgactatgcgctatctggggatgtcgatggggattggcatcgccattggcattacgctggtagtggggacgctgatgacgccgctgttgcagggccgattcgttgaactgttcagctccgccggtggccggatgacgctgctgggcgtgctggttgcgctgctgggtgtggcgattgtgtcacgtgccggactgctaaaggagcgggcgctggggatcaacgccgaagatttcaacctgaagaaaggcctggtgctggcggtgctgtgcggcatcttctctgccggcatgtcgtttgccatggatgcggcgaagccgatgcatgaagccgctgccagtcttggcatcaatccgctgtatgtggcattgccgagttacgtggtgatcatgggcggtggcgcgctgatcaacctcgc

SEQ ID NO: 18136 - DNA, 282 bp, Glycine max
  Peptide Sequence Number=SeqID_109821
atgaagaactggatacaaaattcaaaacacaatgtctacttaggagcctacctgaatggtgttttgaaaggacttgatgatactccacaacctaaatccaaggctagtgctaggtggattgttgttaaatgtaatagacaaaaaggaagcactgagtgtggctattacgtgatgcactggatgtccactataatcttaggaagtttcaagaataattgggaaacgtattttaatgatgttagaccattggaaacagagatattgaaggcgcttcacatctag

SEQ ID NO: 18137 - DNA, 352 bp, Glycine max
  Peptide Sequence Number=SeqID_109822
atgactagaggcaatccatctgacttacaaccctttgatcctaagatagataggacatttcatagattagttaggcatcattttgtatcttttgagcatcctgagcattttgttattggtgagtctgagcattctgtggttggtaattttgaacatcctgattttgggcattatagttttgaacattctgagaacatggctcaacctccaccccgtgagaggactctaagggaaatggttgcacctgatttcacctacgaaagcttgtgcatccaataccctgatgaggatgtcccatatgttcttaaaactggactgatccatttgcttccaaagtttcatggccttgcag

SEQ ID NO: 18138 - DNA, 240 bp, Glycine max
  Peptide Sequence Number=SeqID_109823
atggcaatgcaactgtcataccctaatttcgtccggggacctttgctcgatgacgtgcgaccattctttggtcctcgtgagcacccaggcccacttgggccctccagaatattcctccagaaggcggttgcttctggaggaagcaaccctgctcgcctgggcgagctgggcggcaaccacctcccctattttgctataaataggggaggaaggcaagaaggaaggggttcagccccttag

SEQ ID NO: 18139 - DNA, 240 bp, Glycine max
  Peptide Sequence Number=SeqID_109824
atgaaggggatcctaggcctacaagctccaatggagcttacatcatgtgaagcaagcttcatgcaaaaatcaagattgattcaaagaagttttgatgataacaaaggtgatgacaaaaagctcaaagatcaagaacacttcatgataacaaagatgatgatctcaagaatcaagattcaagttccaagaatcaagatcaagattcaagactcaagattcaagaatcaagagaagacttaa

SEQ ID NO: 18140 - DNA, 825 bp, Glycine max
  Peptide Sequence Number=SeqID_109825
atgggaacaaatcaaactggcaaaaagttttatcaagtcaaggtcaagagcctaggaatcaccagtctaaaagagttagggcagtttatgggtcagctccagcggcaagcttttcgcaaagcttatggtaaaatctgggacctagccatggtagaagtctccacagaggccattgcttccctcacccagtattatgatcagccattgaggtgcttcacctttggggacttccagctatcacccatggtagaagaatttgaagagatcctaggatgtcctctatggggaaggagaccatacctcttctatgggttctatccctcattaggtagaatttctaagatagtccaaatctcggcacaggaattagaccacagaaagcaagtcaaaaatggggtggttggaataccgagaaaatatttggaggcaaaagcaataatcttggctggtaaaggcgaatgggccccgttcatagacattctcacactgttgatcttcggaggattcctttttccgaatgtggatgggttggtggacctagcagcgatcgatgcttttctcgcctatcatgaccataaggaaagcccggttgccgctatgctagccgacctatatgacaccttcgaccgaagtttcacacctttttcgccaagaggtaaggcatgcttgcctgctagagagccaccgttcatgcacagagaaaggaggggcaaattgggaccaactcttagcaagcaaagaatgagcatctgtcaactgctacaatcccgttcttgctataagacaaattggctaccctatgagaggggcgccactagacgatga

SEQ ID NO: 18141 - DNA, 498 bp, Glycine max
  Peptide Sequence Number=SeqID_109826
atgagggaccgagacatttatagtagccaagatgaggctattacttccccatcctctagcgaaagtgaagaagcaaaaggggaagaatctagtgaagaaatctacccccaagaagaaggacaacctttaatgtttaaggaggagtgtaaggaggtaagtgtctcctccaagaggttagctaagaaggaaagtcattttgaaataaagacaaatattaaagaaacttcccctcttagacaactttcacatcttctcctttgtaaaaagacacttgttagcactgccacacctcttgggcttgatattattcctcaagtaaagaagttgttggaggagggtttggttcgtaagagcttaaatccttgtgctttgttggtgcccaaaataggtattattaggcatcaaatccctaaaataggagatatgatgaatgtgttgagtggcacaaccctcttttgtaaaccacttatgcgcccaacaacttcaagattcatgtag

SEQ ID NO: 18142 - DNA, 777 bp, Glycine max
  Peptide Sequence Number=SeqID_109827
gagcgcggacgagccgagcacgggagcgggcgtgccgccgacctccatcgcgacgccccgccgatccgcgagcggcagcagcgcctcgacggcctcctcggccaggagcgagaggtcgacgatctctcgcgggaacgttcggcggtcggcgcggctgagcagcaggagcgcctcggtcagatcgatggccctggtgttgacctcctgcaggcgggagatcaggtcgtcgacgtcacgatccggatcggtggcggcgacttcgagcagggtctgcgagatcgccagcggcgtgcgcagttcgtgcgaagcgttcgcggcgaaccgctgctgctcggcgacgtgcgcttcgagctgctccagcatcgagtcgaacacgtcggccaggtcgcggaactcgtcgcgcgggccggggagcgcgatccggtgcgacagcgacccctgcgcggcgaggcgggcggcgtccccgatgcgctcgagcggagcgagcatccgaccggcgagcagccatcccccgccgagaccgagggcgagcagcaccaccatcaccgtcgaggcgaccgggatgaacgccttgctcaggtcgccgcggttggggaagaagtcgaccgtgtccggcacgtagcgcagcaggaacagcccgacggccgtgagcagcaacacaccggacacgacgacgatgcccgcataactgagcgtgagcttgaggcgggcgctcatcccgcggcgtctacgcatcggtctccgtcccgatccggtagccgacaccgggcaccgtga

SEQ ID NO: 18143 - DNA, 414 bp, Glycine max
  Peptide Sequence Number=SeqID_109828
atggatgccctacaatatattaaggaagtacaatgtgcatttcacgacagcggagaaaagtttgacaagtttatggatgtcatgaaagattacaaatttcatagaattgatgttgggattgtcgtagaaaaaatggaggagattcttaaagaccatggggatttgattttgggattcaacaagtttttgccaaaggtatatgaaatcttacttctagatgagggtgaggatggatttggaaatgcttcgaaatatttgaagaagattcaggatcgatttgaaaacaaagatcatgtttacaagtcatttctaaatatacttcttaagtacaaaaataatggagtcactcttaatcccttttcagaaataagaagaagagaagaagaaatctctcttaaaagagatggattgtaa

SEQ ID NO: 18144 - DNA, 442 bp, Glycine max
  Peptide Sequence Number=SeqID_109829
atgtcgcgggggtcaggagaccttggggacgtcaggcgagctcctggcagtcaacagataaaaggaacaaagaccacaaagcttgaaaacgaggtcaggaagctaggagagcttctggtaatcgattaccaagggaggaatgggtcactggtaatcgattaccagatcatgatggcggcacagctaatccatgatcgagtggagatggagtgcctagagggagcttgggagaccctcgaagtccaagtgatcgaggtgacgtcatccgaggaagaccctgaggaggatcttgaggagctacctcctgagcctgctgtggatgctcttgactttctagagggtgacgaggacccacttcctgaggtggattctcccgaggaagtcatgtcggcatctaaggcagactctacgaaggatagtggcccgggagagatggcgatca

SEQ ID NO: 18145 - DNA, 204 bp, Glycine max
  Peptide Sequence Number=SeqID_109830
atggccgcgttggagagagaaggcagcaacggacttggttccacagaggcgcagctcaccacttcgaagggttggaaagccgtttccaatgattcttttgccgcttctacgtatggggcggaggagaggcagctcactaacatatcctcttctcccgccactatcactaaaagtccacccaaggcgaacttcaatttctggtga

SEQ ID NO: 18146 - DNA, 498 bp, Glycine max
  misc_feature (57)..(57): n is a, c, g, or t
  Peptide Sequence Number=SeqID_109831
atggcctcgaagcactgctggtgctcggcactcctgaaacagtggctatcaaactcngggggtggcactggtcccttcagccgcggcgtccctcctagatctctttgcggaaagctttttcgaagccatttcctgcgaggacaaacatttggaaagcatttttacgctaccaatccaacatatacagatttttcaaagctaagttccacaaaatcatgcgcaaatgccattgaggcatttcaccgaacacttggtgggcgcatgtttaagcatgaaaatcaagggaatcgggacaatgtggcatgccccattatctcagaatgcaccctaggcctagggccatcccctacaacccctcaattcatcaaaaacaaggaacaatccaaggataaatccctcacgtttttgagcaaatacatgcaatttagagcaccaaaatacatcaatggaaagctagagagcccaagaatgaggtacttacttgttggagatgaataa

SEQ ID NO: 18147 - DNA, 439 bp, Glycine max
  misc_feature (439)..(439): n is a, c, g, or t
  Peptide Sequence Number=SeqID_109832
atggcattagaagaggggaaggagaagatcgagaagttcacaagattggagtcagtgcagattaaatttgaggacgaggtgaaggcattgattctattgtcatcactaccagatagttgggttgcaactgttactgcagttagtagttctacaagagagaacacattaaagaggaaggactacctagaaggtcagaatggtcaaggcagattaaagtcaagagggaaaggttcgacaaaatttcgaagtgacattatctgttggaattgtgacaagagaggtcactttaccaatcagtgtaaggcaccaaagaagaacaagactcacaaaaacaagaagcgcgatgatgatgaatccgcaaatgcagcaactgatgaatttgatgatgcattaatttgcagcttggataatcttgttgattcatggattatggactcan

SEQ ID NO: 18148 - DNA, 420 bp, Glycine max
  Peptide Sequence Number=SeqID_109833
atggttctggctgctgcattcccactgaagatacaacacatgaaagaacagtggagaactcaccctggcaatcagttcaataaagaccagggtaggccatctaacaggccatcacaacaagggcctagtctttatgatagaacaacgaagctagaagagactcttgctcagttcatgcaagtatccatgtccaatcaaaagagcaccgagaaagccatcaagaatctagaagtccaggtgggacaattggcaaaacaactggcaaaccgaccatcaagcagctttggagccaacacagagaagaatcctaaggaggagtgcaaggctgttatgactagaagcaaaatgctggtgactgagccagcaattgacctaatggttgaacctttgagtgagactgaggaagaagtggaagtataa

SEQ ID NO: 18149 - DNA, 465 bp, Glycine max
  Peptide Sequence Number=SeqID_109834
atgaagggcctatatatatgcgtgtctgacttcaaaaagcaagagagatattccaagaatacttcattgtcaaatgttctgtcaacaactcttgggcaaacacttgcaaatctattgagagttcatccaggaacttcgaattgtattatccactctaaaggagagaaatctttctattcttctcagaaagtcaattgtaatcaggagattggttgtctcttgaattgtgagtttcctgaacacaagggaaagggattccttgggtgttcagaagttgtagaaaggatttttataaacatagtggaaaatttaaagtgggttgcttggggactggacgtaggcacagggtgtggccgaacaagtataaatcgagtttacatttctctcttcccttatctcatttatgttattgcaatcaatttttccttgcacgttttgttggacaagtggcctcagatatcttaa

SEQ ID NO: 18150 - DNA, 682 bp, Glycine max
  Peptide Sequence Number=SeqID_109835
atggagagaagtatgatagatgctgccagtggtggagcccttggagacatgactcctgctgaagccagaaatttaattgagaagatggcttccaactcccagcagtttagcgccaaaaatgatgctatagtcattagaggagtgcatgaggtagctacaaactcagctgcatcatctgaaactaagaagcttgaaggcaaactggatgcattggttaacttggtaacccagctggccttgaatcagaaatctgtacctgtcgcaaggcaacaacaacagcagcctgctccttccttccaaaatgctgctggcccaagcagaccatacattcctccaccaatccaacaacaactacaaccccagaaacaaccaacagttgaggcccctccacaaccttccctcgaagaacttgtgaggcaaatgactatgcaaaacatgcagtttcaacaagagaccagagcttccattcagagcttgactaatcagatgggacaattagctacacaattgaatcaacaacagtcccagaattctgacaagctaccttctcaagctgtccaaaatcccaaaaatgtcagtgccatttcattgaggtcgggaaagcagtgtcaaggacctcaacccgtaacaccttcctcatctgcaaatgaacctgtcaaacttcactctactccagaaaaag

SEQ ID NO: 18151 - DNA, 234 bp, Glycine max
  Peptide Sequence Number=SeqID_109836
atgcagttatccacacgctcgatgagtgataaacgcgcagggacaaattttgcgccctttatcattcaggagcagcgagttgagtggaacaacaagttgggtggtaaacgcgcagagacagattctgcgccctttatcattcaagagcagaaagctgaatggataaacgcgcatagacgaattctgcgtcctttatcattcaggaacaacaagttgggtgataaacgcgcatag

SEQ ID NO: 18152 - DNA, 273 bp, Glycine max
  Peptide Sequence Number=SeqID_109837
atgaccggccccctcgatgggccgatcgcttgttttctcataaaggtggacccttgggtactagtacctatcacctttagaggaccatatgtcctcgccatcagaggactgcacatcctcgcctgcagagggctgcacgccctcgcctttaaagggctacgcgtcctcattttcagtgtgctccatacccacaccttagaagaatataagggatcgcgcccacaagacgcccagtgggcccgaagaagtccaacagggccctggggtttctag

SEQ ID NO: 18153 - DNA, 399 bp, Glycine max
  Peptide Sequence Number=SeqID_109838
atgagtctgatcaatgtagtaggcaacaatccattgaattctgggcattcatgcacttattatgggaaacataatcacactattgatagatgctataggaagaatggttttcctcaaaattatgcttccaaagaaggaaagggaactcaaagcaatcctggcagaggaaattcaggagcaaaaggaaacaaggtgtgcaaatattgtggtttttctaaccatactgttgatgattgttacaagaagcatgagtactcacctggacacaaactttataaggttcaaaatccaaacatcaataatgacagtgttgtaagagaagaaggtgatggttcacccttagatcgaaatcaagagacacaaaatgaagatgtgatattaactactcagcaatataaa

SEQ ID NO: 18154 - DNA, 183 bp, Glycine max
  Peptide Sequence Number=SeqID_109839
ggatgggatcttctgcctagattagatctctcacgggattcatctggcatttctggatggactgtcattgagcatgtcattccggacttcgctattctcacaggagagagatcgattagccgtgaaggggccccttgcccactccccttccccccattgaaggggcctcgtcctcttcctcag

SEQ ID NO: 18155 - DNA, 459 bp, Glycine max
  Peptide Sequence Number=SeqID_109840
atgattggcgagcgggttagtttttacgttgggccgatcctcttgaaatgtcagccattcggcgtctatcaaatgttggaccttgtatttaagggccaagcatttttcggtggagtggcccggggttttcccatggtacgtgcaagtcgcatcaggatcatacaactttgggaaaggatattggtagatcttcccaggagttattacgaccatttggttggcgatgagggacagcaagaggtcttcgtacgtcattgggatcggggtgaattctggaattggcttcagggaaaagttcctcatcgcattggaaccgacaccaaagtgggcattgtcggccgggcgagtcgtggttggagctggagcttgggggcctccgtttggatgggggtgggcactctaggctgtgcgggtgttgaattggaggagttcccggcgcgagctgagaagctcagatga

SEQ ID NO: 18156 - DNA, 156 bp, Glycine max
  Peptide Sequence Number=SeqID_109841
atgggcagaaacgtgtcagcattgataggtaaatttgttcctcacattcctgagaaatgtaaggacccagatgtggtgattcatttggcaaatagaagtgttgcttacctcgcaagttgcatagaggatgtgctggttcagacttggggagtgtga

SEQ ID NO: 18157 - DNA, 405 bp, Glycine max
  Peptide Sequence Number=SeqID_109842
atggtgggttacacaccttcaagcttttcggatttggtcttcgctggcgaaattatcaaagtgggcctggaaagaggtaaatctaaccatcctactttgatgaatgcgaaaactggggcaaatgaagagggtgagaatgaaggagaaacccatgctgcgactgccattcctatacggccaagtttcccgccaacccaacaatgtcattactcagccaataacaacccttctccttactcaccacccatttatccacaaaagccatccctaaatcaaccacaaaacccacctaccacacaaccaatgctaaacaccacttttagcacaaaccaaaacaccaaccaaggaaggaattttgcagcaaaatcttgcagaattcaccccaattttggtgtcctatgctaa

SEQ ID NO: 18158 - DNA, 567 bp, Glycine max
  Peptide Sequence Number=SeqID_109843
atgtcattttcggaagaaacaagcagtcagaccattactatctctagattagctttcattcttccaaatggatcaatcagttacaaccaaactagtgtttattttcaaagtctcattccaacaccaatgcgagttcctaacaactgttcttttgatacactcaagcgtagaatggacaacacccttcaactaaccaacgatcaactactggatgaaatctactaccgacagccattcatagatgcagaattattatgtaccattattagaacaccggatgctatgctcaacctgcttcaatcaaccatcactcctactcatgatgcaattatgtattacaacgggaagtggaacataccacgtcaaggtgagttttttggttactcatttactggaactaatccaatcagatttggcattctttcggaatgtggcatggagaaactcaaggatttaatcaagcaagttgcacctacaggggtccccctgatggaattcacggatcacaattggttagacgattgttctttcgacaaccaggtcattctaagtattccgaaaatttga

SEQ ID NO: 18159 - DNA, 708 bp, Glycine max
  Peptide Sequence Number=SeqID_109844
atgcagctttccggaaacacaaaactgaaaaaagcagaagtggcagcactactttccatcagtaacctctctgcacaaactttttccgacttcaactaccatggaaacgataaaatatataataacaaccctcttaaaccggacgagttttattccccaattttacagggctgttatcccgatccaagcatcaccaaaaaaggtgacgattattacctggtaaactcttctttctcaatgtttccgggcgttccgattttcacttccaaggatttggtcaattggaaacaggttggacacgttctcgacagatcttctcagttaaaggtggaaaagggaggtgtttctcatggaatttatgccccggatatcaaatacaacaaacacaacgatacattttatatgatcactacccagattgctggcggtatcggaaatatggtcgtaaaaaccaaagatccggcaaaaggctggagtgaagtccagaaactgaattttgacggtattgatcctgccattttctttgatgatgacggaaaagcttacatcgttcacaacgacgcgccaccacaaggaaccgaacagtatcaaggtcaccgtgttattaaaatgtgggattacgaccttgaaaaagatcaggttgtggcaggttcagacagaattattgtaaacggtggagtcgacctttctcaaaaacccattggatga

SEQ ID NO: 18160 - DNA, 303 bp, Glycine max
  Peptide Sequence Number=SeqID_109845
atgaacaaaggaaagagtgatcatagtcacttgctcagtgtgcaaaagcctactaccaataagattggtttagggtataacaagcaaactaccttttctaagaaaaccaagtttgcatcctccaaaaagatgaacccaaacaaagtctccaaaaagaaaaacctagtgcattctaagcctaaaacaaagacttgtcattattgcatgaaaataggacacatatcttataaatgctatgttaggagattttacattcctagaggtgtgactaaaagcaagagactcgctattgtacttggatag

SEQ ID NO: 18161 - DNA, 1007 bp, Glycine max
  Peptide Sequence Number=SeqID_109846
atggttctgaaagaggagttgattgcttgttcaaggtccaaaagaagcttgtctcagcgtttatgcgagacagagaccaacatgctagctatcatcgccaagtaccaagaagagttaggtctagccgcggcccacgagcataggattgcggacgaatatgcccaagtatacatggaaaaagaggctagaggaagggtgatcgactctttacaccaagaggcaaccatgtggatggatcggtttgctcttaccttgaacgggagtcaagaacttccccgattgttagccaaggccaaagcgatggcagacacctactccacccccgaagagattcacgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacgcggccaccgccgccgctgtcagttcggctgccgaagcagacccgactctcttggcaactacgcaccatcctccctcaaacatagtaggacggggaagggacacactggggcacgatggcaaccctcacctgggatacaaccgagcggcttacccttatggattgccgcccaactattcaccacccgtcttacaagaagatgcgggccacattgcttctcccatccatgaaagagagcctcctcagcagcccgacgaagtccacaaagaccctcaagattatgctcgaagggatgtcgagttctatcccccgatccccgaagggccggcaccaggcacgttgcctcaacccaacatcgcagcatcaccaatagttttgtccacggaagggccgcccccagcaactgaagaaaggaggaagctcgatctccttgaggaaagattgagggctatggaaggatttggggactatcc

SEQ ID NO: 18162 - DNA, 228 bp, Glycine max
  Peptide Sequence Number=SeqID_109847
atggcttacactcacattccagtggaagcaaagatgattcacaagcgattctcctcaaatttcaaccagcctgaatcaattagactttgcactttacacttcaaggtcatacaatgcttaatggaatgtcccagaactcctccatgttgtgttcgattcgtatcctcggaaaaatggaggttgaggaaccttggcaggggttatggctaccattgcattatcaagtag

SEQ ID NO: 18163 - DNA, 654 bp, Glycine max
  Peptide Sequence Number=SeqID_109848
atgaaaaaggaaaagagaagtagtcataactcttgcaagagcctaagtgaggaacttcgtgactattatgaaggaaggcataggtcacatcttagacctcactccaatagaagagaacatgaaagaaagcctcaagaggctaacattaacctcccatacttccatgggaaggacaatgtagaggcttacttagattgggaaataagggtagagcaaaaacttaaaagaaagtctactttaaaatcttatggctctcactcttatccaaagaaagaccaaggtctaggcatcttaggggcagcaccttctaagcccaaagatgataagggaaagacaatagaaaagcgggggcgtaaggctaccaaaaatgaggctactacttcaccttcctctagtgaaagtgaagaagcaaaaggaaaagaatctagtgaagaaatctacccccaagaagaaggacaacctttaatggttaaggaggagtgtaaggaggtaagtttctcctccaagaggttagctaagaaggaaaggcattttgaaataaagacaaatattaaagaaatttccccccttagacaacctccacatattctcctttgtaaaaagaaacttgttagcattaccacacctcgggggcttgaggttatcctcaagtaa

SEQ ID NO: 18164 - DNA, 249 bp, Glycine max
  Peptide Sequence Number=SeqID_109849
atgtcattgcctagcgctgttcatgtgtcctccaccttcgagtttggagctatgcttcatgattgcctaagtgtggaccctcaagtgcaatcctccattctccccacttatttcggagttccatcaatgtcattgcctagcgctgttaatgtgtcctccaccttcgagtttggatctatgcttcatgattccctaagtctggaaactcaagtgcaatcctcctttctcctatttttcggagccccatga

SEQ ID NO: 18165 - DNA, 900 bp, Glycine max
  Peptide Sequence Number=SeqID_109850
atgaaaatcgtcagtgaagacccggatatcaaaacctattatgaatataccggtggtgcgggcggtggccagaccaataccggcacgatgtttgccagcctgcggccgttgcctgaacgtgaaaccacggcggcagatgtggtcgcgcgcttgcggccacaactgatgaaagtgcctggtgtgtcactcatgctgacttcgcaacaggagctcagcataggcgcacggcagggaggggcgcagtttcaatataccttgctggcggatgacctgcctacactggagaaaatcacgcccaaattgcgaggcatgatgaatcgctcgcctgagctgacagacgtcaataccgactttcagacgcagggcttgcaactgcaattacaggtagaccgtaatgcagcggcgcaactgggtattactgcggcccagctcgacgcgaccctgaataatgcatttagccagcgtctgatttcaacgatttatgaaccgctcaatcagtattacgtggtgcttacactgtcgccagagtttaccaaagggccgcaggcgctggagcaactctacctgaatggcctgaataatacgcgggtgccgctgtctgccatcagccgctggcagctcaagagcacgccgttcgctctgaaccaccagggacagtttgtcgcagccaccatttctttcaacgtggcagaagggtattcgctggagcaggccactagtgccattgagcaggcgtttgaacgctctggcgccccagacaatgtgaatgccaccttctccggtgccgccaaaatgttcaaagcctcactggcgagccacccgtggttgatactggcgggtttgctcacggtgtatatcgtgcttggcattctgtatgaaagactttctccattccgctga

SEQ ID NO: 18166 - DNA, 518 bp, Glycine max
  Peptide Sequence Number=SeqID_109851
atgccttccagtttcgcgaacttggtatttgccggggaaagaatcaaagtagggttaaaaagagggaagtttgattacgtctcctccacaagtgccaatgctaggagaatcggaacaactggggcaaaaaggaaggaaggagatacccatgccgtcacttcggcgcccgcatgggtcaagcccccgcagacctctcatggtacccatcagtacgcgcaacatcatccaagcttttcagctcacgtcgggaactcctccaattcagcacccgtacagcctagagtgcccgcccccatccagagggaggccccccaagctccggctccaaccacgactcaccctaccggcaatgcccactttggtaccggttccaacctgatgagaaactttcccccgaggccaattccagaattcaccccgatcccaatgacgtacaaagacctcttgtcttctctcatcgccaaccaaatggccgtaataactcccgggaagatctatcaacatcctttcccaaagtg

SEQ ID NO: 18167 - DNA, 957 bp, Glycine max
  Peptide Sequence Number=SeqID_109852
atgattcctcctccgccacccactttctttgaaaagtttggaattttaattggtgggtttatcgtttttatcggattgatcttctattattactcaacatggagaaaatatggcgtggatcctgaaaaaccaatagtttatccgcagtttaatgttcccgaaaatctttctcctgcttctttagggtatttgagaaatgagaatttcaaaaataaatatctgacggcagctattgtcaatctggccataaaaggatattttcagatcattgaaggagaagatgccggaattcttggtcttttcagttcaaaaatatttacccttaaaaaattgaaagaagcagatgagtctttaccaaaagaagaaattaatctcatgaatacgcttttttcagataacatcgatactgtaaagtttgatgggaaatatgattccagaattgaaagagtggttacgaattttaaggaaacgctgaaattccaacatgataaatttctcaatgaaggaaataacacaggaaaattaatattgcctactttacttattacaatagtgtatatgcttggattatatataagttatactatttatccggaagcggaaaaggttgtcatcggaattgcagtgccgtcagaagagaaattacagaaaaaatcactgattgaaggtttcaaaatgtacatgggagcagcggaaaatgaacagttaaaatttcataatccaccacaattgacaccgcaggtttttgaaactcttttgccctttgctatggttttgggagtagatgaaatctggggtaaaaaatttgataccttgttgaaaaatatggctaacggaacagaatatgttcatagctggtatattggaaattctataaatcattataaatttggaactacattgaactcgagccttaccaaatctataaaatctgcatctacacgtgggatcctctag

SEQ ID NO: 18168 - DNA, 180 bp, Glycine max
  Peptide Sequence Number=SeqID_109853
atggcgggcagcaggcaacagacgcgccgcccttccggtagagttcacctcagctcatccacaaaaagtcatagcaggacacacctagttgctcatgatcctaggaatttaaataaaacaagcacaagctcggaagatagtcatacctcacaaaaaatatatatatgtatgtttaggtag

SEQ ID NO: 18169 - DNA, 165 bp, Glycine max
  Peptide Sequence Number=SeqID_109854
atgactaatcaatcgagatacttaaacctaaaatataagtggcaacagagatcacctataattatcaggattcatggaaagtcatgcccgattcttttttgtgcaactcctccagagctctctcaagaaactcacattcctctaacaatgagatctgggaaataa

SEQ ID NO: 18170 - DNA, 1080 bp, Glycine max
  Peptide Sequence Number=SeqID_109855
atggagctctctgtgcccttcagattccgatcacggaacctcctctcaccctctacacacatacccatcacctacccttccaagcatcaaccaccctttttaactaagtttgtcaacaaacccaagatttctaaactaacggtgagagcgcagagaagggcacccattgaagggctgagcgatgagttgaacgctatagctcgttgtaaccttgactttgcttacactcgaagaagggtccgcgctgctttcgctgatatgcagcagcagctggatcattgcttgttcaagaatgctcctgctgggatcagaactgaagaagtaagattttctgctttaccttattatctgggatggtacgaaaggaattctaggggattggaaattttctgcaaaagctggatgccaaagcctggcattccaatcaaggcctctgtgtgtttctgtcatggatatggtgatacttgcaccttcttttttgaaggtatagccaggataattgctgcttctgggtacagtgtctttgcaatggactatccaggttttggtctttcagaaggattgcatggttatataccaaaatttgattatctggttgatgatgttatagagcattatacaaaaattaaagccagacctgatctcagtggcttgcctcgatttatattagggcagtcaatgggtggagcagtttctcttaaagttcatttgagggagccaaataattgggatggaatgatacttgtagcaccaatgtgtaaagctgtttacaatgttatttgttatgatgataatccacggttgagaactggcatggaacttttaaggaccacaaaagaaattgagtcgcaagtacacaaggtctcagcgccattattgattcttcatggagcagaagataaggtgactgatccattagtgagcaaatttctttatgagagagcatctagcaaagataagactttaaagctctatgaaggtggttaccactgcattttggaaggggaacctgatgacagaatatttgctgtacatgatgacattgtctcgtggcttgattttaggtgttcaattaaatga

SEQ ID NO: 18171 - DNA, 387 bp, Glycine max
  Peptide Sequence Number=SeqID_109856
caagctctaattacgggcctctgtcagtctacggagtgcctgtcacccccagcaaggtcatcaggccccctactaatcgagcttcatcaagaagtactgcgtccccaggcaggcgcagggcgaaacaccacagcagcctggggatggccggcagcgggcaacagacgcaccgccatcacctctagagttcacctcagctcatccacaaaaagtaggacacacctagttgctcatgatcctaggaatttaaataaaacaagcataagctcggaaggacatcccctttatccccgaaccgctggccaaaccctgacatatatcattaccagccgttctacaagccttgagccaaaatcccaacttatcataaaccttgacccagggtga

SEQ ID NO: 18172 - DNA, 291 bp, Glycine max
  Peptide Sequence Number=SeqID_109857
atgcccgctaggaggaagaaagccatatcttttttctgggtcctacccctccatgtcaaggatagccaaggtggtcaaaatctcggcgcaaaggcattggcagagcaaggtgaaggggcttcgttcattgatgtcttggcgctattgttatttggagtcatcctctttccaaacgcgaatgggctagtggacctagcaacgatcgatgccttccttgcttatcaccaaagcaaggaaagtttggtcgttgctattttggctgatgcctatgacacctttgaccgagattga

SEQ ID NO: 18173 - DNA, 221 bp, Glycine max
  Peptide Sequence Number=SeqID_109858
atggcaggagctggtgacaatagtggtgtatatcatcaattggacggatctcaacgcttattactagacgcgatgactacacaaatgcaacgtttgttgaaccgtaacaatgaagagctctacaagcgaatagaaggactagagcaccaaatgaatctaaatgctgggagaccttatggtggcaatagaagggtcaatgatggatcgaaccgaatagaggg

SEQ ID NO: 18174 - DNA, 165 bp, Glycine max
  Peptide Sequence Number=SeqID_109859
atgaaatatgatagaggtgataagtattacggaagatatgatgaaactgggcaacacccaggtccatttgctaagcttgttcagaaacgtgcatttgtgtgcaatacacaattcccagtacaccacaacaaaatggtgtatcagaaaggcgtaacagaactttaa

SEQ ID NO: 18175 - DNA, 252 bp, Glycine max
  Peptide Sequence Number=SeqID_109860
atgggggaagttcttgactcctgttcaaagctctttcaagctccgcctttagggcttatttgggagccaatccagtccttgtgttcggactctcagccacttatgatagccgccgatgatcccattactgcttcccctaagctctctgtcctttcttcatgccgcatcccatgccttgcgaactccttggagtaccctcgcgttgtggtcactgaaaccccgtgcgatgaaaggcgtgatgctttcgtctga

SEQ ID NO: 18176 - DNA, 285 bp, Glycine max
  Peptide Sequence Number=SeqID_109861
atgtatgtgaatttagccaaggaggtgtgtgattatcccactggtaaaactaactttccgaatgtttgccttcgcaggaaatggccccgaggaagcttgcctcaaagaggtccaggaaggacaaggcagcagaaggaactagttccgctccggagtatgatagtcaccgctttaggagcgcggtacaccagcagcgcttcgaagccatcaaggggtggtcgtttctccgggagcgacgcgtctagctcagggacgacgagtatactgatttccaggaggaaatag

SEQ ID NO: 18177 - DNA, 264 bp, Glycine max
  Peptide Sequence Number=SeqID_109862
atggtggtgagcttcttcttgactcatcttctccttgaattggtgctccaatcatctttcttctccattccgttgccattcatcttcaagaagccaaggactccattgatgaagaagatccaaggcctacaagctccacatggagctacattagaacgagttgtctattacttaagcaagaagttcacgacatgtgaaatgaactactttttgctcgaaaggacatgttgtgccctggtgtgggcagcccaccgtctgaggtag

SEQ ID NO: 18178 - DNA, 510 bp, Glycine max
  Peptide Sequence Number=SeqID_109863
atgagcgtccacgtgacccaagtgattgctgacgccatctatttgtttgtatgtatgccacccagcaggcaccctctagacccggataagcctaacagagccctgggatttttggctctgatcacaagcctctgccaatccttcggagttcaggtcacccctggcaaagtgatccgacaaccgatcactcgagccttcattgagaagtactgcacgcctaggcaggcacagggtgacgcacctcagggcgcggatgcaccgccaccacctcggcaggctgatccggcagagccactgggcatggagcggtatctacagcatttggttcgccagcaggcggccaaccaccacagacagcagtttgcggctgaggtcgcatggccgggagactggcccgatgcccaggcaggggaggagcctacaagatctcccggtaggatggatgaaccctgcatggacgaggatatgactgacctgttcgatttcttgggagggagcggagccacatga

SEQ ID NO: 18179 - DNA, 603 bp, Glycine max
  Peptide Sequence Number=SeqID_109864
atggtggtgcgagcctttgatggtactcggcgggaagtgatgggggaaatcgacattcccattcagataggcccccacacttgcaatgtggtgtttcaatgtcgggtgaagaggatatgtttagtgagctgcccctcctccgcaccgtatgtagaagcggcggaagaatcattggaaacggctttccaatcttttgaggtggtgagctgcgcctctgtggaaccaagtccgtcgctaccttctctctccaaagcggccataatggtggcgcgtgttatgctcaggaatggatttgagcccggaatgggtctaggcaaggactgcctcgggaatgccgacgtggtcgatatcaagggaaatccatacaagtatggattagggtacgaacccgggatgccagggaggaggaacgtgccgtcaagattttgggcggatagggtatggcccggccgtattagccagtgtttcaccagcgctggaatggtgtccgaggaggaggtggccgtaatagaagaggagttccctcaagacccaccatgttttgtgcaaccatgccaccccgattcccaagtggggaactggcacgtgataagccagtcagaa

SEQ ID NO: 18180 - DNA, 759 bp, Glycine max
  Peptide Sequence Number=SeqID_109865
atggcgcagatcggcggcacgcccgccggaggcgtgacccgtctggcgctgagcgaggaagatcgtattgcgcgtaacctgctgcgcgactgggcgctggacgcaggtttcacctgcgacgtcgacagcatgggcaatatgtttatccgtcgcgcggggaaaaacccgcagcttgccccggtcatgacgggttcacatgtggatacccagccgctgggcggtaactacgacggtgtttacggcgtgctggccgggctggagctgctgcgcacccttaacgatcataacgttgagaccgagcgtgacgttgtgctggtgaactggactaacgaagagggcgcgcgctttgcgccggccatgctctcttcaggggtctggacgggacagtttagcgaagcgtacgcccatgcccgcgcggataacgatggcatcaccgtgggcgaagcgctggatagcattggctaccggggtgaaacccctgcccgcgctccgcgcggcaatgggccagcgctggtttaccctgacgctggaggattcgccgcccacgcgggcacgacgccgatgcacagccgccgcggcgctgccgccttcgcagagctggcgctgaagggaagagattggctaccggcatgcgccggacggaccgcgcccgcacgatcggtatggcgcagtcgccactcgggtcgtgctctcggtgaagcagcgttgagtttcggcatcctatgccaggctggaaaccaggatcacggcgctgcataa

SEQ ID NO: 18181 - DNA, 1674 bp, Glycine max
  Peptide Sequence Number=SeqID_109866
atggatgcccaacaactctctcgtgaaggctattttaatcagtttattcaatcgggcgcgcgcattgagcccgcgggctgttcactctgcatggggaaccaggcgagggtgcgcgaagggagtcacgtggtatcaacgtccacccgaaatttcccgcatcgcctgggaacaaatgccaaagtcttcctggcgtccgctgaattaagtaccgttgcggctatcctgggtaaaatgcccaccgttgacgagtattttcgctataccgataaacttcatgacgcccatgaaaatatctatcgttatctcagttttgacaccctggctgaatatcaaaccacaaaaggcatttatctttccgcaatcgtagggctggtgattaaaccctatcctgaacctgtcatcatgctggtcgcggtcgcattaacctgttttaccgtgaccaaattccccgattctcccgtgaaatccatggacgttcttagcggatacgcctcaggcaccacctggcttgtgttcagcgcctttacccttagcgcggcgtttgtcaccactggtctggggaagcggcttgcctactggtttatcctgaaatttggcagcacgacgctgagactgggttatgtaaccgccttgctggatttggtgctggcacccgccacgccttcaaataccgcgcgggcaggtggggtggttttccctattattaacagtatcgcgaccgtgctgggttcaacgccacaagagtcaccgtgcaaggccggacgttatttaatggtcaatgtctatatggtgactaaaacgaccagctatatgtttttaaccggttttgccgggaacgcattagcgctacagcttatttccgacattttccatattcatattagctggatcggctggatgctggcgggtgccccgttgggattattgatgctgtgtattattccctatatttgttaccgcgtcgcctcgccggaaattaaaaagattgataatgtcgcgattgcgactgatgggctgaaaagcctgggggcgatgagtctcaaagagaaaggtctggtggtgatttttatcgccgcgttactgggttggatcttttctcgccatcttggattgaatgaatccgctgtcgccattatcgcgatgggggcggcactgctgtttaatattatcggctggagtgatgttcagaaaaataaaggtggctggaataccctgatgtggtacggaggcatcattggtctgagcgccaccctgagcaaagagggctttttccgctggctggctgatttcctgtcagcgcatctggatttcctcagcgccggtaatatgaccatcgtgattatcgtgtttctcagcgtactggttcgctatttctttgcctccggcggggcctacgtggcggccatggtgccggtcttcgccaccgtgggtctggtcaccggcacggcgcccgtactgctggcgcttgccattctgttttccaactcgtatggtggctgtatcacccactatggtggcgcggcaggtccaattatcttcgcctctggctataacgatattaagtcatggtggacaatcggcacaatcgtggcgctgggcacgtttttagtccacatgttcctcggcataccgtggtggggtttcctgatgcagcacggcatgctgcagtattaa

SEQ ID NO: 18182 - DNA, 237 bp, Glycine max
  Peptide Sequence Number=SeqID_109867
atgtcagtgaaaaacctcgttgggcgcctaggagtacatgacaagacaaaccacacactaggagaccagtcagggtcatgttattttatgagaatgctccaactgtgtgggatcagcacatgcttaaaggagcactcaaatcgggtgtatttacccccgaggcctaaaatccgaagagtccgtcagggcctctccctcctaattcaggtccaaccaagaaaacattttaacacatag

SEQ ID NO: 18183 - DNA, 384 bp, Glycine max
  Peptide Sequence Number=SeqID_109868
atgggaggaactaaaaggcttttagtgataattcccaaggtggtcatatctctcttgatgttttctagaggtatcattcccttcgaaaaacatattgcggcagtagggactaccaacaacaatatgttatcaaagagaaaaactctagatgagggttcactgttatcaagcaagtcggagacccagcatgaccacagattcacttccactccttatgatcccatggactcgggtataaggccccttttcaactcaccgtgtgtgcaaaaagtggagtcgctaactgtcgcaacctacccgtcggcggaagtggcgacgcatggctcacgggtgcgtcttccaagggaggaagacgcacggagtcgccaacaacatttattctag

SEQ ID NO: 18184 - DNA, 503 bp, Glycine max
  Peptide Sequence Number=SeqID_109869
gtcgactctagaggatcccagaccgaagttggtcattctgcacccaagatacgcggagataccttacggttatccgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaaagaccaagtttggtcattctgcacccaagatacgcggagataccttacggttatccgcacccctttgccattaggcagacacagttgtgtccgatggcaagcagagaccaaagaccaagtttggtcattctgcacccaagatacgcggagataccttacggttatccgcacccctttgctaggcagacacagttgtgtccgatggcaagcagagaccaaagaccaagtttggtcattctgcacccaagatacgcggagataccttacg

SEQ ID NO: 18185 - DNA, 312 bp, Glycine max
  Peptide Sequence Number=SeqID_109870
atggatgaggctattattaccatgaaaagagctttggctatgatgaaagattgccattggaggccgccacatggacttgtgttagccattgcagagtatttggagaaagatgggaatctcaaatatgcaaacaagtatattacagatctccgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18186 - DNA, 582 bp, Glycine max
  Peptide Sequence Number=SeqID_109871
atgggggtgcaaatagcaaccaggcccacttgggccctccagaagattcctccagaaggaggttgcttctggaggaagtcaccttgctcgcctgggcgagctgggctgccgtctcttgtgacggacgcatggggtgctaataccttccccatgcataaatacaactcccgaacctttcactataaagttcgtagatcacgtctttttccggtttttccgacgttttcctcaaataaacgttggtggcgactccacgcgtattcctttcttagaacacgcacccgcgagtcacgcgtcgccctcccgccgaaggtattggcgatcgaaattgctattccttgcgttacggggttgaaccaagcacatgctttcaagaaaagtacttcaacaatgcatcattcacatagaggccgtgaaagagaaagcatgtgtgaagtaaaggagttacaagagcagataaaggccgacatagaggccgtgaaagagaaaatggccacaatgatggaggccatgataagcatgaagaagatcatggaagtcaatgcggtagtagttgccgctaccagcgctattcaaagatga

SEQ ID NO: 18187 - DNA, 216 bp, Glycine max
  Peptide Sequence Number=SeqID_109872
atggccaaggatgaggaaggtcattttgtaatggcccagaaagtttggatggaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18188 - DNA, 592 bp, Glycine max
  Peptide Sequence Number=SeqID_109873
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccacatgtttcaaaaattcaactatctgagtgatcccatgttcaagggttcattcggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18189 - DNA, 516 bp, Glycine max
  Peptide Sequence Number=SeqID_109874
atgaccatgattacgaattcgagctcggtacccgcagagatgtcaggtggtggatgcagcagcatagtgtggttcagaagagatctgaggatagaagacaatccagcactgacagcaggagtgagagctggtgctgttgttgcagttttcatatgggcacctgaagaagaaggacaatactaccctggcagggtctctagatggtggctcaagaacagtttggctcaccttgattcctctctcaggaatcttggcactcctctcatcactaagcgatccactgatactctttcttctctatttgaggttgttaagtccactggagccactcaactcttttttaatcatttatatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18190 - DNA, 177 bp, Glycine max
  Peptide Sequence Number=SeqID_109875
atggaagaatcatcaaagaagcgaaaagggtcttcctccacccccattgttgctggccaccgccgccaaggaacctctagagacccatccacaccagttcctccttctctttcatctcctagatcatccatattagtcattctagaccctaagtaccttgaccttgaatttctttga

SEQ ID NO: 18191 - DNA, 609 bp, Glycine max
  Peptide Sequence Number=SeqID_109876
atggctacctcaccaaaagaaacttccgcttctggttcacccgctgtaccatcatctccgcaccaggaacaaccggaattcaacattcaacccatacaaataattcctggtcaagcttcagtccctgagaaactgattcccagaagacaacagggggtgaagattgctgaaaaccctagccctgcaacaagtcctaggaaagtagacacggagatggacaagaaaatccgcggtattgtgagtagcattctgaaggatgcttctgtgcctgatgctgagaaagatgtcccaacatcgtccaacccaaatgattctgtgcctgatgtcaagaaagatgttccaacatcctccgctccaaatgctgaagccctcccttcacccagtgaagaggaatcatcaaaagaagaggatcaagcctcagaggagacccctgcaccacgggcaccagaacctgctctaggtgacctcattgacctggaagaagttgaatctgatgaggaacccattgccaacaagttggcacctggcattgcagaaaggttacaaagcagaaaagggaagacccccattaagaggtctggacgaatcaaaacaatggggatcctctag

SEQ ID NO: 18192 - DNA, 210 bp, Glycine max
  Peptide Sequence Number=SeqID_109877
atggatgacattgaaaggaggaggcatcatataggtcacctcattcttctcaaggaagtgatgatggctatgaagaagggttttgtgacgtttcggaagaaaatgtgccaaatactcaaaaagagggcaaaagggtcaattttagggcatttttcagcccttgaatcacctagacaacttcatgatgaagtaaccagctcgcctgggtga

SEQ ID NO: 18193 - DNA, 414 bp, Glycine max
  Peptide Sequence Number=SeqID_109878
atgacggtgaaaacctctgacacatgcagctcccggagacggtcacagcttgtctgtaagcggtatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggttacgccagggttttcccagtcacgacgttgtaaaacgacggccagtgccaagcttgctatgcctgcaggtcgactctag

SEQ ID NO: 18194 - DNA, 116 bp, Glycine max
  Peptide Sequence Number=SeqID_109879
atggaccaccagcagcagggtgcacaacacccaaggggtgcaaaccacctaacagttacaacccacccaaagggtgtaaaccacccaatagttacgattcacctaaagggtgcaag

SEQ ID NO: 18195 - DNA, 369 bp, Glycine max
  Peptide Sequence Number=SeqID_109880
atggcttcgagaaagatttccacaaagcgatctaggaaggacgccacgaccgaaggaactagtgccgctcccgagttcgatagccgtcatttcaggagcgctgaacaccagcagtgtttcgaagccatcaagggatggtccttccaccgagagagacgcgtccagctcagggacgatgagtacacagatttccaggaggagatagctcgtcggcgttggacgtcgctggtcactcccatggccaagtttgatccggatatagttttggagttttatgccaatgcttggcccacggaggagggcgtgcgggacctacggtcatgggtaagggaccaatggattccttttgatgcagacgccctcagctag

SEQ ID NO: 18196 - DNA, 777 bp, Glycine max
  Peptide Sequence Number=SeqID_109881
atggcagaaccatcgaagaagcgaaagggttcttcgagtagaagccaacggaactctgagtctcatgatactccaattccaccttccatttcgtcctccacgttgttctcatctgaagagcaacgtatctggtacacaactctcttttcttcttgctctataatagatcctaagttcatggacatggagttctttttttatgaaacatttgagtgtgttcaagcatttcagaactttggtctcattccgtttatgtctttaaaaattcctattcatcctgagttagtgaaagttttttattcaaacttagaaattcaagaaggttccttgatttctaaggtatatgggattaagatggtcatagaccagtcccttttctttgaactcacccagctatccagtgatggtgtactgtttgaaggtacacttgatgatgattggaagttcgatttctctgtttctgatgcccgtcggttggtttgcaccaaccaagcggatatgatcggaaggcttcttgctggttcattggcatttgattgtcgcatcctccactatcttattgttcgcattttgcttccaagatcttcaaaccttgcacaggtacctcttgattttgaaccttctgttcaaatcaagaagtccttttccattggggctgcagtggtcgcctcctttggttaccgcaaagagcgtgatgactcttgggtaaagaaggatgctcaaccacatgatgctgaggaatgctcgcccgctcgagaggattcttctcttctgtag

SEQ ID NO: 18197 - DNA, 222 bp, Glycine max
  Peptide Sequence Number=SeqID_109882
atggctactcagttgaaccaagctcagtcccaaaattctaacaaattgccttcacaaactgtgcagaattcgaaaaatgtgaatgccatcaccttgaggtatggcaaccaaattcaagtgcctccaccagtagcagcacctgcacctgaacctgtcgagcttcattctaaacctgaaaaagaagatgagatagttgcacaaaagaggaagcttcctgattaa

SEQ ID NO: 18198 - DNA, 408 bp, Glycine max
  Peptide Sequence Number=SeqID_109883
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggctgaaactttggtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 18199 - DNA, 366 bp, Glycine max
  Peptide Sequence Number=SeqID_109884
atggctaagtttggcaggtctactctagagattgaaggccttgtggctgccagtggacgatcacgagaggtaactatcaccttggatgatgtggcatcattgctacatttgcctatcgtaggggcattccataacttcgaacaacttcatgtcgacaatgctatcaatatgttggtggaattactcgagtgttggatctacgagcatttcccatctgttggtttcgccttagctgctgaggattatgatgagcgaagaccgcgtgcatgccgatggacctctggcaaggcattacccgtgtcgatgtatcataggcgtctggatagactgacccctaatgttgtgtgttgggttccttatgattga

SEQ ID NO: 18200 - DNA, 83 bp, Glycine max
  Peptide Sequence Number=SeqID_109885
cgattctgtggaattcttcatcgttcttcgtcgttcttcaccgttcttcatccgttcttcgttcgttcttcgttcttcaacgg

SEQ ID NO: 18201 - DNA, 306 bp, Glycine max
  Peptide Sequence Number=SeqID_109886
tgctcttgtatgcgaggtaactcttctgcaggcgatttagctccattagatttggagatagaagccacttgcaggaggaacaacacagagagaaagagaaaaattttgcaggaaaggacagcacaaccaaatttggaggaatctcaatcatctaagtcatcttcgatctttccagagttaagagaatcagaagtaggtgcatctgaagtttcaattatggctgaagatcaaccacaaagggttactcttgaggactattctagctccatcgtgctgcaattcttcacaagcattgtgcggccataa

SEQ ID NO: 18202 - DNA, 165 bp, Glycine max
  Peptide Sequence Number=SeqID_109887
atgtgcacgtgtgcaatttttggtagccaagatgctttgagtatgcataaaatggccccgaggaagcttgcctcaaagaggtccaggaaggacaaggcggccgaaggaactagttccgctcctgagtatgacagtcaccgctttaggagcgctgtacaccagtag

SEQ ID NO: 18203 - DNA, 81 bp, Glycine max
  Peptide Sequence Number=SeqID_109888
gttgcgacacttgccaacatggatgacgaggaactacctttacccgtgaactccgacgttgtcaagcgatactatgcttaa

SEQ ID NO: 18204 - DNA, 348 bp, Glycine max
  Peptide Sequence Number=SeqID_109889
atggtgtttttgagtgctccagtggcttctgtttctatcagctgtccctcctgttcagctactgacggggtggtgcgtaacggcaaaagcaccgccgggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 18205 - DNA, 1833 bp, Glycine max
  Peptide Sequence Number=SeqID_109890
atggatgccaaggtgaagcaaatgattaagcttattgaagaagatgcagattcctttgccaggagagtagaaatgtattataaaaaacgcccagagcttatgaaaatggttgaagagttttccagggcatatcgggcattggctgagagatatgatcatgcaactggagtgatctgccacgcccataagaccatggctgaagcatttcctaatcaagttcctatgatgctgagagatgatttacctgccgtttctccttcggagactgagccacatactccagaaatgcgacacccagatgcttctgctcatttccatgctatcaaaagaaatggtggttatattggtgaacccgattctccattgaacaaaaccggtttgaaacagctcaatgatctctacatccctggagaacaagaaaatcttccaaagtttgctagaagggggctcaatttttttgagatgcaggaggagagtaatcagcaaaaccgtggaagcaacaacactttgtctgagtctgaacgcgtgacaaaagatgagacagaaattttggccttgaagaaagccattgccaaattagaagatgaaaaggaagctggcttacttcagtatcaacagagtttggagaaaatttctaatctcgagttagaagtgtctactgcacaagagaattctcgaaaactcgatgagcgagcaagtaaagctgaagctgaagttcaagccttgaaggaagcccaaatcaaattacaagctgaaagtgaagctagtcttcttcagtaccatgaatgctgggagaaaatatctaatctggagaaaaatatttcttctttgcaaaaggaagcaggagaacttaatgaacgagctactaaagctgaaactaagtctgagtccctaaagcaggaacttgctagagtagaagctgaaaaggaagctacccttgttcaatataaccagtgcttggagacaatatcaaaactggaggagagaataaaagaagttgaggagaatgcaagaaggattaaggagcatgccaatatagcagaaaaagaaatcgaagctttggaattacaagttactaaacttaatgaagaaaaggaagatgctgctctccactatcagcaatgcatggagataatttccagtttggagtataagctctcttgtgctgaagaggacgtgcataggctaaattccaagatagttgatggggttgaaaaattacagagttcaaaacaaaaatgtcttctcttggagacatcaaatcacactctgcagtcagaattacaatctttggcacaaaaagtggggtctcaaagtgaagaacttaatgagaagcagcaggaattgggtagactttggggttgcatacaagaggagagactgcgattcattgaggctgaactgctttccaaactcttcagcagttgcattctcagtctcaggaatagcttagatctcttgcttttgaacttaacagtaaagtggaaatactggggaatgtggaatctcgttactttgctagttttcatcatcgtggttgcttttgctgtagtaatctggattgggataggaaagaatcccattgattctgaagtggcagctcagcccactcaaaaatgcaacagcttcttcatcaacaagtcatcgatgacatgtgaaggagcttcaatggaagaaggggtagggcttcaatgtaaaatcgctgaggtcaatgtcaaagaaagcgagggttcaaacgaaggagcaagcagaaagcgagggttcaaacgaaggagcaagcacaaagttctagggttcaaagcaatctcgaaagctagtagaaacagccgcgag

SEQ ID NO: 18206 - DNA, 663 bp, Glycine max
  Peptide Sequence Number=SeqID_109891
atggtcaaatccaaaggacaccatcacctttgcggcaccctcttccttccaacacctaggtctccaatcgcccattacaagttggagaaagagaaaatatggcgagagctagagaaggaaggaatcaggagagaaatcattgcttgcgagatggcatttgcacaacgacgagaactggaagatgaagtgagaaaagaactagaattggagagaacatttagaatctcgatgcaaagatcagatgggatcacatttcgagaaccaatttcagtgtcttttaatcacagtatgggtccattgaataatattaccatgtctggagggctaccattccatttactgtcacaagcttctaagcaaattaacaaggataaagtgattatactaaataagccagatgatcattgtggtgaaaagcgcaaagcaatgacacttgcaattgatgacaatgagagtctacagaagaaatccaagaaggagtggagttgcgagttgtgtcaaatttctgcaacaagtttgaaaggcttgaatgatattcaagggaaaaaacataaggctaacaaagaatccactagaactcaaaaaatagggctggattcaagaccagaaagtgaaacacttcatccttgtttaacacccccacacatgcaaactggaatctaa

SEQ ID NO: 18207 - DNA, 171 bp, Glycine max
  Peptide Sequence Number=SeqID_109892
atggatgccttagaaatttacttgaatgaagaagaaagacaattagatagaaaggtgaaagttgttaggtctgatagaagtgatgagtattacaaaagatacgatgaaattggacaacacccaggattcctagtaaggtatttccaaaggcaccttttgaagtgtgaatga

SEQ ID NO: 18208 - DNA, 288 bp, Glycine max
  Peptide Sequence Number=SeqID_109893
atggtgaaagttggaacctcctacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 18209 - DNA, 286 bp, Glycine max
  Peptide Sequence Number=SeqID_109894
aatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcatggtcagtatgacaaagatttatggggcggccgacaaaagcaaagctcttgctcctacgtatcctccaatgaggaactcagacctacgtagttctggataa

SEQ ID NO: 18210 - DNA, 656 bp, Glycine max
  misc_feature (16)..(16): n is a, c, g, or t
  Peptide Sequence Number=SeqID_109895
tgtatgatggtgtttntgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgttcaagacaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccggtgcgtcagcagaatatgtgatacaggatatattccgcttcctcgctcactga

SEQ ID NO: 18211 - DNA, 271 bp, Glycine max
  Peptide Sequence Number=SeqID_109896
ctacttgcactacaatacgatagctactgtgagcaagcccttttgcattgccatctactacctgcctgctccccatgaactagttgagggactagcccgaaggacccgaccggtctgctatcaacgagctactcacagagggactactatggatgatgagctaccagataaccccaaccccaactactatgatatagcagctggcagtaggggctggagtagtgaagatgcggttgaggcggggcagtggagcatctactcgttccactag

SEQ ID NO: 18212 - DNA, 225 bp, Glycine max
  Peptide Sequence Number=SeqID_109897
atgacagaaaccgtttgtatggataaacgcttgggtatctccatacgtcacctgacttcacgggtcaagatgacagaaagcacggaagagaacataatcacttgtgtatctccgcatgtcgtcggactcacgggtcacgatagcaaaaggtggggtggtcgacaaaagcgaggcttttgctcctacgtatcctccatttgtgatgaggaactcatacctacgtag

SEQ ID NO: 18213 - DNA, 330 bp, Glycine max
  Peptide Sequence Number=SeqID_109898
atggcagtcgaaaccaaatatgttgtggtcagaaagggtgaagagaagatgacgtttgccaataaaaaagacgcagatgcatgggacaagatgctcgatatggccgacgcgttcaccgactggctgcagcaacatcagccagcgatggatgaggcccaggccgaagcgctgggtatgctgctggccgaacagaaagacgcggtgcaacacattctgcgcaccagcaaactaccggacgcggtgaaagacagcggcgaaaccgctgctgacgacagcgatacggctgtgccggaaaaagagaagaaggtgcgtgcggtcaaagccgcctga

SEQ ID NO: 18214 - DNA, 255 bp, Glycine max
  Peptide Sequence Number=SeqID_109899
atgggtgccaagtacctcgaagtggtcaaacgagggtcgcatcccaacaacggatggtccccggatgaaattaggaatgagcataatttgtctctgcgtgttgttggacacgatcgagcttgggcggcaagacacggaatgaccataatttgtctctgcgtgacaccgggcacgatcgcctctggatggcgaaaaggtgcacggaatgactataatttgtctccgcccacctctcgacttactgtccctgaatga

SEQ ID NO: 18215 - DNA, 210 bp, Glycine max
  Peptide Sequence Number=SeqID_109900
atgtcgcggaactttacggattacctaatgatgggtgttaagtacctcgaggcggttaagcgacgattgcatgccaccaaacaatggtccccggatgaaattagggaggattctgaggattccgctctgattaaagtgttcctcttggtgtgggggtccaacagcaagcaacaacaacttacggtggccaccggtggtcttgggtggtga

SEQ ID NO: 18216 - DNA, 213 bp, Glycine max
  Peptide Sequence Number=SeqID_109901
atgggctcaaaaatctaccctaaggttcatgagaacccttgggccttctttagtagctctagcctaagcctcttggagtcttctatccaatacccttggggtcatactcccttgtctaagcctttggagcttgtccataagctctctttcatagtaggagggaatatgcctcttcctaagggaactcctaagatcactccaatactctactag

SEQ ID NO: 18217 - DNA, 814 bp, Glycine max
  Peptide Sequence Number=SeqID_109902
atggacatagaaaatataaaaattcagataaaaactttcttcggattggagcagatcttagctgaagagattaaaaaattaggaggacgaaatgttgaagttaaaaaccgcgcggtaaactgtgaaggagatttaggttttctttataaaatcaattactcggcaagaacggcattgaagatcctggtaccggtttttgaattcaaggcttttaatcagcatcagttttatgacaagctttttaagctggaatgggaacagtttatggatgtggatcaatcatttgcaattgacgctaccgtaaattcagagacctttaagcattcacaatttgttacattaaaaatgaaggatgctattgtggattactttcaggaaaaattcaaaaagcgccctaatgtggagcctaaaagtcctgatatcaagtttcatttgcatatcgacagggagttagtaacaatttctcttgattcttcaggtgatcctttattcaaaagaggatacagaaaagaacagggtgaggcacctattaatgaggtattggcaagtggaatgcttcagcttgccggatgggacggaaaaggaaattttctggatccgatgtgtggctcaggaactcttttgattgaagcagcaatgattgctatggatcttcctgcacagattttcaggaaaagatttgcgttccaaaactggaataattatgataatgatctttttaccaagatcaaggaattcagaatcaatagagtgaaagaatttcagggtaaaattgtaggatacgatatagacggaagaatgcttaacgctgccc

SEQ ID NO: 18218 - DNA, 213 bp, Glycine max
  Peptide Sequence Number=SeqID_109903
atggcaggaggcaacctccctaccacgaaatgggtatgccaccaaatgcttgcccctctgtggcatatccgaggggaggttcgaatgcggctaaagtgtggtctcggggtactttatgtgtctcccccatgggttgagggacctgtgcatgaccagagtggggatgttagctctcaatgggtatgggaacagagttatcgacattctcattaa

SEQ ID NO: 18219 - DNA, 417 bp, Glycine max
  Peptide Sequence Number=SeqID_109904
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccttatccaggatgtattctacctcagagtcgggaaacctgtcgtgccagctgcattaatgaatcggccaacgcgcggggagaggcggtttgcgtattgggcgctcttccgcttcctcgctcactga

SEQ ID NO: 18220 - DNA, 278 bp, Glycine max
  Peptide Sequence Number=SeqID_109905
gtttatgcctttcctgatcttatctggacaactttgtcctccaggaattgaagggactttatttgcacttttcatgtcaataaacaacttgggatccacagtggggtcttttgtgggtgctggcttggcttctatattgaacattgattcaggatcatttgacaatcttctcttgggcatcattgttcatgccttgtgcaatttcatcccaattgcttttctgtttctgataccgggtaccgagctcgaattcgtaatcatggtcatagctgtttcct

SEQ ID NO: 18221 - DNA, 408 bp, Glycine max
  Peptide Sequence Number=SeqID_109906
ggctgttcatgtgtcctccactttcgagtttggagctgtgtttcatgattgcctaagtgaggaccctcaagacaatcctccattctcaccctttttcggagcccatgaatgtcattgcctagcgttgttcatttgtcctcctttatcaagcgcaaagcctctggtgactgggaagcacaagaaaaaagaaggagtagagacgagagtcatcatcacggaaagggcagggcggacgaaatcagtgtcctatctttgctttcctcttatctccgatgagaggcttgcgcgatccgtgaaattccgtaatgtggcggaaatcgaaaagagacccacttgggccctccagaagattcctccagaaggccgttgcttctggaggaagcaaccttgctcgcctgggcgagctgg

SEQ ID NO: 18222 - DNA, 408 bp, Glycine max
  Peptide Sequence Number=SeqID_109907
atggaatgtgtgaagattaacactctttggtctggtgatattgattgtgatggccatggttttgaggccaagcttctttgtcacaaggacaagccaggaattgtggatgtgaacataggttctacatccattgtgatggggttttgtttggtctcatgcttccttttgtcaaacgtcaaccaggccctatggccttccggattcttcctccagaaggcggttgcttctggaggaagcaacctggctcacctaggcgagctgggcggcaagctcctcccctattttgctataaatagggggaggaatgaagagggaaagggttcaaccttcttggcacttcgtattttcttaaaattgctgaggaaaattgtttccgtgaagaaaatccaagccgaggcgcttccgtaa

SEQ ID NO: 18223 - DNA, 297 bp, Glycine max
  Peptide Sequence Number=SeqID_109908
atgtattgtactccttcacctgctcatcaaactttttgccagactggcaagttagtcaatgcaactagccatgaatggatgaccaatttatttggtgtcaatttgaatacaccaaattttatgacatcatatttagcttccttacaacaattcgatgcgccatattcgtttggagagcaaggaaaaagttctctagctacaacaacccacactgaatacactgacatagaacaacagcatcatcatcatgagggagaaccagtcatacatgaaagaagaaatccacgacataattga

SEQ ID NO: 18224 - DNA, 450 bp, Glycine max
  Peptide Sequence Number=SeqID_109909
atgacaattgaggaatcaagacatgttacttttgatgaaactaatattacctccccgagaaaggagtttgttgatgatattgcagatactttggaagattctcaaaatgaagaaagaaatctgaaaagaaagagagatgaagaagacaaggatgatcaagatgacacggcacaagaaaatgataatcttcccaaagaatggaaaacttcaagaaatcatcctcttgacaacatcatcggtgatatctcaaaagggcaatctgttgcttctggaggaagcaaccttgctcgcctgggcgagctgggtggcaagctcctcccctattttgccataaatagggggaggagtgaagaagaaaagggttcagccttcttggcatttcgtattctcttaaatttgctgaggaaaattgtttccgtgaagaaaatccaagccgaggcgcttccgtaa

SEQ ID NO: 18225 - DNA, 368 bp, Glycine max
  Peptide Sequence Number=SeqID_109910
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtatacggttatccacagaatcagggataacgcaggaaagaacat

SEQ ID NO: 18226 - DNA, 696 bp, Glycine max
  Peptide Sequence Number=SeqID_109911
atgtcctcaccttcagaggactacacgtcctcaccttcagagggttgcacgccctcacctttagaggactacacgtcctcgccatcagaggactacatgtcctcacctttagaggactacacgtcatcaccttcagagggttgcctgccctcaccttcagaggactacacgtcctcaccttctgagggttgcacgccctcaccttcagagaactacacgtcctcgtcatcagaggactacataggactatgcatcctggccatcagaggactacgtgccctcaccttcagaggactacacgtcctcacctttagagggttgcacgccctcactttcagaggactacacgtcctcgccttcagagggctgcatgccctcacctttagaggactacgcgtcctcgcctttagaggactacacgtcctcgccttcagagggctgcatgttctcacctttagagggctacacgccctcaccatcagagggctgcacgccttcgccttcagagggttgcatgtcctcaccttcaaagggctacacgccctcgcctttagagggctgcacgccctcgccttcagactacacaccctctcctttagagggcgacacgtcctcgccttcagagggctgcacactccctcgcctttagagggctacgcgtcctcactttcagtgggctccatatccatgccttaa

SEQ ID NO: 18227 - DNA, 930 bp, Glycine max
  Peptide Sequence Number=SeqID_109912
atgactgtctctctcgatgagtcgatctctagctttctcataagggtggatccttgggtactagtacctatcgcctttagaggactacacgtcctcacctttagggggttgcacgccctcgcctttagagaactacacgtcctcaccttcagagggctacacgccctcgcctttagaggactacacgtccttgccttcagaggactacgcgtcctcaccttcagaggactacacgtccttgccatcagaggactagacgtcctcgcctttaaaggacaacacgtcctcgccatcagagggctgcacgccctcaccttcagaggactacgcatcctcgccatcagagggctgcacgccctcacctttagaggactacatgtcctcgccatcagagggctgcacgccctcacctttagaggactacacgtcctcaccatcagagggctgcatgccctcacctttagtggactgcacgtcttcgccatcagagggatgcacaccttcaccttcagtggactgcacgtcttcgccatcagagggatgcacaccctcaccttcagaggactacacgtcctcgcctttagagagctgcacgctgtcaccttcagaaggctgcacgccctcgccttcagagggctgcatgccctcgcctttagagggctacacatcctcactttcagaggactacatgtcctcgcctccataagactacatgtcctcgccttcagaggactacacgttctcttctttaatgggctacacgctctcgcctttaatgggctacacgccctcgcctttagaggactacacatcctcgccatcaaaggactacacgtcctcgccttcagagggtttcacgtcctcaccttcagagggctactcaccctcatcttcagaggactatacgtcctccccttaagaggactacat

SEQ ID NO: 18228 - DNA, 357 bp, Glycine max
  Peptide Sequence Number=SeqID_109913
atgaaggcccaagtggagaaggatgaaggcccagaggcagagacactatcaagactattaattgctgctgaaggcccaagtaatccttgtggcgtctacccagacttatcttccttaaccggaagtggcgtctaccctgacttatcttccttcattggaagtggcgtctacccagacttatcttccttaaccggaagtggcgtctacccagacttatcttccttcaccggaagtggcgtctaccctgacttatcttccttcaccggaagtggcgtcatccaaaccttcgtaacctgtatcaaacgatccgctcctactcatgttcacatcatctggtatcagagcttcggctcttga

SEQ ID NO: 18229 - DNA, 246 bp, Glycine max
  Peptide Sequence Number=SeqID_109914
atggcagagccatcgaagaagagaaagggatcatcctccaccgctgctgctgctgcccatcgccgccacggaccatctgaagcatccacagcacctactcatccatctttatcatctccaagatcatcaacattgttttcttccgatgatcagcgtctacggtacctttctcagttttcttctagaatcatcttagaccctaagtacctagacgtagaattctttaatgatgggggatcctctaga

SEQ ID NO: 18230 - DNA, 852 bp, Glycine max
  Peptide Sequence Number=SeqID_109915
atgggccgtatcgtagaaatctacgggccagaatcctccggtaaaaccaccctgacgctgcaggtcattgccgccgctcagcgcgaaggtaaaacctgtgcgttcatcgatgccgagcacgcgctggatccggtttatgcacgtaagctgggcgtggatatcgacaacctgctctgttctcagccggacaccggtgaacaggcgctggaaatttgtgacgcgctggcgcgctccggtgcggttgacgttatcgtggtcgactccgtggcagcactgacgccaaaagcggaaatcgaaggcgaaatcggcgactctcacatgggcctcgcggcacgtatgatgagccaggcgatgcgtaagctggccggtaacctgaagcagtccaatacgctgctgatcttcatcaaccagatccgtatgaagattggtgtgatgttcggtaacccggaaactaccaccggtggtaacgccctgaaattctacgcctctgtccgtctggatatccgccgtatcggcgcggtgaaagagggcgacgaacgtgcgccgtttaagcaggctgaattccagatcatctacggtgaaggcatcaacaccttcggcgagctggttgacctcggcgtgaagcacaaactggtggaaaaagccggtgcgtggtacagttacaacggtgataaaatcggccagggtaaagcgaacgctaccaacttcctcaaagagaatccggcgattgccaatgagctcgacgttaagctgcgtgacatgctgctgaccggtgcgacggcggaagcggcgacagcggatagcgcggccgataaatacgaagaagccagcgaaaccaacgaagatttctaa

SEQ ID NO: 18231 - DNA, 276 bp, Glycine max
  Peptide Sequence Number=SeqID_109916
atgatttttcacttaaggcttgtaatgagcttcaaaacaaagaatggggaacataggctcaaaagggctatcaaaggatttaatttacaaccctttgatcctaaaatagatagaacctttcatagattagttaggcatagtgtgcatcctgatcattttgagcattttgtgcattttgtgcattctgagcattctgttgctggtgattctgaacattctgattttgagcattcggctgctaattttcatactgagaacatggctcaacctccatga

SEQ ID NO: 18232 - DNA, 61 bp, Glycine max
  Peptide Sequence Number=SeqID_109917
aacttgtaaagggcttttgcaagatagtggaactctcaagcgggttgcttggggactagac

SEQ ID NO: 18233 - DNA, 577 bp, Glycine max
  Peptide Sequence Number=SeqID_109918
tgccgagcaccagcagcgcttcgaggccatcaagggatggtcattccacaaggagaggcgtgtccaactcagggaagacgagtaccctgacttccagggagagatagctcgcaggcatagggcacagctagtgacctccatggctaaattcgacccggagatagtcatagaattttatgccaatgcctggcccactgaggaggaggttcgagacatgcgctcatgggtgaggggtcactggatcccctttgatgcagatgccatcagccagaggagccaggcagacggtttcgatgaggaagccatcgcccaactgctgtgcataccggggcaggatttcgcccggaccgctgcggggaggtgggtgcggatcatgcgcaccagcatgactaccttgacccagatatggatgacactgctactcagcaatgtcttgtctagcaaccacaacttcgacctccctctgcctaagtgccagttggtgtatgtcatcctgacacagatgagcgttcatgtggcccaggtgattgctgatgccatttatttgtttgctggaatggcgcctactaggctctaa

SEQ ID NO: 18234 - DNA, 387 bp, Glycine max
  Peptide Sequence Number=SeqID_109919
atgatgaacgagagtggggcgccggccattgaatggagctatggcggccggggtgatgatatcagcagcagcctgagcctcgacacggttgaggagcagccgcagggtttcttgatgacggtcgatcggccggtgcagatctttaaagatgcgctgtcgccgatgatggcctttgtcacgctgctgcgcccgctgtacgccaaaacgagcgagggtttccagtacgtgccggtcaacgccgggctgttcttccacggcgccaagccgacgcactataaagatcgcgacggccagatgaaaccgatcgacggcggcacgcttttgcagcacatcaccgtgctgcatcaggtggcgcagccgctcggcccgggtgaaggcgccgtctga

SEQ ID NO: 18235 - DNA, 360 bp, Glycine max
  Peptide Sequence Number=SeqID_109920
atggagttagatttcatacaaagacacgtgaaagggaatgatatatgtgacgatccatttgtttttgcatctcaagctaagaaagtattttatgtggagaataaaacacaaaatggttggcttgttgttgtgcatgctaaaatcagagatgtatatgatatgggtgatgagcaatccaatgacacggatcaagggaatgaacaagtcttacaagagataaatcataatgatttgatcagaccagaagccgatgatagtgatgatatcattgaagttacaatacctatggagaacattttaccacataacaaggatgataattatatagatgatgatgagagcgatgcagacttcttttga

SEQ ID NO: 18236 - DNA, 243 bp, Glycine max
  Peptide Sequence Number=SeqID_109921
atgaatttgtttcctgagacagacataatgaaacaaagggtacatctaacatccttggagtttccacaatttcaaggcaacctgaggattgagaagggattaggggagtgccaacagcttaagggaattgcgcattttcattttattttgagaataggagttgaaggtcagaggaagaacatggagaaaaacaatgttagtaaagatagaagagcttataaacaaaaagaaaaagaaaggtga

SEQ ID NO: 18237 - DNA, 479 bp, Glycine max
  Peptide Sequence Number=SeqID_109922
atgggatcaagtcaaaagccttcgcttaaaaagaggttctatcaagtcaaaatcaagagcttagaggtcaccagtttacgaaagttggggcaattaatgggtcaacttcaacggcaagccttccacaaagcctatggtaagatttgggacctagctagggacttccagctagtgccgactgtgaaagagtttgaagaaatcctgggatgcccactgggaggaaggaagccatatcttttctctaggttctatccctccacgacaagagttgccaagtaccaaggaagtgtttggaggaaagggcaaaggccttggaaaatcaaagcaaatgggctttcttttattgacatcttggcacttttgatctttggagttgtcctctttccgaatatggaagggttagtggacctagcagtgattgacgctttcctcgcctttcatcatggcgaggaaagcccggtcatcgccattttggccat

SEQ ID NO: 18238 - DNA, 714 bp, Glycine max
  Peptide Sequence Number=SeqID_109923
atggccgccacgcgcgcctccggcaccaacgccgtgcgctacggcaccatgcgcgaaaacgtcatgtcgctgaccgtggtcaccgccgacggccgcatcgtgcgcaccgccggccgtgcccgcaagtcgtcggccggctacgacctgacccgcatcttcgtcggcagcgaaggcacgctcggcatcatcaccgaagtgacggtgcgcctgtatccgcagcccgaggccgtgtcggccgcggtctgcaacttccccacgctcgacgccgcggtgcaaagcgtgatcgagatcatccagatgggcgtgccggtggcgcgtgtcgagttcatggacgcggccagcgtgcgcgccgtcaacctgcacagcaagctgacgttgcgcgagacgccgctgctggtgttcgaattccacggcagtccggcgggcgtgcaggagcaggccgagaccgtgcaggccatcaccgccgagcatggcggcatggacttcgaatgggccgagcgccccgaggaccgcagccgcctgtggaccgcgcgccacaatgcctacttcgccggcctgcaactgcgtccgggatgccgcgccagcaccaccgacgtgtgcgtgccgatttcgcgcctggccgattgcgtgcgcgacaccgtcgaggaactggaccgggccagcttcccgtacaccatcgtcggccacgtcgcgacggcaatttccacgtgctga

SEQ ID NO: 18239 - DNA, 393 bp, Glycine max
  Peptide Sequence Number=SeqID_109924
atgcaatcaatctgggcacatgagattcaattgtcctgtcttcaaaagaagaatgaaaaatctgacaagaggaatttcaaagaaaagaaagaaaagaaaggatacatcacttgggaagataatgtcataaattattcaagtgattcagagaagaaaatcataagtctgggtatcatgatgaaagactatgtaaacggagaagagcaaagtcgatacattgatagcaatttctccaaacacatggcatgcatcaaagtttattcacatttcttcccaagaaaattggaagttggaaatggaagttattggaagttgaaagttgaaaatggaagtttgaagttgaaagttggaaggggaagttactggaagttgaagttggaagttggaagttga

SEQ ID NO: 18240 - DNA, 603 bp, Glycine max
  Peptide Sequence Number=SeqID_109925
atgaatatattcgatcactatcgccagcgctatgaagctgccaaggacgaagagttcacactgcaggagtttcttaccatctgccggcaagatcgcagtgcttatgccaacgcggcagagcggctattgacggccattggtgaaccagtcatggtcgatacggccctggagccgcggctgtcccgcctcttttcaaaccgggttgttgcacgctatccggcgtttgaagagttctatggtatggaagatgccatcgagcagattgtttcctatctgaaacatgctgcgcagggtctggaagagaaaaaacagattctgtatctgctggggccggttggcggcggtaaatcctcgctggcggaacgcctgaaatcgctgatgcaaagggtgccaatctacgtgctgagcgcgaatggcgaacgcagcccggtcaacgatcaccctctgtgcctgtttaacccgcaggaggacgcgcagatcctcaataaagaatacggcattcctaaccgttatctcggcacaattatgtcgccgtgggcggctaaacgcctgcacgagttcggcggacatttcggcgctggtggggaaagtggatatccgtaa

SEQ ID NO: 18241 - DNA, 324 bp, Glycine max
  Peptide Sequence Number=SeqID_109926
atgggtgaagtagagggaggtacaagagaagatgaaggccgacatggaggccatgaaagagcaaatggccgcaatgatggaggccatgatgatcatgaagaagataatggaagccaatgcgctatggtaggcaaagatttgggaagtacgggcggcccccatgatgtgcaaattcaaaacgagcacgccttcccgccatatggcttgcctctcaactatacgccacccaatgtggcgtacactcccaataagaatgtcaataactccactcctatacctattgagagccaacaaccccaaactgatcatgcacatgtctcttaa

SEQ ID NO: 18242 - DNA, 507 bp, Glycine max
  Peptide Sequence Number=SeqID_109927
atggccaagttcgatccagaaatagtccttgagttttatgccaatgcttggccaacagaggagggcgtgcgtgacatgagatcctgggtaaggggtcagtggatcccgtttgatgccgacgctatcagccaactcctgggatatccgttggtgttggaagagggccaggaatgtgagtatggccagaggaggaaccggtctgatgggttcgatgaggaggccatcgcccagctgctatgtataccgggacgggattttgcccggactgctgcagggaggcgagtgcgaatcatgcgcaccaacatgaccaccctgacccagatatggatgacgttgctccttagcaacatcctgcccagcgatcataattccgacctccccctgccgaagtgtatggcgcctaccaggcaccctttggacccagataagtccaacagagccctgggatttcccgcactgatcacaggactctgccagtcgttcggagtccctgttgcacctaccaag

SEQ ID NO: 18243 - DNA, 501 bp, Glycine max
  Peptide Sequence Number=SeqID_109928
atgaacgcgctaagcatagctgtcgcactaagcgcattcatcttctttgttgagttatctgttgaactcgctaagtatggttcaagcttcatgaagatgaaccaagcaattttgatgatgccaaaagcccaagtgattgattcaagacttcaagatcaagcatcaagaatccaatccaagattcaagattcaagagaagaaatcaagaagcaacaagtcaagacttcatataggataattggcagtaatcgattaccagttgtcgcaacctacctttcggcgggagggcgacgcggggcttgcgggtgcgtcttccaagggaggaaaatgtgcggagccgccaccaacatttatttgaggaaaacgtcggaaaaaccggaaaaggtgtggtctacgaactttaatcgtgaaaggttcgggagttgtttttacgcacgaggaagggtgtttccctcgctcctacgtatcctcaattacgatgaggaaatcagacctatgtag

SEQ ID NO: 18244 - DNA, 837 bp, Glycine max
  Peptide Sequence Number=SeqID_109929
atgggtaaaggtaaattggaactaagtgtagaggatcagaagatctcctttaacttatttgaagcaatgaaacacccagatgatagtgaggcttgttttgaagaagacacgttggagcaggagatggaattaacagcctcagccatggtattacagtctcctttggaagaagaatccaacaatgtgatagaatgcctagtcagtgaaaatgaaggagaagagctagcttgtattgaagagctggatggtccagaagataagtctgctggtcatgtgatgtttgaagcatttgaaaacaatagaccaatggaaaagcccaaagttgaactgaagacccttccagtacatttgaaccaattacatgcccgtgagacaacctcaaagaaggctgaatccaataatgaaagaagaagtaaggaaggcgtgttgaagttgctagaagcagggcttatctacccaatctcagacggttcctgggcaatctttctattgtttcttagatggatatttgggctacaatcaaattgcagtggaccctcaggaccaagaaaagacagctttcacatgcccctttggtgtattttcttatcatcgcatgcccattttggctgtggagagactgagagagagctgagcttgacgaggaaaccatcttgtggagcttttgatgagatttttagagattatgaggaagcttccctgctatggagagctaaaccctcagttggttcttcctatggggtacttgattactcaattctagtgtgcctttgccttgatcacgtaactgcatgcttagttagggtcactcacattgggaaatggtttaatccttag

SEQ ID NO: 18245 - DNA, 243 bp, Glycine max
  Peptide Sequence Number=SeqID_109930
atgtcattgcctagcgctgttcatgtgttctccattatcaagcgcgaagcctctggtgactgggaaacacgttcttctgttgttttcgggatcggttccttcgccaaatatgtgtatatgtatattatattcgttgtgttgaaaaaagaagaagtagaggcgagagtcgtcatcacggaaagggcaggacggacgaaatcagtgtcctatctttgctttcctcttatctccgatgagaggtaa

SEQ ID NO: 18246 - DNA, 453 bp, Glycine max
  Peptide Sequence Number=SeqID_109931
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgagtgtgttgcggtggagaaagagaaatgcaaatccgaaaggagaagaggtaaatgtggtggtggaggttga

SEQ ID NO: 18247 - DNA, 363 bp, Glycine max
  Peptide Sequence Number=SeqID_109932
gcgtttcagttccagcgcgccaacgaaatcagcaacgcggtgactcagtacggcatcaataccgacgcagccacccaggggaaagaaattgaataccggacgatcctcaagaaacagccgacgtgcgatctggctgtgcctgccgctattgctggtgggctgctcgactacacgtaccgtctacgttcccgcgcaatgtcagccaataccggcgacgctgacgcaaccggtactggcgccactgcctccagcaccctgacttactgccaagcagttctatggattgcaccattgctcgcagcacttgataaggcgaacaaccaaatgttggaaattcgcaaacttgatatgatgttgcggtag

SEQ ID NO: 18248 - DNA, 291 bp, Glycine max
  Peptide Sequence Number=SeqID_109933
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggatggttccagccaatccatctcattccttaaccttgttgattttggccgacctttcgcacgaattgtaattggatcagggataagtgtccatggctcatcagaaggagaaatagccgcttcattcccaagaggccaccattgcgcgaaataa

SEQ ID NO: 18249 - DNA, 813 bp, Glycine max
  Peptide Sequence Number=SeqID_109934
atgccgatctccccttgtggaagtatcaattggtctgtgtcgttccgacgtagggatcgtgcccaaaagacacccagtagacccggagaagtccaacagggccctggggtttccagctatggttatgggcctctgtcggtcctacagggtgcccgtcccccccagcaaggaatcgcgcccacaagacacccagtggacccggagaagtccaacagggccctagggggtagcgcccacaagacacccagtggacccgaaggagcccaacagggccctggggtttccagcatgggtctctgtcagtcctatagggcgcccatccccccaccaagttcatgccatcgtgacatagggatcgtgcccgtaagacacccagtggacccggagaagtccaacagggccctagggggtagcgcccacaagacacccagtggacccgaaggagcccaacagggccctggggtttccagcatgggtctctgtcagtcctacagggcgcccatccccccaccaagttcatgccatcgtgacatagggatcgtgcccgcaagacacccagtggacccgaagaaggccaacagggtcttggagttgccagctctaattacgggcctctttcagttctgtggagtgcatgtcgcccccagcaaggtcatcaggctccctactaatcgggctttcatcaagaagtactgtgcccccaggcaggcgcagcgcgagacaccacagcagcctagggatgaccggcaatgggcaacaaacacactgcgaccacctctagagttcacctcagctcatccacaaaaaggttag

SEQ ID NO: 18250 - DNA, 78 bp, Glycine max
  Peptide Sequence Number=SeqID_109935
atggatgaaattaatggtgatgttgaaaaagaagagaaagttgttttggatttcccagtccatgactctaatgtttaa

SEQ ID NO: 18251 - DNA, 252 bp, Glycine max
  Peptide Sequence Number=SeqID_109936
atgttactggagtatttagttttctgcctttgccctgttttgcttggtttgcttgagaggattgatggggacccggcgttgagaggaacgaggataagggctacgtgggagtacgtgagctcaattggaggtgggcaacaggggatggtgggtttatacgtgatttgtggatgtggagaattgtcttgcaccattgctcgaccgccacctagtaccacatgtgatgggtaccccataatcctacaagcttga

SEQ ID NO: 18252 - DNA, 323 bp, Glycine max
  Peptide Sequence Number=SeqID_109937
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccaccagccttcccagctttctcgtctggggaggagtctgatccagagggaattagaaacgatcacgtgcaggggagtttccatggacaaccctag

SEQ ID NO: 18253 - DNA, 261 bp, Glycine max
  Peptide Sequence Number=SeqID_109938
atgggtattttaaggcttttcattcctctggtaatcgattacacaaacctggagctcgcctgtttaggtacatcacaggttctcactgaccgaccatgcccgggttgggtcgggattggtcaagcttggttttgggcaatagcaccccacctgacgtccccaaggtctcctgacccctgcgacatatctcccggtaccactctgtggtcaacgaataaaagcaggaagtttcacccttctacacttcctcatctcaagctt

SEQ ID NO: 18254 - DNA, 327 bp, Glycine max
  Peptide Sequence Number=SeqID_109939
atgccttccagcttcacggacttggtattcgccggggaaagaattgaagaagggttgaaaagagggaagttcgattacgtttcctccacaagtacccatgctaaaagaatcggagcaactggggcaaaaagaaaggagggagatacccatgccgtcacttcagcgcctgcatgggtcaagcccccgcagacctctcatggaacacatcaatatgcacaacaccatccggcttttcagtttgccccgggaactcctccaattcagcacccgtgcagcctaaggcacccatccagagggaggccccccaagttccggctccaaccatga

SEQ ID NO: 18255 - DNA, 449 bp, Glycine max
  Peptide Sequence Number=SeqID_109940
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccacgaaaacgcaatgcatggggctccgaaaaaaagggcgaggatggaggattgcactagagggtcctcactagtcaatcatgaagcatag

SEQ ID NO: 18256 - DNA, 213 bp, Glycine max
  Peptide Sequence Number=SeqID_109941
atgagattatcgatgatagatggaaaatatgaatgtgcatataataacaagggggaccctaaggctccattagagcttgtaggcctaggatcttcttcatcaatggattcctttgcttcttggaagatgaatgacagtggaatggagaaggaagagagagaggagatgccacttcaaggagaagatgagtctagaagaagatcaccaccatag

SEQ ID NO: 18257 - DNA, 396 bp, Glycine max
  Peptide Sequence Number=SeqID_109942
atggaatctaagccaattgaatcagcaaccgctggtacactcaagctccatttcaaggtgagagtgaaccttctggctgattcaatatcaccggagtctgctcagggtccaaaccagaagcgaagtttctttctacgatacactggaatcgggtctatcttaagcgggaagaaagcctaccgacggaatagggctctggagttcataccacccggcgactcttcccccggcccagtagtggagcttgaccctcgccctacgccgattgagatctttccttgtgcggtacaggtaaattttgctcttgagggaatacccggttcatcggaacttcaaccagaagaggtaggctcgggttcctggtataggtataagaaagccagtagagctaaatag

SEQ ID NO: 18258 - DNA, 510 bp, Glycine max
  Peptide Sequence Number=SeqID_109943
atggcgttgggcatggcgctggtgccggaagacaggcaggcggagggcttggtgcagatgatgtcgatcaaggccaacatgaccctggccagcctggggcgcaacgcgctgcggccgttggcgtcggccggggagtgcgcgctggtcgacggcatgatcgaaaaactggcgatcaaggtgagtgaccgggagctgccaatcaccagcctgagcggcggcaatcagcagaaagtggtgttgggcaaggcgctgctgaccgggccgcaggtagtgtttctcgatgagccgacgcgcggaatcgacgtcggcgccaaaacggacgtttatcacctgattggcgcaatggcacgccaggggttggcggtgatgttctcttcgtcggagctggatgaggtggtctcactggccgaccgggtgatggtgatggcggacgggaaactgacggccgatctgccgcgcgaacgggccgatcgcgaaacgctgatccgcgcctcaaccccacacgcataa

SEQ ID NO: 18259 - DNA, 885 bp, Glycine max
  Peptide Sequence Number=SeqID_109944
atgtcctcaccatcagaggacttcacgtcctcggctttagaggactacacgtcctctccttcagacgactacacatcctcgccttcagaggactctaaaggactacacatcctccccttcagaggactaagtgtcctcacctttagaggactacaggtcctcggcttcagaggactacatgtcctcaccttcaaaggacatcacgtcctcgacttcagaggacaacacgtcctcacctttagaagactacacatccttgccttgagagggccacatgccctcgccttcgtagggctacgtgtcctctcctttagaggactacacgtcctcgactttagaggactacatatcctcaccttcagaggactacacgtcctcaccttcagaggactgcacaccctcgccttcaaacggctacacgcccttgccttcagaggactccatgacctcgcctttagaagactagacatcctcgcctttagagtactagacgtcctcgccctgacgactacacatcctcaccttcagagggctacacttcctcgccttggagggctacgcgcccttgccttcagagggctacgcgcccttgccttcagagggctacgtgcccttgccttcaatgggcaacaagtgctcacctttaggggactacacatccccccctttagagggctacacgccctcacattcggaggactacacgtcctcgccttcaaagggctacacgccctcgcctttagaggactacatgtcctcgccttcagagtgttgcaagctcttgccttcattgggctgcacgtgcttgccttcgtagggctacacgccctcgcctttagaggatcacacgttgatgcaatcctaccccccaagggtattggatag

SEQ ID NO: 18260 - DNA, 444 bp, Glycine max
  Peptide Sequence Number=SeqID_109945
atgggaaatctacaaagacaaggatacaaccaaggaggattctcaggtttccaacaaggtccctacaatcaacaaggacaatggagatcacaccctggtaatcaattcaataaggaccagggtggaccttccaacaggtcgcctcaacaagggcctaacatcttccagaggactaccaaactagaagaaaccctggctcaattcatgcaagtgaccatgttcaaccataagagtactgagtcagccctgaaaaaccttgagattcaggtgggtcaactggccaagcagctagctgagaagtcatccaacaactttggagcaaatactgagaagaatcccaaagaagagtgtaaagttgttgtaacaagaagcaggaagcttgtggcggccaaggatgaggatgttgttgctttgaagaagcaagtttctttcaaggacactact

SEQ ID NO: 18261 - DNA, 414 bp, Glycine max
  Peptide Sequence Number=SeqID_109946
aatatagcgaaacgcctctttgcgagggccaattcctgccgggtgctcgccaacaagcttccagccttgatggaagaagctggctcggcagccgttagagtgatcgatctctttaccctgggcgttgagcgggatagtgccgtcaacgcggttatagcagaagctggtaaatggcgcgttccagccagcgaccgcatcgctttccagactctgccagcgcggatcggttttccaggaggcgctaagcaggataaaggtcgagaacaggctgccgaccagccctattgtgccccagcgcgtatcaaccagtgcggtacagatgaggaagccggttatcatattgacctggaagctcatacgggtgcggttataaacaatccgcgtttcgccccagtggatatagccatcgcgcca

SEQ ID NO: 18262 - DNA, 402 bp, Glycine max
  Peptide Sequence Number=SeqID_109947
atgtggcaggcggagataccttatggtcgtctgcaccttttatcaatcgaggcgaatgagttcgacggtatcaggatgatgttgtttttactctcgtcgtccggagacattcaagcccggcgacgcacgagattcttctttgctgggcgggggcgatcaagttcaatagcgtggggaaatgtcgtggttatcccactttatcactttactctcgtcgtccgaggaccattgtttggtggcattcaaccttcgcttgaccgcctcaagggggttccaacagaaggcggtgccttctggtggaagcaaccctactcgcctgggttagctgagctcacctgggcgaactgggcggcaaccacctccctcttttctcctataaataagggaaagagggctgattga

SEQ ID NO: 18263 - DNA, 133 bp, Glycine max
  Peptide Sequence Number=SeqID_109948
atggaaattcaagcagaggaaaatagagctaatcagaaggtggagggatttaaacaacagctggttgatgaactggcgttggaactggttgatgatttagttgaacttgaagaaattgttgagaaagcagaag

SEQ ID NO: 18264 - DNA, 609 bp, Glycine max
  Peptide Sequence Number=SeqID_109949
atggtggagaatattagctcatccagattccctcatggcaagactcctaaaagcaaaatattttcccctgacctagcctcttcaagcccgtgcaggtcactacccgaactatacttcggtgggtgctggaaggaaacgcttatcagaagcatcttttctgaacatgatgcccaacaattccttggaatccctttgaggatgttccctgaccaagatagagtggtgttgaaatattcagaggatggatggggagtacacggtaaaatcaggataccatgtgacaatgaagaatatggaaagagctccaaacattcaccagtgctatttctggattttttttggaaagacatcttgagtgttattgttgctccaaaacgtaggaacttggtatggagaacccgtaaaggaattgtgtcagtaaggaaaactctccgaaggaaaatccaagtcttagatcccatttcccctgctgcggagaggatgaagagacaattgaaccctgcttcatgtattgtgaaaaggtccaacaaatatggtttgcaaatcagctgggggaatctctgggaaatcagcgcacatcgtttaatacttggctggtatgatgcttag

SEQ ID NO: 18265 - DNA, 357 bp, Glycine max
  Peptide Sequence Number=SeqID_109950
atgaaaagcattccctggaggtcgccaaactcgtgctcttcgacggcggaatcaaatcctggcggcgtgaatcacgagacagcgagtggaagagaactaaaggaacaaaatccccttgtcgtggtcgtgaaagtagttcattctcctccgctcgaaccactccttcgactcctcatcatcgacgagcagcggcacatcgaggttgccggaggcaaaggcattgaagtcgatgacgcggttgaggagctgcgcagaatcgtcgtgccgccgcgcgatgaagccgatgaccaccacgccgtcggaggaacgagggagaaatgcgcgattaagtattctaaaattcctaaccttttctaa

SEQ ID NO: 18266 - DNA, 333 bp, Glycine max
  Peptide Sequence Number=SeqID_109951
atgcatcctccaccaacttattcgaagccccatgaattgattgtcgttcatgcatcctccaccgttgagtccgaagccccacgaattgattgcatagcactgttcgtgcatcctccaccatcaaatcttattcggagcccctttgtcgcaacctacccttcggccggagggcgacgcgtgactcgcgggatgcgtgttccacgaaaggaatacgctgggagtcgccaccaacgtttatttgaggaaaacgtcggaaaaaccggaaaagacgcgatctacgaacttttaagtgaaaggttcgggagttgtatttacgcacggggacgatattag

SEQ ID NO: 18267 - DNA, 156 bp, Glycine max
  Peptide Sequence Number=SeqID_109952
atgatgaggcttcactgttatcaagcgagtcggggacctagcatgaccacagatcgacctctactccctatggctaacacagacctgggtatagggaccaatatctcaaagtgtgtgcaaaaagtgtgggtgtcatgtgtgaacggagcaacctaa

SEQ ID NO: 18268 - DNA, 237 bp, Glycine max
  Peptide Sequence Number=SeqID_109953
atgacgtgcgaccattctttggtcctcgtgaggtgcttggcacccatcattaggcaatttgtgaaattccaggacatgccgaaaaaaccaaaaaatattgatgcacaatccgcccacttggccctccggatattccttcagaagcggttgcttctggaggaagcaactggctcgcctgggcgagctgagctcgcctgggcgagctgggcggcaaccacctcccctattttgctataa

SEQ ID NO: 18269 - DNA, 225 bp, Glycine max
  Peptide Sequence Number=SeqID_109954
atgagagaaaaggaaagaaagcctcaagaggctaacattaacctcccatacttccatgggaaggacaatgtagaggctaatttagattgggaaataagggtagagcaacaacttaaaaggaagtctacttcaaaatcttatggctctcactcttatccaaagaaagaccaaggtcaaggaatcttaggggtgagaccttctaagcccaaagaaaaagtcaattag

SEQ ID NO: 18270 - DNA, 225 bp, Glycine max
  Peptide Sequence Number=SeqID_109955
atgagaaagcgcacgcttccgaaggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 18271 - DNA, 210 bp, Glycine max
  Peptide Sequence Number=SeqID_109956
gtccccagtggagttgccaactgtcgcaacatgcccttttgcgggcgagcgaaggcgaggctcacgggtgcgctttccaaaggaggaaagatgcatggagtcgccaccaacgaaggtattagcacttcttacgtcgacaaaagcggggctcttgctcctacgtaccctccatcgaagaggaaatcagacctacgtagttctttcttaagg

SEQ ID NO: 18272 - DNA, 180 bp, Glycine max
  Peptide Sequence Number=SeqID_109957
atggtccatgacatctttgtcaaggtgaatctggaagtaacaaggtcatcaacaatcttaaatgtgtttggcagtagacgaagcagtgataggaaaatgcaaggatcacgcatgagcgaacatgaaaacaaaaggtatgcagtttgtagaacaaaaagtatgttgaacgcatatgcatga

SEQ ID NO: 18273 - DNA, 744 bp, Glycine max
  Peptide Sequence Number=SeqID_109958
gcagagcgtaactctcgatcgaaatccatcggccaggcgaaagcgcgcggggaagatattgagccattacgcctggaagtgaacaagctgggtgaagaactggatcaggcgaaagcggagctggatgttcttcaggccgaaattcgtgatattgccctggctatcccgaatattcctgacgacagcgtgcctgtcggcaaagatgaaaacgacaacgttgaagtgaaacgctggggtacgcctcgtgagtttgacttcgaggtgcgcgatcacgtgacgctgggcgaaatgcacgcgggcctggattttgcggctgctgttaagctaaccggctctcgcttcgtggtaatgaaaggccagattgcccatctgcaccgtgcgctggcgcagttcatgctggatctgcacaccgagcagcatggctacagcgaaacctatgtgccgtatctggtcaaccacgatacgctgtacggtacgggccagctgccgaaatttgccggcgatctgttccatacccgtccgctggacgaagaagcagacagcagcaactacgcgctgatcccaaccgcggaagtgccgctgactaacctcgtgcgtgatgagatcatcgacgaagacgatctgccgatcaaactgacggcgcactctccgtgcttccgttctgaagccggttcttacggtcgcgacacgcgcggtctgatccgtatgcaccagttcgacaggttgagatggtgcagatcgttc

SEQ ID NO: 18274 - DNA, 384 bp, Glycine max
  Peptide Sequence Number=SeqID_109959
atgaagaatgaagaacgaagaacgaagaacgaacgaagaacgaacgaagaacggatgaagaacggtgaagaacaacagaaaaccttcacggatttgctcacagaaacatctcggaagcgttacggaagaaaagtggggaggaggttgccgcccagctcgcccaggcgagctgggttgcttcctccagaagcaatccagcttcgaaaaatactctggaagacccacttcaaaatttcaaaattgctattcgcaccccccattttgatatggttatggaaattttacgaaagcattacgggtatcccgaaagcccattttttaacaaaacaagggaggtggttgccacctagctcgcccaggcgagctagggtgcttccaccttaa

SEQ ID NO: 18275 - DNA, 249 bp, Glycine max
  Peptide Sequence Number=SeqID_109960
atgttaggattcacaagcgattctcctcaaatttcagccagcccgcatcaattagactttgcaccttacgcttcagggccctacatgataagcacacgttacgttcgagtcgtatcctcagaaaaatggaggttgaggaaacctagcagggggatggccttggtggataactgggtggtggataaggagaatggttgttattggctaagcaatgacattgttggattggtgggaaacttggccatgtag

SEQ ID NO: 18276 - DNA, 436 bp, Glycine max
  Peptide Sequence Number=SeqID_109961
atggctactccacctgcctcgcctcctcctcctcttcctcctcctcctgcagatgcatcagcgtcttcgtctatgttgaagcagacacacaaggcgacatggctacgatcgttggtcactagaccacctggggcagaaagacctgtggtcaacattgatcttgctaccggcaaggccaacggtccccacaagaagaaattaagaacatatttagggattgtcactcgtgataaggtcgacgtgacatacgagaccttgaaggaagtccctgctgctcagaaggatttgatatgggaggatattcagcttaaatctgacttgactaggaaatgggcacttgcagtcaacaaggacggtgtggatgacattgatgtgcggaaaaaggcacaggccatccagaagcaaaacactgcccccaatgtgttgtctcgtgggg

SEQ ID NO: 18277 - DNA, 757 bp, Glycine max
  Peptide Sequence Number=SeqID_109962
gattcctttgaggagcaggcgacacagggatccttcgtcccccatggacgtcaggatgttctgaccactgctattggacgtccagagcaccctggacgtgtccgtgctgctggagccggtgtcaccatcaagtactactttggttcggctccatggatgtcctgcacctcttcctccctaccttctgaggaattgcagcagttgacccaacaaatcagggaccagctagaggagtccatcacagagagagtgacacggcagtcgcagatgcaatctcagggacttacaatgcctcctaaccctctggttggtccctccggtcctcgagtgaggacaaaggggagttgtgttgatccctcaggaaacgatcctgagacgggtgactctgataggtgcgacttatacatagaagcagatcctgcccgcctagtttccatggggagagtttatgagggatccactgttgttcataacactcctttgttgcctggccaagtaaaggtgagtgtggaggaggttacacatgcagatgctccagttcctgtacccactgatgaggtagttgtgtctccggcaaaaccacctccaaagcctgatccggaggttgatgatccactttatctgatgacattgaccatcccaaaacttttcttgaggccttaccaggttacatgggatgccaccgtgttcggagtctttaatccagatttcccgctctacataaagcacgaagacctctcggaaatcacacacggtg

SEQ ID NO: 18278 - DNA, 239 bp, Glycine max
  Peptide Sequence Number=SeqID_109963
atgcaagaggaaaatgaagaagaagaatcagaagatgaagaagacttctcactattttttaagaagttccaaaaatttgtcaagaagagaagaatcgagagatgtcaaaacttcaacaatggaaaaagatctcaagaagattctcaaattcttagatgctacaaatgcaatcaacttggccacatcataacaaattgtccctcaaatgaggaatggcctgagaaaagtgataagaaaag

SEQ ID NO: 18279 - DNA, 1695 bp, Glycine max
  Peptide Sequence Number=SeqID_109964
atggacagcgacatttcccagtgggtgacggagttcctactccgcagctccgtccccgattccctaatccaaaaaaccctagccgccctccctctctctaccgcctccccccgcctcaagaaaaccctcctcctccgcaccctccaaaccctcctccgcacagccacactctccgaaaccgcgctcgacatcctcgaactcctcgaacccagtgcccctgtctccgacgcgcaccgccgcgcgtactgcgcagtcgccgtggagtgcaccgtaaagtacctcgccgcgtgccccgaagacatcgatggcgagtacgccggagccgtgcggcggatctggcgcggccgcgtgtcggcgctgaaggcgcgctggagccggctggtctccggcgagctggcgcggtggcgcgacgtcgtcgaggacgcgttcggggattctagggctcgccagaggctggtggggttgaatagtcggagggacgcaatgaaagaggtgagggtgtttttgaaggaagcgtggggagcgatggggccttcgtttttggaaactgttgcggcgaaggagaagaataaggatgaaggtgctcgtgataatgatgataatgataatatatgtgatgatcatgatgatggtgcatgcatggaggatgtggcaatgcatggtgagaatcaggaaccattggaagagagtgttgatgcgaatcaggaagtgggtgggtttgacttatctcctcggagggataaagcaattccaaagcggaattctcagcttaaacacaaacactctgcatttcgtgcatctcataggggaaggggagttgaaatatctagtccgaaggaagtgaaggcaaccaaatcatggagcaaacatgatcctgtgcctagtgctgaagttaaaaaagttcgggaatccctaaaatcaagttctttggagttacgagcgttggttaaggatcctcttccccatgcattgcatatatctgatgttgtaagatccaaattggcaactagtgatacaaaaactgagccactgattgaaaaccaacatgaagatgtagaagtacaggatccagatgtttgtcagagtattgtaccttttcagcctaatgatgtcaatcttgggaagaagtcttttgttcattgtagtaatattcatcagccctacttgatggaacagaacataagtgctcgtacctttgaggatggagtcttggtcaagaaaagttgtaaacaattgcaatacaatgtgactggtatagcagcaattgcgatcatgatgtggaaaccacaatttgaaaccttgcttccacttgatccagtggcctatggattccatatgtggatccacaaagacaatattgatcatgccgatgtgggaggattcagtagacaactcgccacaagcaagacagccaaggaggaggaaaaggaaatggagttcgttggaagaagaaacactaagggctgggggtctgttcttgggtgtaacccgccattgaaactggcggcaaaggtggagagaggcgtaggagggagaaaggacagtgtcgccaatgggaatggcgacacaccccctggtgccgctagcccttctggcgggataggccacgtgggactcgcccacggtgctggcgagacagccatgcttcacgtgaaccttgcagggcttcaacttttcaggcttgcaggcttcaag

SEQ ID NO: 18280 - DNA, 179 bp, Glycine max
  Peptide Sequence Number=SeqID_109965
gtgtcgagggaagtaacccagagtatcaagaaccttgggatttgaggtcaaatcctttccaagggaagcttctcaaggaagcttctcaaggaagcttctcaaggaaatttctcaaggaagcttatttctcaaggaagtttctcaagaaagcttctcaaggaggtgaacttagttattag

SEQ ID NO: 18281 - DNA, 993 bp, Glycine max
  Peptide Sequence Number=SeqID_109966
atggccagaacacgaggtataggtcgtgccataggtagacttgtaggcagagataaacctgatgaccaggatgcagctgatgttcccgaggggcgtaggcctactgcctcagcccgtaggcaacggggtgctgatcgtgctgagggatcagatgctgatgatactgctgagggattacctggtgggccacgtgacccgtcagtgctgacatcatttgcggaccacgttgcacatgttgtttggagtggacaggaacgtcctgatttgaagttagtgtcacatgggaggaaggtgacactgattgggaggccagtgcctgagattgaaggcctggtgggtgccacaggattaagtccactgatcgattgttcagttactactggcgatcctggactgatatccgcattcgtagagaggtggcacagtaagactagcaccttccaccttccgtttccatgctctttctacggaggaggccaaatttatgctgatagagttgctggaggatgggttcgagacatttatgagacgagatgtcaagcccggcagtggattgtcgcagctcgcgcttatctattgcaccttgtcggttgcactctttttgctaataagagtgcaacatacgtgcatgtggttcaccttgacgcttttcgggacctcgctcatagtggtggttacgcttggggagttgccgcactggttcatatgtatgaccagttagatgaggcttgtagggcccccacccgacagcttgcggggtacttgacgctacttcagcacttccctagtgtgcaccagtgcgtgactgacgatacataccaggagacgtccccacgtgcttcccagtggttgacgtcgaaggcgcacatgaagggcatcacaggagcaccctacagggcacattgtgatggtttgactgtcacagatgtgtcctggttgccgtacacggagcatcggggggttagggcgtttcaggagatttcatcgttctag

SEQ ID NO: 18282 - DNA, 681 bp, Glycine max
  Peptide Sequence Number=SeqID_109967
atgatgcaatcctaccccgcaagggcattggatagaagactccaagaagattgggccagagatgcaagagaaggccttagggttctcatgagccttaggactcatcttctacttgaagtggcgtctccattcatctttctccttctccattccgctgcaatcagatctcaagaagcaaagaaatccattgatgaagaagatccaaggtctacaagttccacctggagctacatcactccaccaccatgtcaaaaggttaatttctatgttgaacgtactatatacgttccaaaaataaatatacaaagggttgctcacaaaaaatgtgttttgcaacctagaagacaagcaagcccttctccaaatcaggaaagagcttggcaacctaatctcttggctcccaactaccaactctcgcaattgtacctcacaaagcaaacagtgaagtggcgaaactgcccttcaggaattcttcttccggaagaaggttcttccggaatcattccggaaaaaccttttccggaagctttccggaagaaccttcttccggaagaagaatttgtgattttcggaagtactcagaaactacttccggaagaacgtcatccggaatgtttccggaagaagcttcttccggaatatatcaatttacttccggaagaaggttcttctggaagttag

SEQ ID NO: 18283 - DNA, 451 bp, Glycine max
  Peptide Sequence Number=SeqID_109968
gattactgatatccgtcctgaccctgacctcgaccccgacccgctcggaattatagaggaagaaaaggatttggagttgccactcctctacttcgatctcctctccgatctcaattctgccatcaatgaggacaccaagtcttcttcaccttcaccaattgatccaactccttcacctattcaagctgatcttacaccttctccttcacctattaatgttgatcatactccttcacctcatgaagatgaagttaataatgtggaggctaaggaggaatatggacaaacatttcttacacctaagatggtgcaaggaaagcaagagttaggtgcgggaacttatgatgcagaatatgcaagggaagagctagcaaaaacaattattatgcatgagtatccactatcaattatggatcaccttggctttaggagatactctgttactctttag

SEQ ID NO: 18284 - DNA, 666 bp, Glycine max
  Peptide Sequence Number=SeqID_109969
atgcccagaacaaaggtgaaaatcgccttcataaccaacgatgctgcgaggagggcagcatacaggaaaaggaagaagggaattctgaagaagatggaggaactcagcaccctttgtggaattgaagcatgtgctatagcatatagcccctatgatcccgagccagtgatttggccatccgaattgggtgtccatcatgtgctgggaaaattcaggaccatgtctgaatgggagaagaacaagaagatggcgaaccaggagagcttcctagggcatatgatcgcgaagcacaaggagcagctgaagaaactcgtgaaggaaaacaaggagaaggagatgaccgtgttcatgcatcaatgccttgatgaagggagggttctgccagataacaacttgacggcagacgatttgaacgatctttcgtcgatcatcgaacagaacctgaaggatgtttgtagaaggttggaaacgctgaatgttatggagaagacaccaccacaccaacaacccccccagatccaatcatcaccagtgttggatatgagtgctaaccatgatcaaaagcagaagaagtttatggatttgcttaatggtaatgaggatgagacaacaacagtgcctccatttgaatcagatgctaatctccaactccaaattgggttttag

SEQ ID NO: 18285 - DNA, 573 bp, Glycine max
  Peptide Sequence Number=SeqID_109970
atggagtgggacaacaattatgatctaagcggatacaaagaggaggaagggttcatcttcaatgacagcgacgacgctggtcctctcttattccctttccctgttgctgaagacctcctccaaacgacaccttgcggttttgacgtcactgatgtgcacgagcccgagggcgagattaagaaacgcttgatgagaatgttgctggttggtactatgaatgtcgtgaaagtgtatcatgaaagagcacatttcaatcctaataataaggagcatggtgcccctaaggatgagcatcgtcatgctacaaattgcagtaattttgcggttttgagtgaaaatgaggatttgatggttttaagacagctagaagcatccccatcagagtatgcaagagcaaacaaggagttgcggaagctaagcggttttatggaccttattaaggaattgaaggccaaacagaaggaaattgatggcttgatgtcactaatggctgaatgttttgaggataaagacatgcttaatacggctacagaggaaatgggtcaggcagtggaagaagaaagaagactgtaa

SEQ ID NO: 18286 - DNA, 657 bp, Glycine max
  Peptide Sequence Number=SeqID_109971
atgaagtcactttgtgaaagtcacaatgacatacggacccttatgactgcccttgagcttcctcatgttagttctaggaaccctagaattgagaaatgtaattctatgttagataatcttgtgggctcacttgatcttcttaaggttaaaattttttccaaaggaaaggttttgatgcaagctatgtatggagttaaggtggagactgcatttatttgcagggtgtttactgcagcattctctggctcgtcaaagaagttatcagacttgaatgtggccgacatacattcatgggctccagattttagaaggttgcggaatcttgtaattgaggaaattagagttagattttctggtggtaaatttactgtattgaatgagttggaagtggttgatgcctctgtgaagatattatatcctactatccaagctggtgtagataccgttgagacagactggcttgtgaagactattgaggaattacgtgcgggtgccgagaagctttcacaaggaattgatcttcttgcaaagggagtatatgggttttttcaagccgttatcactagtcgcgatactttgctcagctctgtgaggtttgataaaactgtaaatgatcgttccccaggccgtaacagagacatgcaagtagttcactaa

SEQ ID NO: 18287 - DNA, 237 bp, Glycine max
  Peptide Sequence Number=SeqID_109972
atgaatgtgtcaagacaagcatctgggttggggattgctttatctacaacaatcacgtttggagacttaattactgtgttggtggtaagtgtggctcattttttggaatcacgaggtatgatagaagatgctcttaaagtagctactgaccctgactacagatttgatctagcaatacaacttggaaaactagatgttgcaaaggtatgtgatcgaggtcgtaccgaaatcaaataa

SEQ ID NO: 18288 - DNA, 532 bp, Glycine max
  Peptide Sequence Number=SeqID_109973
atggcgggggcgagagatattcaagattcatttgtgcccgatttgcaatatgtatgcggtgtccatcttgctattacactgtggaagcaatgtttttgcaaagctaatcaagttgacgatgcacttgctaagtctcgtggtagctcttcgtggacgtgcttcgttgctactggtgtcattgcttctaacgatcctaacagtatcctcccctgggaaagtcaccttgtcctcaagctggaggaagtggggttgcttgtaagtcgtgtggaccatggtgaggcaagagcaatgaacagtggaagacaggatggatttaacatccttcagttcatagtgaacgttgccgataaggtcgaagcttcacatatactagctgatcaacctcgtattgagcctcgcgaccttgcgtctgagggtggcgtatatttcttccctcgtggagagcaccgcatcaactgcttcgttgcgggaagaacctcgaaggtagctgtgaatcgaaggaggaggtttgccatagactacctcataaggg

SEQ ID NO: 18289 - DNA, 615 bp, Glycine max
  Peptide Sequence Number=SeqID_109974
atggctttgttggtggagaaaaccacacaagtggtctcgagtacaaggtcaatgacctttcctaggccgaggtcctaccatcgtcttcgcttggaagagggagaccctccaggagtactggtggcgcaccgagcgtgccctcgactggaccccgacgaaggacccaaccttattgtcgatgacggtggtgacgctaccctcctcattcacaaaagcatcaaggccgatgagctttatgagaagaaaccacaacacaagcaacacttttcacttctcaatttgtttctccttttttctggtcaccatcatgggtcggaagaaggccgtgacaaacccgagccggaggtttggccatccgaattgggtgtcctaagtgtggtggaaaggttcagaagcaggcctgaattggatcagagtaggaagaaagtgaaccaagagagtttcgtttcccaaagtatcgtgaagggtcaagacaggttgcagaaagttgtgaaggagaacaaggagattgaaatgtcctcgttcatgactcagtgtcttaatatagggaatgttcaaccttgtaagaacatgaccacagctgatttgaatgttctttcatctatgattgaatag

SEQ ID NO: 18290 - DNA, 624 bp, Glycine max
  Peptide Sequence Number=SeqID_109975
atgaaacctaaaggttgcgccactcgtttcatgcctcaacctctcgccttggtgtcattgctactactccgttcaattcattcgtgtgtgttggttgaacaacagacaaagattgcttcgggaatggagtgggacaacaattatgatctgagcggatacgaagaggaggaagggttcatcttcaatgacggcgacgacgctggtcctctcttgttccctttccctgttgctaaagacctcctccaaatggcaccttgtggtttcgacgtcaccgatgtgcacgagcccgagggtgcgcatttcaatcctaataataaggagcatggtgcccctaaggatgagcatcgtcatgctacaaattgcagtaattttgcggttttgagtgaaaatgaggatttgatggttttaagacagcttgaagcatccccatcagagtatgctagagcaaacaaggagttttggaagctaagtgtttttatggaccttattaaggaattgagggccaaacagaaggaaattgatggcttgaagtcactaatggctgaatgttttgaggataaagacatgcttaatatggctacagaggaaatgggtcaggcagtggaagaagaaagaagactgtaa

SEQ ID NO: 18291 - DNA, 204 bp, Glycine max
  Peptide Sequence Number=SeqID_109976
atgcccctcacgagcatgaagaggaagttgaagaagaagtcgaagaggaggaggaggaagaagaagatggcgacggtaaagaccaacaacaacaagcaaagactaaatctcaaaggactaatttgtgatccttttacaatttcaaagacaaaaataacaatttatcctaagatgaggggcgaaaatcagtccattgggcagtga

SEQ ID NO: 18292 - DNA, 717 bp, Glycine max
  Peptide Sequence Number=SeqID_109977
atgcacctccacctccaccttaatggattgaggctaagccatgtacaactcggagcatatgagtgtggatattatgtgatgcattggatgtggtgcatcgtcagcggcggtttgaaaaatgaactccacaactttttttctgatggaacaccattagtcactgacaccatgactacactatgcaagaaatgggcagcttgtcagtgttcaacatcttcctgctttggtccttttctccgccgtaaccttgtcatgaatacaaaggatcagatctcacaaacttccaaatttcaaccacttccaatatcagctatctcagggactggaactgcagagcttattgaccttgtttattgtcgcctacagaaaattgaggaatctaataatcttgttgaagaagattatgttctagcaatttcaattgttggtagaccaaatgttgccaaaagtaccattttgaatgcactggttggtgaggacagaacaataggcagccccatcagtggcactacccgtgatgctattgatactgaatttactggaccagatggacagaagttccaacttattgatactgctggaatcaagaaaataacaaccattgcttcagctgggatcacaacagaggctttatcagtgaatcgagcatttcgtgctatttgtcgttttgatgtagttgttcttgtcatcgaggccatggcttgtatcacaaaatag

SEQ ID NO: 18293 - DNA, 237 bp, Glycine max
  Peptide Sequence Number=SeqID_109978
atggctcaattgcctgagggcataactgaattatggcatcatgacaaattgtctatgcccttgggtgaaaatgtaataattcttagtgcaacaaatgttccagagctggaaaagcagtgggactgttggattgaattagcaaaatctagtgacctactagcattgctggaaccatatgtatcaaaggacgtgacaactaatctattagatgaatgtacaacttttcatatatcatga

SEQ ID NO: 18294 - DNA, 249 bp, Glycine max
  Peptide Sequence Number=SeqID_109979
atggtggaagtttctcttgcagctcatggaagtgcttcttacaatgatgaacaacaacacactttgccaacaaatgaacaaggaagttcaacctcacaaagtcagaacattaccgaatttggtgtagttggcgataagtggttaactggtagttttgatctcatcagccatctaactttgtcgttggacaaggatgcaataattcttggatcaatgtttttccaatgtagaagaccactcagagcttag

SEQ ID NO: 18295 - DNA, 915 bp, Glycine max
  Peptide Sequence Number=SeqID_109980
atgtgggatcagcacaggcttaaaagagcactcaaaccggatgtatttacccccaaggcctacactccgaagagtcctttggggcctctccctcctgatttagggttcccaaacgttagagagaaggagaagggattgaagcctccattccactgtctatgtgcgatgagtatttctccctccacaattattattttgcagatcccaacggcgaatatgcgtggaagtgaagcaggaaccacatatcaaattttcacgacaatccaacggttaatgagtcaggatcgtggttttactgagacagttttgggtttctacaggaaaagaaaaagctacgatgcaaagggtttggtgatatcgcaacctacccttcggcgggagggcgacgcgagggctcacgggtgcgtcttccaagaaaggaatacgcgcggagttgccaccaacgtttatttgaggaaaacgtcggaaaaactggaaaagatgtggtctacgaactttaagtgtgaaaggcgagaaaatgacttaaataaacgactaaagcagggaaaagaaggagaagcttgccacccggctcgcccaggcgagctaggttgcttcctacagaaggcatcgccttctggtggtggaacttcctggaaagcccaaaacttcacggattgtgcaacaatgctttcttttgacttccggcatgtcacggaacttcacggattgcctaacgatgggtgccaagcgcagaatgaccataatttgtctctgcgtgccctcggacatgatcaagcctgggtggcaaggcgcagaatgaccataatttatctctatgtgccatcggacacgatcacctctggatggcgaaaaggtgtggggaatgaccataatttgtctccacccacctctcgactcactatccctgaatga

SEQ ID NO: 18296 - DNA, 678 bp, Glycine max
  Peptide Sequence Number=SeqID_109981
atgttatctagtgaaggtgtaccctttgagggcaccattgatgatgattggaaattcgatttttctagtcatgatgcccgccagatggtttgcaccaaccagacggatatgactagtagattacttgctggatcattggccttcgagtgccgcatcatgcactacttgattgtgcgaatccttcttccccgatcatctaaccttgcacaggtctctaaggaagatctgatagttatgtgggttttcttaaccggtcatcagatcgactgggcccactttgccagatatcgcatgaataatgcattgcgatcaaacgctcttcttccttatccccatttgatcactctattttcgtgtcattttaatgttcctcttgactttgagccttttgttcaagtcaagagatctttttctatcggtgctggtgtggtttcctcctttcgataccgcaaagagagggatggttcttgggcgaagaaagatgctcagccacaggcagcagatgatcgctctccttctcctcttcctccgagtgttgactcttcatcccttatgcaaaacgttctagacaagttggatggtctccacacattcgtcggtgagcattttgactccttgaacagccgcattgatgccattgatgcacgatttgcaggaatggatacacacatcacttag

SEQ ID NO: 18297 - DNA, 378 bp, Glycine max
  Peptide Sequence Number=SeqID_109982
aacatgctttatggtgcccttaccgaacccgtgctagagctagagtaatgggtaaagtaaaggaggtgcaagagcagatgaaggctgacatggaggccatgaaagagcaaatggccaaattgatggaggccatgatgagcatgaagcagataatggaagccaatgcggttgcagttgccactaccagggctgttgctaaggtgaacccgatgcacctttctgatatcaaccaaatgaatcatccaacctcaaatatggtgggcaaagatttgggaagatatgccactaaagggcaagcagttggtggaatacccctacgaaacactttggagggccctcagtatcacccacaaccacactccttgcattccacaccgg

SEQ ID NO: 18298 - DNA, 996 bp, Glycine max
  Peptide Sequence Number=SeqID_109983
atggctacaccaccaaactcctatcctcctgagtcagcaccttcaccgtctatgtcgaagaggactagaaaagcaacacagctcatatccttgtctgccaaacccgtaggggtggagagaccaattgctcatgtcgatcctaccacttggaaagttgatggtccacacaaaaagaaactaaggacctatttgggggtcatcgctcgagacaaagtcgatacagtaggagagcaatggaggcaatctaagttagatttgacctccaaaaaggctttcacacaaggaaaggatgatgacgatgacacagtctgtgagatgtatggtataagcaaacagaagtggaaccaattttgtcaaagctgtagagacctttcatggtatgatgtactgactactacccttgggcgacttgagaactctggtcgtgtccgtgctactagagccagtggagcaataaggaaattctttggaccaacttcagaaggctcctacagatatatgcagatgcagtcccatggaattatagcttctgttgagccaaaggttgctctttctggtgcccgtgttagcacaaaaggaagttgtgttgatcccttagggcaagacctaaacacgaatgcatcagacaaacatgggttgtatgctgatgacacttctccctttcaacgtgctaatgcttgcatccctatacccgttgaagaggttcaattagtgggccaagcccttaacaccttccttgcttgggcgacacatcttgataaacaagtaccaaagggaccgacgaagcttgttgataggctagaacttgatgatgatcccatataccagatgacattgatgatcctgcaacttttcctcaagcctatgcatgtgtcgtgggatgcaactatgtttggggcgtatgaagataatgtctcattgtacataaagcatggagatcttggggaaatagcacacgatggtcaatgtctgaacatcgttgttatacaattgtag

SEQ ID NO: 18299 - DNA, 162 bp, Glycine max
  Peptide Sequence Number=SeqID_109984
atgaagttcattgccaattactatgcatctctaagaaaagtgatgcaatcctaccccacaagggcattggatagaagactccaagtagattgggccagagatgcaagagaagaccctaaggttctcatgagccttagggcaaattttgggcccatgagctaa

SEQ ID NO: 18300 - DNA, 1041 bp, Glycine max
  Peptide Sequence Number=SeqID_109985
atgaagaagatccaaggcctacaagctctacatggatctacattagggcacttggaaagtggttgtttgaagcaccagtgggatgttagggcaaaacctagcatattcaatgtatgctccattgcccaacatgaccttaaatggactgggtggaccaataatgtggctgtgagtcggagtgtgttcagtgcagggaagggggaaggagaaggtaaggttgtaggcgaggttagaaaggtcgatgggagtgctaatttgttgggtggtgtgggaagcaagggaggaagggttttaggaggcatccatgggggcttagcgaataaggttggggtagcttgtagcttggtttcaactagtttgaggcctaagaggaaacagtttatcatggcagtactagggcatgttggtgattttcaaagccattggaaccagccatatagcatgaaagctgggaaaggtgatgagcaggagcaatggaatagtgttaaaaaattgttcaacctggaatacccattcaaggggggtgtctatggtgcaggatggtggggttggtggattgtgggttttgttttctataagcagttcttgaaggagttggaaagttttaagttggacgatttcggatttttcagtgtgggatctagtcatcatgtgaggatcccggctagagatttttggccattcgaatcgggtgtcttaaatgggctgggaaagttcatgtgtatgcctcaatgggaacagaccaagaagatggtggacgaagagcatttcattgcacaaagcaacgtgaagggtaaagagaaattgaagaagcttgtggatgagaacaaagagaaggaaatgtccttgttcatggttcaatggcttaaaacaaggaaggttcagccagaacataacatgaccaaggctgatttcaatgctgtttcatcgatgattgatcaaaatcgaaaggacattgctgaaaggatggaaattttgagtgttagtgaggttgtaccaaaccaaccccgcatgcaacaccagcattctaacccaatatga

SEQ ID NO: 18301 - DNA, 352 bp, Glycine max
  Peptide Sequence Number=SeqID_109986
atgactagaggcaatccatctaacttacaaccctttgaccctgagatagataggacatttcatagattagttaggcatcattttataccttttgatcatcctgagcattccattactggtgaatctgtgcattctgttattggtgattttgaacatcctgatttggagcattataattttgagcattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 18302 - DNA, 546 bp, Glycine max
  Peptide Sequence Number=SeqID_109987
gcaaaatttgatatccctgaagcggcgaatgcaaagataaaggtgatgtccaccgtggccactagatggaggcaatttaaatcaaccatgaccactaaatttgtctatgctgactctgagaggcaagataaacatgatcattcggtaaaacatggcctagatgcagaaacttgggaggaatttgccgcaagctgcaaaacccttaactggcagctaagctctagcttctttaggaatcttcttaaggaaacttctcaaggaggtgagcttagttatgagagggcatcctctccaagcttcttatccaaggttcatcttggtggtgaaactccttcttccatggcttattccctagacctcattgaagctcaaagatctagcctccatagaagccccacaagcaagcttccatcacgatggatgcatttagatggagaacatggggctattaagttaaaaggagaaacattaaccaaagtattgttgaacactgatgggcctccttcagcaaggccattttcacaatttgaggatgtgattatctga

SEQ ID NO: 18303 - DNA, 366 bp, Glycine max
  Peptide Sequence Number=SeqID_109988
atggaaaattccatagtagtgaactttaatgtaaacttgcccctggtgaaacgagctagagttagaatgggtaaatcatccacagaggcaaaactcaatagcatttctcaagttcaggttaaaagtggcgaggaagatattactgacttaccacatcagataatcacatcctcaaattgtgaaaatggccttgctgaaggaggcccatcagtgttcaacaatactttgggtctcatcaactgtttaattaaaaaagaccaaatgttaggctgctctgtggatgatgaagttgttttacctccatctaaatgcatccatcgtgatggaagcttgcttgtggggcttctatggaggctagatctttga

SEQ ID NO: 18304 - DNA, 187 bp, Glycine max
  Peptide Sequence Number=SeqID_109989
atgataataaccaagaagttgtacccacttcttgcaatgaacccaaatgcggttagtcttttaagtccaatgataacaaccaagaagttatacccacttcttgcaatgaacccaaaagcggttagtcttttgagtctagtgatcaaccaagaagcaaatcctgcttcttgcaatgagcccaaaagag

SEQ ID NO: 18305 - DNA, 207 bp, Glycine max
  Peptide Sequence Number=SeqID_109990
atggagggaggaattggggcttcctgtgacccagaatgtcgcagactccgactcgagggacgcgtcgtaatcgattacacaaatatggtaattgattaccagagagaaactttgccagaaataactgcttgtaatcgattacactattatggtaatcgattaccagtggttattttagccagaaaacaaaaacaacaagctttctag

SEQ ID NO: 18306 - DNA, 216 bp, Glycine max
  Peptide Sequence Number=SeqID_109991
atggaagctaagtgcttaagaaaaaagggcaagtatggggaaggaatgaatgaaaaagtgaaggtcaaaaagaggctaagttttgaattgcaaaatgtagcagttgggctaagctcagcagctgggctaagcaaagatccaccgctaagcgcagctttagcgcgcttagcgcaaaggagaatctggcagagcatcagcatcaaagtcgcgcactaa

SEQ ID NO: 18307 - DNA, 1518 bp, Glycine max
  Peptide Sequence Number=SeqID_109992
atggcgtccatctctacgtgcatcactgtgacccccacttgtaggcttgctcggcggctactttccttcacctcgaagcaggcaatagcattcccttccgtgcagcaaaacccggtaattgggggagtcacgaaaagggtatgggattctagggttttggtggcggggccgggtggcgcagtggaaaccgacaagttgccttctgatgtgagaaagcgaacgatggatgctgtggatgagtgtggagggagaatgaccattggggatgtggctagcagggctggcctcaacttgaatcaggctcagaaggctctccaagctcttgctgctgacacaaatggcttcttagaggtttctgaggaaggtgacgttctgtatgtatttccaaaagattatcgatcaaggcttggtgccaagtcatttaggattaaagctgagccattttttgaaaaggccaaggctgcaggagaatactttataagggtttcttttgggacagcacttattgcatccattgttattgtttacactacaataattgctcttgtaactagcagtagaagtgaagaggacaatcgtggaaggcgtggaggcaggtcatatgattcaggattcactttctactttaatcctgttgatttattctggaggcaaaggccacaagctgatgatgacaagatgaacttcattgaatcggtcttctcctttgtattcggagatggtgatcccaatcaaggaattgaagaagagagatggaagttgattgggcaatacatagcatctaatggtggcgttgttgcagcggaagaacttgctccatatcttgatatagattctacagagggaattaaggttctccggccaccgtccgccactgtcttcggccaccatttctctcggcgaactcagggttgggtgcgccttgaagagcgcgactcacccctggaagtcgcatggccaaactcccttccacgcgccgccatagtctcgtgccagtttcggcgcgtggccttcacgcgccgcactccagtcgctggaagttcatcggacctgttccggcatctttgtcgtcttcacctgaacacgttttcaggccttgtctttcggttttggcaagttgtttgttccagcccttgcgtttccctcttcttcttcattagggtttccgtttttgatcagaaatggcttctgctaaatagtctagtgaataagaagctggacaagttttacatggttcttatcttgaggagcctacactcagattttgatcatgtgcgtgatcaagttcttgctggagaccaagttccgtcaatggactctctcatcactagacttcttcgtgtgcctcatgtgttgaaaaatgaaaatctagttgatgttgtggaaacatcagccatggttgcacctcgtggaagaggaggaggccgcagtggaaggggtggacgtcctcatttgcaattgcaatttttttattgctgggacaagaacactgagagcataggcttgggaagtacttga

SEQ ID NO: 18308 - DNA, 348 bp, Glycine max
  Peptide Sequence Number=SeqID_109993
atggagatgcagcggaagacaaaggagaagagaggatgcttcaatggaggaaaagaaagagggagagaaagagagaggggggagcacgaaattgaaggaataaaagaggtagagaagtggaactttgagttgtgtctcacaagactctcattcatcaaagttacaacaagtgttacacatgcttctatttatagactagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 18309 - DNA, 645 bp, Glycine max
  Peptide Sequence Number=SeqID_109994
atggagtttactctaggtgaccaacatgtatgtgtaatttcaacttcattaggtagggagttgctaggtgcacccagcaatattgctggtgcacccagcaatttattgaaaggtcaattttgcccttcatttaaaaacataaaaaactttatccctctttcagaagcattctgtcttctctcttccgcgaaaaagcttttctcctctcttctctcttccgcgaaaaagcattctgtcttcttctcttcttctccgcgaggcttctccggcttcatcttctccgcgaggcttgtcttccatttgcattcgagggtagaggacgccggaaaaaatggcggaagcttggtgacggtgagccttccggaagacccgttaggggttcttccggaacttccggaagaagatcttccggaagattttcggaagaagggttcttccgtaggtaatgaaatgactttcggaagaacagatcttccggaaaactctcggaacacctcttccggaatgtttccggaagatgtacttgttccggaaacattccggaagagggttcttccggatgacctttcagtggttccggaagcactttccggaagagtcttcttccggagttgttcccgaagaagtacttcttccgagaagtag

SEQ ID NO: 18310 - DNA, 786 bp, Glycine max
  Peptide Sequence Number=SeqID_109995
atggtggtggtggattttgcgaagagggaggagaggctatatatgtgggacggcggaggatgggggtgggggtgggtgacacatcggaggccactaccaccaccgctgccaccggtaacttataatgaatccccttcaactaaaaattctcaaagttttcaaacctttccttcaatgccacaaaacaccttcaccacgttccataattacaacactttttgtggcaatctaagtgagaggtccgacaatcaactaaaatcccaatgcccaaaaaatcacaatgtcattcaaaagttcaatggttattacaagcaagttgttgctttgaagaagagcggttacacagagaacaatatgatgattaatccatatgctatttggaaatggttagaacaatgcgcaaaagttccttccaaaagaaccaagccgaatgaaaattggaattactcatcgtcatctaatccggaaacaccaattgatgtttttgaaagtgacacccctacaccactcgctcgcccaatgggacaaaaggcagtcaaaaggaagatcaaaggtaaaggaccatttccttctacactagttgtgaacttgtctggcattgaaaaagaaatgaatgaaagaaatgttgtccaaaaacaaatagtagaggcagtggcgtccgatagcatcgtgaagatgtacgaaattcttatgaaagacaaagataacatgactcaagaacaacgcaataaacacaagatcatttgtgattatattgagaaaagtttagtacttatcattaattag

SEQ ID NO: 18311 - DNA, 843 bp, Glycine max
  Peptide Sequence Number=SeqID_109996
atgagtgacacacaccaacctttcatgtccgtacaaccacccatgaagctccacaaccacccatttaacccacaagcctcaagctcaaattttgacggcgacccaccatgcaaaaccgccggaaaaacaaaaccacctcacacgaagctcctccgggtcattctcaccgaccacgacgccaccgattctgactcctccggcgacgacgaagacccaaaaaacacaaaaaaacacaaaaaggtgaaaagacaaattacccacatcaccataaaccttccctttttctcaaaatccccaactccaacatcaacaccttcttcttcttcgcttgacccgacccgttcgacccgacccaagaaacgactcggcgtccctcgccgccggaacaagttccgcggcgtccggcagcgaccatggggacggtggacggcagaaatccgtgacccgactcagagaaaacgggtctggctcggaaccttcgacacggcggaggaagccgccgccgtgtacgacgaggccgcggtgaagctcaagggccctaacgccgtcaccaacttccccctctccgccgccggaaacacggaacatgatacccctccgccggagacggtgttctccggcgaaggtctttcatctccgacgtccgttctcacttactgcgacggagactcgacgccgttcgacggttttcgttacggcgaggtcgacgcgttcgggtttgagtttgacatcgacgcgccgtttagtttaacggccgttaacttaggggtgctgagtcagcggttcgggaaggaagagtttggcgagtttgacccgaacgagttcttgacgtggccgagttaa

SEQ ID NO: 18312 - DNA, 540 bp, Glycine max
  Peptide Sequence Number=SeqID_109997
atggcatcgaaacgcatcgtcaaggagctcaaggatttgcagaaggaccctcctacttcctgcagcgcaggtcccgtggcggaggacatgtttcactggcaggcaacaatcatgggacctcctgatagcccatataccggtggtgtattcctagtttcaattcattttcctcctgattatccattcaaaccaccaaaggcaataagctatcctattgcgaagccacacacctgtggtggtggtggtggtggtgcctcagtggctcaaatgctcaatgctctggtggtcaaggttgcatttaggactaaggtattccacccaaacatcaacagtaatggaagtatatgccttgacattctaaaagaacaatggagcccagcactaaccatttctaaggtccttttgtccatttgctcactgttgacggatcccaaccctgatgacccgcttgtgcctgaaattgcccacatgtacaagactgacagggctaagtatgaagccactgctcgtagctggacacagaagtatgccatgggatga

SEQ ID NO: 18313 - DNA, 465 bp, Glycine max
  Peptide Sequence Number=SeqID_109998
atggagttaggtgaagtgaaagttcatcaagtttactcaaggttgctatcaacgtttgctgaccttcccacattgggcttccaaatgttgcgtgatcttggtcgtagattcgttttgatcgaacagtgggaagatgttgcgtcgtccgattcccactccttgggattggttttccctagttcgactggcccctcaacaaccgaggggtctaggaacctgtcgacttttttgagtcagctgccgccaaatgctgctaagaaggtaggaaagagcattgtggctctaatggttgccaccgttgccgagacgggtacgtcttctcgactcaagaagcatccagtgttgaagaaaagatgtctgcctcccccaatcactcttctagagtatacttgggtcgacgaagaggtaggcacctacttcttgcattataatcaccaatcatacatgtccaacctcatcaattga

SEQ ID NO: 18314 - DNA, 147 bp, Glycine max
  Peptide Sequence Number=SeqID_109999
atgtctaggtatttggagataaatgtctttctttcaatggaggaggagattagtattggtgaagatggcgaggtagaagacgagtgcgatgcgggagaattttttggtggtggggagggtgaaggggtcatggtggagaaatcctaa

SEQ ID NO: 18315 - DNA, 1168 bp, Glycine max
  Peptide Sequence Number=SeqID_110000
atgcaaaccgccagccccattggcgcgtttgttgtggttgtgacacgtggcatgtcgtcactgtcactggcgacacagtcagtggttgtcgccacttccattggcgagtggagagaacccgctggagttgcagcctttgatagagaagtcgttattgctgctggcgacttgggcttcaaggatatcaccatccctgttggcgacttgggcttcaaggatatcaccatccctgctggcgacttgggcttggtggattataaaatccccttaaacgagagtgaaagtctccgtgttgatgggacacaattaattggtccaacaaatcttgattgggttgatttatgtgaagaattgttaggagttagaccacatgaaggtgaacttgaaggtagtgtgtttctgtgggagccttacacaacaactgttacgtcagcgttgcctccaatttatggttggaagtgtagcgtgaatatccatggcataacgctaaaaggcaaacaagatgaaaattgggaacaactattcgcccgaatgatcagtcaatggaacaatcgagttgagtttagggtcgacgtttatcctcgacaagagggcctattgagttttaactccgactacatggctgaagttatggagacattacagtatatggtgtcaccacaagggaggaacacatggacagttgataatctcgtaccttatgtggagaagataacaattttatttgaagagcaagagagaatcactgagcctatgtcacatggtccagcactagagcgtcaatttgcagcacaagagtttcacattcttcagtcaagtgttgaaactcagggcataggcagacgcagggaggctgttgaagcggaagaatattcccaacaaatggtggagcgtggccatgggatgcattacatgccaccaacattttctcagtatccttcacagatgtatcagtatccttttgaaggtcatcacactgatacttctacaagcgaacattcgttcggtggtgttgcagaaacacatcctcatttttcatggccgagtgttgatttgcgtcaccaattttctgttgagactgaccaagtaaaagcgaggagacattggggcagaagaaatcctgatcgtcaagcgcgaagatgggatcgaccatgtggcacatcctcac

SEQ ID NO: 18316 - DNA, 549 bp, Glycine max
  Peptide Sequence Number=SeqID_110001
atggacgtcgggcatggtttttatatggcaaagtttgatgaagaattggacagaaacaaagttatggaagaggggccatggatgatctttgcccttatagcttccatagggaagcctatcaaagtagattccaatattgttgatgttagacttggaagattttctcaggaaacttcagccaagcctggagtggctgttagcaaccaaccttcccaatcagacggcggaggtgtatccaaacaaccagtgccagcaacaaccatgaaggagggagccagtggagaaggggccactcaaggagacaaagaaattaattctagcaataataatattaaagggccacgtaaagaacctttattcccaacctctagtgtcatgatgagtgggctcgtgacagcaacaaatgcaccccctcctatcgtgattaatctgggacataataaggaggatcctattatctatgatatcagtaataacgcaaaatctacgatgaatatgaagttagtgtcaagtgttcaatacacaaatgtcgttgaagattccaattag

SEQ ID NO: 18317 - DNA, 144 bp, Glycine max
  Peptide Sequence Number=SeqID_110002
atgtcacatcctgatgtagctccattgaagctttttgatagcagcggaatggagaaggagaaggatgattggagacgccacttcaaggagaagatgagtctagaagaagttcatcaccataggaagccaaggataaaagcttga

SEQ ID NO: 18318 - DNA, 297 bp, Glycine max
  Peptide Sequence Number=SeqID_110003
atggaggggactgtcttcactcctgcactgcaagaaattgagcatgtaaagtctgatcaaggagaaattctgagcaagcttttcttggatgcgtgcaaacacatattgcctgtaatagatgtgtcagcaagggcgttttatgaggtgtcataccctaatttcgtccggggattattacttgatgatatgcaacctttgatcggccgctttgggatacttggcatcctttgtttcacaatatgtgaagtcccgagacatgccggaaatcaaaaggaagcaggcttatgcgatccgtga

SEQ ID NO: 18319 - DNA, 519 bp, Glycine max
  Peptide Sequence Number=SeqID_110004
atgaaaaccatacttcattgcacaagcgtggataacagaaatagggaaccacttgctacattgtctcatggtcatgttccacatatcccttcttcaaatagatgttcatctattgcatattcaaattcgagaaacactcaacctagccacatattggaagaatataacaaccgacaattccaaagactacaaaaacttagtgcaactagactgaattttgatcaagttttgcatcagcaaaatgttggtttgaatgacaatggtagagccacaaaaaccaacacctacaatgacaataatttgttattgtattggcagtcatatgtctatgtggcaagtctttggactgaattcaaaaattatgataagttaggaatagccttatgtcgtaacatgccctcttgcgggcgagcgaggcgaggctcacgggtcgacaaaagcgaggctcttgctcctacgtaccctccatcgaagaggaaatcagacctacgtagttctttcttaagggtaatcaagtga

SEQ ID NO: 18320 - DNA, 309 bp, Glycine max
  Peptide Sequence Number=SeqID_110005
atgaattgtagtcatcttagccacaggggagaaggtctccatgtaatcaataccctcaatttgagaaaacccttttgcaacaagtcatggcttgtagcgttcaatactaccatcagctctacgcttgatcttgtaaacccatttgcatccgatgggtttaacattagaaagagtcacaacaatgtcccaagtgaggatggcgtggttggtgctagaggattgaactgtgaagtggacggattaggaacatgtgaggtgatgttaggagagaaggaattgggcttcttgaaaggcaagatggtttcatga

SEQ ID NO: 18321 - DNA, 357 bp, Glycine max
  Peptide Sequence Number=SeqID_110006
atgacacatcaccaggatcctgatactagagtgtattcacctaaggtaatgtcgcttatcggcaagcatcttctatttttaatagaaagagaaagtgttgaaggtagatgtcttcgagatgttgttaactatcctaatgcatatacggtacatctaatctgtcatgacaagcaagtgttaaggatgtttcattccaaggagttcttaattgtggcacagaagcctgttccacctgcaatgttaattgaatggattaaaaagcaaaaggaggacctcaagtgtcaaggttatcgcggaagcaggaatgatgcaccccaggatacacaaattttgaatgatgaatcagcatcttcttaa

SEQ ID NO: 18322 - DNA, 363 bp, Glycine max
  Peptide Sequence Number=SeqID_110007
gtacagcctcgatcaaatttggtgccgttgtcggggagcagtggaccaaagtgcatgattaggggcaatccaggtgatttacaaccctttgatcctgaaatagatagaacctttcatagattagttaggcatagtgtgcatcctggtcattctgtgcattttgagcatcctaatcattttgagcattttgttgctggtgattctgaatgttctgattttgagcattcggctattaattttcatactgagaacatgactcaacctccacctcgtgagaggactcttagggagatggctgcacctgatttcacttatgaaagcttgtgcattcaatatcttgatgagggtgttccatattgttag

SEQ ID NO: 18323 - DNA, 753 bp, Glycine max
  Peptide Sequence Number=SeqID_110008
atgacgctaggttgcagacttgggaggttgaactccatagccgaaatagatgaccaaaaggaaacttggaagattgttgttcgagtgataaacatgtggattataccaagatcgcctaagtttattgttgagctaaatttagttcacaaaaagggtgataaatttctaactcaaatgaagaatgttgatgttcaactcgacaacgcaactaaagtcacacctcacaaaatactagaaatacttgaaacaatgtacaacttcacaatgtttgatgacattgtaagtggttcaaccaacactgacttttcaatagatgttattggtgaggttgttgagattgtgcagtggaatctgcatggcaagccaaagaaagttgtatttacaatgaaagatggatggtttcgcatggatgtcatagttggtcaacctcatgagtctgcaatttttacactatgggatcgtgaatgttatgctctgataaaggagactgcagctgagattaagcagaaaatgattgataaggatgaagttttgccttctatatcaatgatgaacgagattaatgatgctagtgagagtcaatgtttctcggccactactgagtctgatccaactctactgggatccatcacactggctaagcacattttgccactgtctcatagtcaactggatgaaatatcattcgaagatttatcatccatacaactatccttaactaggctggacaaaaagcatatcaagactgaatga

SEQ ID NO: 18324 - DNA, 492 bp, Glycine max
  Peptide Sequence Number=SeqID_110009
atggaggatggggttgggatcggaaatgacgcggccaacacgaaaaccaccacagagggtggcgcgctgcccgtggcaccattggtgcaaagtccagcagcacgagcccggcccagggtcggcggcggcactacagcaatggtggcggagggtggcgcggtggttcgaaaagaagaagaagaagaaggaggggaagaagaagagacagaaaaaaaaaacaaagagaagaggaggaaacatgagagtgaaagagtgaggaataaggggttacttgatgagaagaggaggaaacatgagagtgagagagtgaggaatgaaggattacctaatggcccctcttcttctctgacaaaactcatcaaattgcaccactggattggttcctttttcttcttgggatcagtgcctcactcctctgtgtcttttgctgagactttcctctttttccttttatgcaatctgctctctcttgacctaatgggctctctttaa

SEQ ID NO: 18325 - DNA, 426 bp, Glycine max
  Peptide Sequence Number=SeqID_110010
atgagggtcactttggctaaagctgtgttggatactatccctatctacacaatgcaaaatgtgtggatcctagagggagtttgcaataatattgataacatagttaggagatttatgtgggggagtcaaatgttaccttacttgggaaacacatttggtctcttttgcaagactcaaacaagttatggaggtgacttgtccatatggtatgacaaatgggatcaagatgggtgtgtggttgggtccgtgaatcatgttaatattcaagatgttaatctaactttgagggacatcttttggaatgggatttggcattggaatgaggctactcaagatgagtattttcccaccaaaacaacttatggctggctcacaagaactttggttacccctggatcttctgcaagttacgactcttggatctag

SEQ ID NO: 18326 - DNA, 228 bp, Glycine max
  Peptide Sequence Number=SeqID_110011
atgataaatagagggctagagaaaaatgcaagaaggcatgttgtgattgggagatctactgtgcaaagaatgaacacaaaaactgttttcaaatcaagtcatttatgcatgagcataaatgctacagagaaatcaagaacaaacaagcaaatagagagtgggtggtcagcaaacttgaggccaaactcaaaatccagccaagccttaaatgtgttgaagctttggtga

SEQ ID NO: 18327 - DNA, 720 bp, Glycine max
  Peptide Sequence Number=SeqID_110012
atgaagcatacttatagaagaaccaagcaacaaaatcctaggaacagagaaagtgttggaaaggcagttgcagacaacaatgacatccttaacttcggagaagccggtgagagaagccctactggtggacttgccaatgcctctcatgtcaaaggtgacagttgtgtaaccattgagagccaagccagaaacgattcctttgaggagaccctggcaacaacccaaaatagaatacaggaattaatgatggcagcagtggacaatccagcaaatgcatctgaatgggcattagcagaaatgataaatcagcctaaattgcttcaaaaagccatagaagtattagacaatgtggtaggtaagaagaggttggtccaagaatcagatattcctaagctcaactttgtgaaggcttgtgcaaaagagacagtggtagccaattacttgataccaaaggatagttatgtactactaagcataaggggtctggggagaaaccctaaagtttggaatgaaccactcaagttcaagccagaacgccacctcaagaatgatgggtctgatgtaactccatggcttccttggagtgcacctcctaatgtgtcaaccattaatcttgccgagtccaagaggaatatgtttcttgctgagccacttgtggcagtagcaaaaccaggattagcaacagaattgtacaccatgaaattgagtgaacatttatga

SEQ ID NO: 18328 - DNA, 507 bp, Glycine max
  Peptide Sequence Number=SeqID_110013
atgggaacacaagatggattcaccagtgtaaagcagttgaggaacaagcttacttttgcagcaggatgtgtagaaacacatttaatcgatggggtaggccatttccagatggaaaggcctggttatgatgctgagatggtggatctcatcattaaattggagtatattttacccttgctcattcttggtgatggattcttccaatatggggtttctctttggactgaatatgcttcaaaagcactagacataccatctcagtttctagacgaggaaaagtatgctaaggaaactttaggctctcgtgggcaaatgtttcatagcatatttgaagggatgaaaatatcccacgacagggtattgacacactttatatcttttggtttccagaccaaggtgttaagtagcatccttacttttttttcctacaaccaaaaggagagatgtttaacaagtaggattttgattgccattatcattttccttttcgtttttccatatgggtaa

SEQ ID NO: 18329 - DNA, 510 bp, Glycine max
  Peptide Sequence Number=SeqID_110014
atggcctctggtttccatgtgcaaaagctgtgtaattcgagtttgagcactggtaatcgattacatactttgatcgcgatggcagcgcagttaatccatgatcgcgtggtgatggagtgcctagagggagtttgggagaccctcgaaggcaatgagaggtgccgattccgtggcacgattcgactcactgctacttcattagtacatccggaggaacccacacacacgcttcagcagcctgtggagtggatactacctacacctactccatatcgactagtggagccagttcaagtgatagaggtgtcatcctctgaagaagatcctgaagaggacccagaggagttacctcctgagcctgctgtggatgctcttgactttccagaggatgatgaggacccactccctgatgtggattctctagaggatatcatgtcagcatctgaggcagactctatagaggagagcggccctggagggacaacgaatagtgaagactcttcatcatag

SEQ ID NO: 18330 - DNA, 555 bp, Glycine max
  Peptide Sequence Number=SeqID_110015
atgagtgttacagatatgcatgctgagagtcgtgtggagatgccactgcctatgtacgtaccaagagacgaacaatttgatgagtctaagctgaacacattcttaatcaagaggctcaaggcagtggtccataacttgatccctggtcttaaggctagtctttctgctaataaccatgacttcaatagattttcagacattgacgacctttacagtgatggcctgcccttgcaagatgaaattttgaagaaaattccattgttacaagtgctcacaaagatacaagaatgcagccaggggcttcttaagtatgacactcccaagattatttctaaggacaagttttcctggctgcgagatgatgaattttcccggcaagcaatagcaggagtcaaccctgttaacattgaggggcttaaagttttcccactggtgagcaaactcgacccggaaacatatgaccaccaagattctgcactcaaaaaagagcatattctaggacaacttaatggcatgaccgtgcaacaggtacgtaccttcaaaatccttaattaa

SEQ ID NO: 18331 - DNA, 423 bp, Glycine max
  Peptide Sequence Number=SeqID_110016
atggcatcgttcaaccagatgcagtcccagtttcagtcccagatgcaatctcagggacttgcactgcctctggagcctctggttggtccctcagatcctcaagtaagcacaaagaagagttgtgttgatccctcaggaaacgatcctgagacgggtgactcagacaggtgcggcttgtacatcgaagcaaatcctgcctgcctagttgccctgggaagagtttatgagggatccactgttgttcataacactcctttgtttcctggccaagtaaaggtgggtgtggaggaggttaaagatccagatgctctcgttcctgtacccactaacgaggtttccttagtggggcaggcaattcacaccttccttgcttggccgacacatctggtcaagcctttatcacagcagggtgcctcaaattag

SEQ ID NO: 18332 - DNA, 174 bp, Glycine max
  Peptide Sequence Number=SeqID_110017
atgggtggtttaacctctcataacaatgagaggcttactaatactaaaagaaagcaagaggtatggaagaaaatggaggaaagggtccccaacacaatcatgtttttcgatattgagtgtacgctaagccggcatgtgctcgctaagcgcacatgcaaatttcagctggaataa

SEQ ID NO: 18333 - DNA, 555 bp, Glycine max
  Peptide Sequence Number=SeqID_110018
atggaggccttcctagctcaggctcctgtggcccaaaaaccacagactcaggcccctggagacgctgaggacaccccagctgacacaactatagatcaggcagtagaggatgacatgccagaggctagggatactgaggagacacttgcagccacacctatagagatcattgaggaaggaggcgcaatagataccgacattgatgaggactacgtggaaaatgtcaccgcggatgctcccagtacacctcatgatgacccagtgatacaatcctaccccgcaagggcattgggtagaagactccaagtagattgggctagagatccaagggaaggccctagggttttcatgagccttaggctaagctctagcttctttaggaatcttcttaaggaagcttctcaaggaggtgagcttagttatgagagggcatcctctccaagcttcttatccaaggttcatcttggtggtgaagctccttcttccatgacttattccctagtggatggcgcctcctctcacctcttctcctttgtcttccgctgcatctccatg

SEQ ID NO: 18334 - DNA, 261 bp, Glycine max
  Peptide Sequence Number=SeqID_110019
atggctcgcttagccgcaacaagaatgcaaaaagcctctaagtatcagactcaactaaaggatgaagtgaaagcagagaggcaaggaacagaatgcaactatgagcagttgcaaaagattgtagataactctgcaaattccgctaagcgggccatgactcgctcaggggattcaatgcctgaggatgcagtagtggggtcgcgcttagtgagatggcctcacttagtgctattgccattccaaagagagttttgggcttag

SEQ ID NO: 18335 - DNA, 87 bp, Glycine max
  Peptide Sequence Number=SeqID_110020
atgggggagggaggttacttcaggtggaagctaccaagcttgcctgggcaagctgggcgacaatcacctccctcatttttgctataa

SEQ ID NO: 18336 - DNA, 201 bp, Glycine max
  Peptide Sequence Number=SeqID_110021
atggaggttgaggaactttgggtggggttatggctaccattgaattatcaagctctttcgctggaaatttccctccttggttggtgttttggttcatgttacgggtggtgtttgacattggatgtgcgacaagcagcctttgtggctgatttaggggtgacctttgtggatgattgggtggtgggtaatgagaaggcctga

SEQ ID NO: 18337 - DNA, 312 bp, Glycine max
  Peptide Sequence Number=SeqID_110022
atggctaaattcgatccagagatagtgaggggccaatggattcctttcgacgcagatgccctcagtcagttcttggggcacccactgatcctggcagagggccagcagtgcaagtacaaccagagaaagcgagaggtctctagctttgatgaggagaatattgcccagctgctatacataccggggcaagacttcgcccagaccaccgcagggaggcgggtgcctcgcatcctccttggaaaaccactcaaagtgttcaaatctctccctaaaagtcaggaaactcatcctccttggaagatgcaaccatga

SEQ ID NO: 18338 - DNA, 216 bp, Glycine max
  Peptide Sequence Number=SeqID_110023
atggtagccataacctttgctaggtttcctcaacctccatttttccgaggatacgactcgaacgcaacgtgtgcttgtcatggagaagccccgggtcattccattgagcactgtatgatctcaaagcgtaaggtgcaaggtccaattgatgcgggctggctgaaatttgaggagaatcgcataattttcaagtttatgccacagttacaacgctaa

SEQ ID NO: 18339 - DNA, 702 bp, Glycine max
  Peptide Sequence Number=SeqID_110024
atgggtggtgatgatcacacgaaaacagatctgcaggcaaagccaaaacagcaagttcaactacttgaagaactttaccaaggaatcccagatgaatctgttaaacttacctttcaagacctagccaatgtgaattcatcaaacaacacaatggccactaatgaacgcgtttctgatcaaggaggtataattagcaactctacaaaggtaccatcaccttctctttctacagtgcctagtcttgacatcaaaaaaggcttgggggcatccaatcacaaccatcaccaccatgaaaaaaactacagtcatcaccatcatcatcatcaggattttggtcatagaggtggtggtgagtcaccatggggtcgttttagccatgcaagtggtggtgtaccaagtagggctgaaaaggaggttctggttgacgaaggcggccggggcactactacaaaagcagaattcaacgtcggtttaaatgggtatactacgtcggttgaagaccgtcgttgtctgcgacgacccccgtctttagaacttactagagactacgacggccataaggacaacaccgtcgtagacataatcttgttctacgacgactacgacggttgtcttcccagaaccgtcgtagaagggtcctatcactacaacggtgttttgttgcggacgaccgtcgtaagagacggtgttaatactactacg

SEQ ID NO: 18340 - DNA, 396 bp, Glycine max
  Peptide Sequence Number=SeqID_110025
atgcgtcaacatacaaagacgggtttgttagaagagccgtcgttgtatgttttgtacagacacgtggcgggcgtcattcaaagacggtcttttctaggacccgtcattgtatcccaaattgtatcacgtttacggcacgtgcttgttactttctcttactttggcgcgccgtatcacttctttgctccatttttcgactacttgcccttactttggcgccctagctacacagaccttcttctccgacaaagagcttcgtctccgacaaacagcatctcgtgtccgttgcctgttgttccgtttgcagccgccgccgacaaaggccctttgttgttgttggttgtcttcatcgtggtgtacatcatagtgtttaaggaagataaggtggttccataa

SEQ ID NO: 18341 - DNA, 132 bp, Glycine max
  Peptide Sequence Number=SeqID_110026
atgagcaagaggctccaagaagattgggctagagctactgaagaaggccctagggttctcatgaaccttagggtagggtaccctagaaatataggatttttcagcccttgtatttttgggcacctagactag

SEQ ID NO: 18342 - DNA, 384 bp, Glycine max
  Peptide Sequence Number=SeqID_110027
atggcttctccacctgcctcccctcctcctcctcctcctgctccttctgacgcatcggcttcgccgtctgccatgaagcggacacacaaagcctcacgtctacgatccttgtctactagaccacctggtgctgagagaccagtggtccatgttgatcctgctatcggcaaggccgatggtccccataggaagaaattaagaacatacttgggaattgtggcacgtgataaggtggacgtcacctacgagaactggaaggaggtccctactcctcagaaggacctgatttgggaggatattaaggcggaatttgaaatcccagaggcttctaacagtaggacgaaaaggaagttacttcagaccatgggcgagagatggaggtag

SEQ ID NO: 18343 - DNA, 450 bp, Glycine max
  Peptide Sequence Number=SeqID_110028
atgcataaaacatttgtgcaggaacttcaacacctgaggagtgagcgagaccgcattgagaatgaaatgcatcatctgaacgaattcaagaatgcagatgaagataccaagaagaatttctctgctactggggaccagattgatggtatagctgctgtgaaggttcaaactggagaatctagcaggcccaaaaggaatgtgctggtgacagtagagattccttatagtgaatgtgacaatgttgataagatatacaaaaaggtgtcttctggagttagacctactgccttgaacaaggtcaaagatcctaaggttaaggctttcattgagaagtgccttgctcagccaagggctaggccttctgcagctgagcttctcagagatcctttctttgatgagattgttgatgatggtgacgaaaatgatgactgttcttgttcatatcaatag

SEQ ID NO: 18344 - DNA, 1107 bp, Glycine max
  Peptide Sequence Number=SeqID_110029
atgcctaaagactatctgcagagttgtagacatgaaggttggagcagtgttgccaaatttctaaccgaagatgtccctcaacttctaaagtcagaggatctaaaagacattcaggaagtactctctcatgcttttaaatctcctcccagtgaattgagagggttaataacatggattgctgaagtttgcagacaagaagatgggaatctcacactgagtgaggatgagaaaggaaggctagctatcaaggctaacatactggaacagattcaaacaactggactcttcaaacacgtgacaaggtggttggattctaaaatttcatgttgtaattctttagcaaaccttggtgacaaagatatgttaccagcacttactgcccctgtttgttgccaagtagcagatcttttgactgtttgtggtaggctaggtttgtcaggtggaaaatattgtagtcaaatagatgtaaaacatctgaatgctgatagtgaaaatccagtaacattagtttcaggaactattacaactagtggtggtagtgaacaaggagttgatgtgttggtccctttgtgtcaaagggaaccaagtaggttgtgtctttctaatgaaggtcactgcattggtatgcacccgtctactgcaaacgtcttaacggtgcttttattggccttgcccttgcatacgtggtctggcattaaagaagaaaagttgcgtgtggaagctttgagccttctagcaacagaagatctccctcccctacttcaggaagagatatggacttttcggtctagtttgacaggtgtttatagattgaagtggctcgtatctgtcaatttctgtggaccatctggtttacaagaaaccaatgactgttttcaacaaaggaaagtccccatgcgactactgttagaaaaatatcagaatttagttgtgcctgcaactgaagtggtatcaaatgataatgtccaaattcataaatggaagcagccaactgtatgttttatgaaagccaatttggatgcctctgtgaagaagaatatagggacttcggtgaagtcgttgctgcagcatctttggttattcctcgctgctagaaatctcatgtag

SEQ ID NO: 18345 - DNA, 237 bp, Glycine max
  Peptide Sequence Number=SeqID_110030
atggtgcaacgtctcacctactgcaagcgctacagctatgccaccaaatccaaccagcacagagtcgtcaagactcccggtatgtctccatttgagaggcaagacatcttacttccttccagcacaaatggtgttaaagacctacacatttctgcttctcatagtagtggcctagctctctttgcttctctaggaaagaaattatcagtgctcaggcatgtttgtattaagtactaa

SEQ ID NO: 18346 - DNA, 309 bp, Glycine max
  Peptide Sequence Number=SeqID_110031
atgacccctactcatgatgtcctgctatattacaacgggaggtggaacatgccacgtcaacatgactttgtcggttactcgttcacaagaaaaaatccaaaaagatttgacattccttcgggatgtatcatcgatggagtgaaggatgtaatcaagaaagttgcatctcaagggattcccccttataatattcatgaatcacaaacggtaagacgattgttttttcgacaactaggtcattctgagtattcagacaaagttatcaaatttgaagttattgagctgaaaactgatgatgacgtgttaaag

SEQ ID NO: 18347 - DNA, 543 bp, Glycine max
  Peptide Sequence Number=SeqID_110032
cgatacatgaaggtgttaaagggttataccaagaatcaataccgaccagaggcttccattgtggaaagtcgtcgtgacctgacactaggaggtaagggtacacaaggatacaatgatgccacaatgattcgacaagatgtttcacaagcacatctatatatattaaataagataccagagcacaatagaactttcatcaactggtttaaagaaacaatctttgctgatgatagtgcttctcaaacattaaaattgttagttgttgggcctaatctcaatgtccctacttggaagggatatgggcgatgcggggctcacgggtgtgtcttccaagggaggaaggtgatgcaatcctaccccccaaaggtatcggatagaagacaccaagaggcttgggctagagctactaaagaaggccctagggttctcatgaaccttaggctaagctctagcttctcaaggaagcttctcaaggaggaagttttctcaaagaagcttctcaaggaagttttctcaagaaagcttctcaaggaagctacctag

SEQ ID NO: 18348 - DNA, 345 bp, Glycine max
  Peptide Sequence Number=SeqID_110033
atgggtgactttgttgaggatagatgggaatggaagctaaactggaggagaaacttttttgaccatgaaattgacatggtagcagcattcttggctgagattgagaatgttcacatccaacattccagcatggatattctaatatggaaggctgaccctagtggtatttattccacaaagtcagcttataaactcttgcaggaagctgacagtgtagctattgaggacagtgcatcaaagatcattcgaaatctgaaaattcctccaagaccaattgctttctcatggagatttttcaaaaacagattacctactaaggctaatctgagaccacattcactttaa

SEQ ID NO: 18349 - DNA, 389 bp, Glycine max
  Peptide Sequence Number=SeqID_110034
atggggaactcaacatcgtcatcaaacgcacgacccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 18350 - DNA, 68 bp, Glycine max
  Peptide Sequence Number=SeqID_110035
ggcataaagggaacgtaaaaatcaaagtcatgtttgcacattcgattaaaggctgtcgtgccttgtga

SEQ ID NO: 18351 - DNA, 773 bp, Glycine max
  Peptide Sequence Number=SeqID_110036
gactacacgtcctcgcattcagaggactgcacatccacgccttcagagggctacacgccctcaccatcaaaaggcaacacgccctcactttcagagggccgcacatactcgccttcagaggactacacgtcctcgccttcataggactactcgtcctcgccttcaaaggactacacgtcctcaccttcagaggactacacgtccttgcctttagaggactacacgtccctgccttcacaggactacacagggctacacgtcctcgccttgccttcagagcactatacatcctcgccttcagaggagtagacgtactcgccataaggggactacacgtcctcaccttcataggactacacgtcgtcgccttcagaggactacacgtctttgccttcataggactacacgtcctcgccattagagggctacacgtcctcgcattcagagggctacacgtcctcaccttcagaggactacacatccttgccgtcataggactacacgtcctcgctttcagaggaatgcacgtcctcgcctttagaggactacacgtcctcgccgtcagagggctacacgccctcgacttgacttcagaggactacacgtcctcgccttcagaggtctacacatcctcgccttcggaggggtatgtcgcaacatgcccttttgcgggcgagcgaaggcgaggctcacgggtcgacaaaagcgggactcttgcttctatgtaccctccatcgaagaggaaatcagacctacgtagttctttcttaagg

SEQ ID NO: 18352 - DNA, 300 bp, Glycine max
  Peptide Sequence Number=SeqID_110037
atgaccaaacttggtctctgcttgtcatctgctctggatgacaaaagggtgcggataaccgtaaggtatctccgcgtatcatgggtgcagaatgaccaaacttggtctctgcgtgccatcggacacagactgtgtctgaatggcaaaggggtgcggataaccgtaagaatgaccaaacttggtctctgcttgtcatctgctctggatgacaaaagggtgcggataaccgtaaggtatctccgcgtatcatgggtgcagaatgaccaaacttggtctctgcttgtcatctgctctggatga

SEQ ID NO: 18353 - DNA, 643 bp, Glycine max
  misc_feature (7)..(7): n is a, c, g, or t
  Peptide Sequence Number=SeqID_110038
atgcaantcttctgcaaggcgtatggaaagattttagatttgaccatagcggagatattcacggaagccgttgtatccctcacccaatactatgaccagcctttgagatgtttcacgtttggagacttccaattagtaccgactgttgaagaatttgaggagattctaggatgtcctcttgagggaagaaaaccgtatcttttctccgagtttcttccctccttgagcaagattgcagttgtggtcaaggattcagcaagagagttagatcgtgtaaagaaaactcgaaacggcgtagtgggcctaccacggaagtacttggaaggcaaggcaagggatatggcgaatcaagaggagtgggtcccgtttgtggacgtattagcattgctaatctttgggggttgtcctctttccaaacgtggacggtttggtgtgagaagagtagcgcacggatcatctgctgcttacccgttctttgtgtatgtagattgggaccaacacttggctgggataggaggcagaacaatcaactggtttcctcgttggaaggaaggaaaggagggagttctcttctcatgtggggactacccaaacatcccgttgatagggacgaggggttgcattaactacaatcctgcactgg

SEQ ID NO: 18354 - DNA, 159 bp, Glycine max
  Peptide Sequence Number=SeqID_110039
atggatccgccactcacaactccagaggcctatcgccagcaggtcgcctggccaggagaccggccctccactgacagggaggaaaggccttctggagccgccgctactgaggatcctgcagttgatgaaggccttatagctgacttggcgggcttctag

SEQ ID NO: 18355 - DNA, 552 bp, Glycine max
  Peptide Sequence Number=SeqID_110040
atggttcagggcaccacgtcggatgccggtaaaagtacgctggtggccggattgtgccgtgtattgtaccgcagcggggtggcggtggtgccattcaaaccgcaaaacatggcgctcaatgctgccgtgacagaagatggtggcgagatcggtcgtgcgcaggcggtgcaagccatggcctgcggattgccgccacataccgatatgaacccggtgttactcaagcctaactcggataccggttgccaggtgattattcatggccatgtgctgggtaaccaggaagcgagtacttaccacgactataaaaaaaccgcgatgcaggccgtgttgcaatcttatcagcgcttacagcagcaatatgactgcatcatggtggagggggcgggcagtcctgccgagattaacctgcgggccaatgatattgccaatatgggctttgccgaagcggtcgattgtccggtgattctggtcgcagatattgataaaggcggcgtatttgcacacctggtcggcacactggcgctattgtccgagagcgagcaggccagg

SEQ ID NO: 18356 - DNA, 350 bp, Glycine max
  Peptide Sequence Number=SeqID_110041
atggcgactagtaagtatttaattgctcttggagcctttggcagtggtcccagcatgttcattcctcacacgacaaaaggccaagggaagctcaaactatggagattgtcaacagggatgcataaaatgtctgcaaactcttggcatcgtctgcactttttagtaaagtcaagtgcatttgcccagagtgttggccagcattttaacaagggtgttgtcaaccctcttttgaatagctcgcgatcaaggatgactttggagtgtctcttggatgatagtcttgaggtgcccagtctttttagtgctggccaacttggagagcaggtctgctctggtgttgctctccctgg

SEQ ID NO: 18357 - DNA, 1011 bp, Glycine max
  Peptide Sequence Number=SeqID_110042
atgtggatggatcagtttgctcttaccttgaacgggagtcaagaacttccccgcttgttagccaaggccaaggcgatggcagacacctactccgccctcgaagagattcatgggcttctcggctattggaaaaacaccataactaaacgcgccacaaggtatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacacggccaccgctgccgctgtcagttcggctgccgaagcagacccgactctcttggcaactgcgcaccatcctccctcaaacatacggcttaccctttatggattgccgcccaactattcaccacccgtcttgcaagaagatgcgggccacattgcttctcccgtccatgaaagagaacctcctcagcagcccgacgaagtccataaagaccctcaagattatgctcgaagggatgtcgagttctatcccccggtccccgaagggccggcaccaggcacgttgcctcaacccaacatcacggcatcgccaatagttttgtccatggaagggccgcccccggcaactgaagaaaggaggaagctcgatctccttgaggaaagattgagggctgtggaaggatttggggactatccgtttgcggacatgacggatctttgcttagtacccgatgttgttattcccccgaagttcaaagtgccggacttcgacccccccccaagggacgacttgtcccaaaaaccatctcaaaatcttggccggagctgcggtagtgtggttgtcgcaacctacccttcggcgggagggcgacgcgtgactcgcgggatgcgtgttccacgaaaggaatacgcacggagtcgccaccaacgtttatttgaggaaaacgtcggaaaaaccggaaagacgcgatctacgaacttttag

SEQ ID NO: 18358 - DNA, 273 bp, Glycine max
  Peptide Sequence Number=SeqID_110043
atggagagaagtcataacttcaataatgggaagagatcccaagatgtttctcctacacttaaatactataagtgtaatcaactcggtcacataaaagcaaactgcccctcaaatgagtcatggcccgagaagaatgagaagaaaagctataaagaaagaagatccaagaaggcgtctagggatgacaatgactcatccaatggttcggagaaggagatcaaccttctatccaaggactatgaaagcgataagaacatctctcaagaagattaa

SEQ ID NO: 18359 - DNA, 342 bp, Glycine max
  Peptide Sequence Number=SeqID_110044
ttggtagctgagccggcactggaaccggtttctgattttgttgaacttgaggaagttgtggaagatgaagatgaccaagatgtgagaaagacaccaataaaagagagtgaaatagaaataaagataaaggaagagcaagaaaaagaaaaagaaaaagaaaaagaaaaagaagaaattgaaaaagaaaaaaatcagaaaaatgaaaaagaaaaggagaaggttgatgaggagaaaaagaaaagcaagagtgaagtttcaagagagaaaaagagagagattacttcagctgaaggaaaggaagtaccatatcaattggtgccttccaagaaggataaagagtga

SEQ ID NO: 18360 - DNA, 345 bp, Glycine max
  Peptide Sequence Number=SeqID_110045
atgtcgaaaaaaccagaaaaggtgtggtctacgaactttaatcgtgaaaggttcgggagttgtttttacgcatggggaaggagaaaagagggaggtggttgccgcccagctcgcgcaggcaagcagggttgcttccaccagaaggcaccgcctttttttggaaccctcaggaaagcccaagtgggcctgaatgttgcgaaacttcacggattacgcaacaatgctcgttttccttctggaacattgcgaaactttacgaattatgcaacgatgcttgtttcgagggttccgaagggagcaaacaaggttcaaggaccgaccacaagtactctcggacgaaattag

SEQ ID NO: 18361 - DNA, 666 bp, Glycine max
  Peptide Sequence Number=SeqID_110046
atgaagcatgactatgtgattgtggccgtcgggctgcgtctgtccaagcttttggaaaccggtactgaagctatggggggtgtggggggagctcaatcccgccaccgtatgcgcgtgggacgtattcaatgcggtgtgccatatgcgacaaatttctttaaaaaccccctgatttccgctcagcaggcagaggcattgctcacgcactatcctgctatgccgcactatccacagcacagtggtgaggtcaagctggccgcgggctggctgatcgatcagtgtgcgttgaaaggctatcgtcttggcggcgctgcggtgcatcgtcagcaggcactggtactgatcaatgaagacaatgccacaccgcaggatattgtcgccctggcccatcatgtgcgtcaggaggtagggaaaaaatttgccgtgtggctggagccagaagtacgtttcattggcgcgcagggcgagcgtaacgccgtcgagctgggtgaagcgctcggtatgagccgcgctgccgtgaataaacatattcagacgctgaaaagctggggcctcgatgtctacaccgtgacagggaaaggttacagcctgccagcgccgattcagttgctgaatgaagaggcgatactggcgcatctgcatcaggcggatctggcggtgattccg

SEQ ID NO: 18362 - DNA, 228 bp, Glycine max
  Peptide Sequence Number=SeqID_110047
atgaatgttttgagtggtgcaaccctcttttgtaaaatcactcgtacacctaacatcttcatggtgtgtgtacataggaactcattaggtaggaataatcaacatgaaaatacagaaaaaggtgttgaggaaaagagcccagagtttcaagaacctcgggatttgaggtcaaatccttttcaagggggagggaataatgcaatcctacccagcaagagcattggatag

SEQ ID NO: 18363 - DNA, 331 bp, Glycine max
  Peptide Sequence Number=SeqID_110048
aagatctcctgcaggtgacttgatccccattgattttgagattaacgctacttgtagaaggcataatctagagagaattagaaaatttttgcaggatttagaagtagcaataattccagaggaagaacctcaatcttctgaggcatcttctagttttcctattacaggacattctcatttagatcctatcaaggaccacatcatggctgaagagccaagaagagtcaccctggaagattattcaagttctaatgtgccacaatttttcaccagcattgcacaaccagaagttcaagtccaaaccattacatatccaccatcattgatttag

SEQ ID NO: 18364 - DNA, 1010 bp, Glycine max
  Peptide Sequence Number=SeqID_110049
gagaggaggtagagatatatcacatagagtttgatgacttcaagacagagttagagaggcgtaatcttcacaaacgcctcaccaacttggttgatgggactattgatgttgctttggcgaaagaattttatgctaatctctacagctctaaggatccttcaccaaagcaagccagagttagaggccacttggtgaagatagacgctgacagcctcaacacatttctagagactcctgtagtcctagaagagggggagacattacccacctgctctaggtactataggttaccatcagaccacagagagattgaggctgctctttgcatacaagggagggggttcattttaaatgctgagggccatccggggaggattctcaggaaggatctgactaccttggcccaggtgtggagtgttatctcttactctaacctggcccctacatctcatacatcagaccttactgtggacagagccaacttgatctttggcctggtctctcatatggacatgaacatcgacgctctcatctcaggacagatgacttccattacccagtctaactcttgcagacttgggtttcctgctttgattatcgccttatgccgagctcgaggggttgtctctgacagcctcacatttgagcgcctaagtccggccattaacttggcctacatcaggaagaactggacaaattttattgctgtagagcctataggtggtagctcctccaggatccaacctatcagtagagaagtgagaccagagactgatgctactcctgagagatcacttaagggcacatcagagcctcatactttaatggcagacctctcctcaccacagcctgtagctgacccttccactcccagacttgtgataccagaggacctgaccacaccagtcctggcactgaacacctctcctccagctactgcagtacttcacttgatagatgaggaggatactcagactcaagatacccaggatctgtctcaggaattttaa

SEQ ID NO: 18365 - DNA, 231 bp, Glycine max
  Peptide Sequence Number=SeqID_110050
atgggtgccttgatcactaacgatggctctagggactctaaacctgcaaaacagattagatttaacaaaatccacaacaaccttagcatcgttagttctggtggacatcaaacacctcacagaacaacatgggttgttgaggcatttgctgtctccatgaaaaaaccacattcaagcaccttgcaagctaccctctatatgccaagatggccacctggtgcggaagaatga

SEQ ID NO: 18366 - DNA, 279 bp, Glycine max
  Peptide Sequence Number=SeqID_110051
gggccagtgggtccccttcgatgcaaacgcactcagtcagtttctaggccaccccctgatcttggaggagggccaacagtgcgaatacagccagaggaggagacaatatctagctttgatgaggaggccattgcccagctattatgcttatcggggcaggatttcacccagaccactgcagggatacaggttagtgtgcacatggctcagctcatttccgacgccatttatcagtttataggtgttgcacccacgagacactgtgtggacccaaagtag

SEQ ID NO: 18367 - DNA, 330 bp, Glycine max
  Peptide Sequence Number=SeqID_110052
atggtcatctacttcctttgtcgaagacttaactatcgatcgaccctactttactttagtctcccttcgtcatccagagacagcaagtccgatgatgagcatagaccaatatggtcatctgctccctttgtcaaagactcgacgtctatcgaccgagactactttagtctccctttgtcatccagagacggcaagtctgatgacgcacagagaccaatatggtcatctgctccctttgttgaagactcaatgtctatcgaccgagactactttagtctcccttcgtcatccagagacggcaagtccaatgatgcacagagaacaatatga

SEQ ID NO: 18368 - DNA, 591 bp, Glycine max
  Peptide Sequence Number=SeqID_110053
atgactggcaagagagtttgtctttacgtttggaccatcctcttggaatgtcagccaacttgcgtgaatcaaactttggaccttatgtttgaaggccacacattgttctatcgagtgccccgggacacctccatgataagcgcaggtcgcgttggggttgtaccattgaaagaaaggagactagaaaatcttcccgggggtcaccagcaccatttggatgggagcgaattctgcaagtttctttaccggaaaattccttctcggattggcgcttgtgctcgaattggagctgtcggcggggcgaggttgtgtaggagccgagttttgagtggggaccctttgtggttgagcgggtgccctttgctggatgggcgttgggctggaggggttttcaacacaggccgaaaagcttggttgatgttgggcatattggggtgccacttgtgctgccaagtccctccaccgttaggcgtactccttaaaggactcatgctcccgcttgctcatattttgcagctaggttctattgggagccatgtcagtattgtattggtaccgcctaatgaaggtagtaatcaagtccttccatga

SEQ ID NO: 18369 - DNA, 171 bp, Glycine max
  Peptide Sequence Number=SeqID_110054
atggggtgtagcaagcaaatgctcacaaaaaatacaagggctgaaaaatcctacatttctaggccaatgggcctgaaatctagcctaaggctcatgagaaccctaaggccttctcttccatctctggctcaatcttcttggaatcttctatccagtgcccttggagggtag

SEQ ID NO: 18370 - DNA, 690 bp, Glycine max
  Peptide Sequence Number=SeqID_110055
atggattgggaccggctctgggccgggataggagcgcacaaaatttcaaggactatacaagcaatccataaggcatgggaaaccccgttaaggaaagatcaagaacttaggggcattcgtaatggcatcattggtgggtaccatgaatggctgaaagttcatatacgaggtttagattggctcaccaagttaaaagtcgtcagcaaagagagtttcgaagcaccggaagaggacgaggaagtccaaactctcaaaagcgagttaggaaaggcaaaacttgccaaggaaaagttcaaattggccgctacacacatccgtaaggagtgtgccggattacgggaagagaatgcaactaccgcacgagcccttgaacaagagaccaagagggctcgcaaggaagagtatggccggaacaaatttcgcggagctctgtggggtagcaacaatgaactcaagctgcgaagggaagagagggaccagtcgcgagcacatagcatggttttgaaagaggagttagttgcctgttcaaggtccaaaaggagcttgtctcagcgtttatgcgagacggagaccaacatgctagctatcatcgctaagtaccaagaagagttaggtctagccacggctcacgagcataggatcgcggacgagtatgcccaagtatacgcggaaaaagaggctagaggaagg

SEQ ID NO: 18371 - DNA, 342 bp, Glycine max
  Peptide Sequence Number=SeqID_110056
gaagagcacggacggaacaagttccgaggggctttgtggggcagtaacagcaagcttaagctccagagagaggaaatggaccaatcacgagtagacagtttgatcttgaaagatgagttgaaggtttgctcaaggtccaaaagaaacttgtctcagcgtttatgcgagacggagaccaacatgttagctatcgttatcgccaaataccaagaagagctaaatctagccacggcccacgagcataaagtggcagacgagtatgcccaagtatacgcggaaaaggaggctagaggaagggtgatcgactcgttacaccaagaggcaaccatgtggatggactga

SEQ ID NO: 18372 - DNA, 276 bp, Glycine max
  Peptide Sequence Number=SeqID_110057
atgtttcatcctgcaaattctattacgtcatgtggacataatatatctcatcatgagtcggaactaccaagaaatataagcaatttacatgatgatgaagatgatgatgatgattatcttgcgtctaactcatacgttgaagagtctttcgatgaagatgatagtgttgatggaatatctgatacagacgatgaagtcaccgacatcattgaaccagttttaattgttcacccaactgaaggtgtaccaggaatgggaaaattcattttggaatga

SEQ ID NO: 18373 - DNA, 330 bp, Glycine max
  Peptide Sequence Number=SeqID_110058
gagtttttcttgaggccttaccaggttacatgggatgccaccgtgttcggggtctttaatccagacttcccgctctacataaagcatgaagacctctccgaaattgcacacggtggtcaatgtctcagcatatcagtgttacagttgtggattctcggacactggcagatggtggtcatcgtgcccaaggaacacctagttgtctggttttgttcattgcataacaggccagacaactaccttaaggggatcattaatagtgctttaaaaggtcttgatgatgctccacagcctaaatcaaaggctcctgctaggtggattgtcgtcaag

SEQ ID NO: 18374 - DNA, 282 bp, Glycine max
  Peptide Sequence Number=SeqID_110059
atgatgatgataaaagatgatgacaaaggtgatgacaaaaagctcaaagatcaatcaaagaacaattcaagagaatcaaaggccaatcaaagaacaactcaagtaaatcaaagagcaatcaagaagactcaagaagaaagtctagagacaagaatcaagattcaaggttcaagatctcccgcaccccaccatcaagattcaagactcaagatacaaggaagaagagaagactcaatcaagataagtattaaaaagtttttcaaaactttgaatagcacatga

SEQ ID NO: 18375 - DNA, 441 bp, Glycine max
  Peptide Sequence Number=SeqID_110060
atgaatgaagaacttcttcaatactgccaaaaggaaatcaaggatttgcttgataaaggcctaatccggaaaagcaaatgcccatggtcttgtgcggctttttatgtcaacaaacaatctgagattgagcgtggaacaccccgcttagtcataaattacaaaccagtaaatcaagcattacaatggattaggctaaagaaaaatccgcctccttggtctgacctccatacccaaacagttaaagaaatcaaagtcaaagtccaatccataaaatgtctgtatcttcccattccacaggcattcaaaattgtcgaaactgatgcatcagacatcggttacggtggcatcctcaaacaacaaaatatatcaagggctcttccaactctctacctgactacctcacccgtgaatttttacagaaaattcccgatgcctcctaag

SEQ ID NO: 18376 - DNA, 807 bp, Glycine max
  Peptide Sequence Number=SeqID_110061
atggaccacatcgtggccaaggtgctcatcgataatggttccagtttaaacgtgatgcctaagagcactttggagaaattaccaatcaatgcttcccacctaaagccgagttcaatggtggttcgtgccttcgacggcacccgccgagagctgtctgttggggcgtccgtggatccactaggtgggagttgttccctctacactccaccaaaacttccaattcatagtggaagggcatctggtcatcgtatcaggcgaggaagacatcttggtgagctacccatcctctatgccttatgtggaggccgcagaggagtcattagaaaccgctttccagtctttcgaggtggtaagcatttcctccgtggattccttctctgggcaaccttgcctgtccgatgcagcagtaatgatggcccgagttatgttggggaacggttacgaacccggaatgggtttaggcaaagacatggcagcataactaaactgataaatgccaaaggaaatagtgggaagtatgggttaggctataagcccactcaggcagatataaagagaagcatcgcgggaaggaagagcggtagtcaaggctcgcggttgagacaagaaggtggaggaagcccgccctgccacataagtaggagctttataagcgcgggtctgggggacgaaggtcaagtggtcgcgatatacgaagatgacgttccgagtacattggatttggtacgaccatgccctcctgatttccagctaggaaattggcgagtggaggaacgccccgacatttacgcagcgagcataatgtaa

SEQ ID NO: 18377 - DNA, 237 bp, Glycine max
  Peptide Sequence Number=SeqID_110062
atgttgttgtttgcattgtcattaggacattcgttgttggacattatattgatcatcatcatagctccatgtggaccttgtaggccttggatcttcttcatcaatagagtcctttgcttcttgaagatcatggcagcagaatggagaaggaagaaagatgattggagatgccacttcaagaagaagatgagtcaagaagaagttcaccaccatatgaagccatggataagagcttga

SEQ ID NO: 18378 - DNA, 225 bp, Glycine max
  Peptide Sequence Number=SeqID_110063
atgaagggaaaccaacaaaggatggagtcgccaactgtcgcaacctacccttcggcgggagggcgacgcgagactcgcgggatgcgtgttccacgaaaggaatacgcgcggagtcgccaccaacgtttatttgaggaaaacgtcgggaaaaccggaaaagacgagatctacgaacttttaagtgaaaggttcgggagttgtatttacgcacggggaaggtattag

SEQ ID NO: 18379 - DNA, 889 bp, Glycine max
  Peptide Sequence Number=SeqID_110064
gaaagtggaaatctatcacacaaagctggatgaattcaagggcgagttagagaggcgtaactttcacaagcgcctcaccaacttagctaatagtagcattagcctcgcgttggtgaaggagttctatgccaacctctatagtcccgaggggccttcacctaaacaagtcaaaatccaaggccacttaataaggattgatgcagacaacctcaatgcctttctagaaacacatatggtacttgctaagggtgaatctttgcctgcctactcaagatattgtaggatgcctactgacattagagaaattgaggttgcattgtgcatacccggccaagggtttattctaaatgttgaaggtcacccagggaagatcctcagaaaagatctaaccacccttgctcaggtctggagtgttctatcctactccaatctggctctgacctcccacacttcagatctgactatggatcgagctaggttaatctttggcctagttactcagctggacatgaatgtcagagccctcatttctgggcagattacttctatggcccagtctaactcctccaaacttgggtttcctgctcttatcatagctttatgcaggaccagaggagttacctccaacactcttgtctttgaatgtctgagccgggtcattaatttggcctacataaggaagaattgttggaaccctgatgatccaacaattattattaggggggccagaagaccaagggcaaggacagctgaggctctttctacatcagcagctcctcctccagctcgtattgtagcagctctttctaccctacctcctgcaaattttcaatgtttcgaagcatacatcaggggcagattattttgctgcaaagtctccagatggtag

SEQ ID NO: 18380 - DNA, 273 bp, Glycine max
  Peptide Sequence Number=SeqID_110065
atgttgggaaacccattctggataccgagcgacggccagaaatccagcgtcaaactgcttcttcacttcttcttttatcttcaaggacgtttcgggcttcatcctcctcaatttctgttttactggggaacacccggggatttagaggcaatcggtgctgcacaatgtcagaactcaaaccgggcatatcttggtgcggcaatgcctgtacctatctttacttccctctttccactgccaattcctaagtctactagctctgtttctccttga

SEQ ID NO: 18381 - DNA, 507 bp, Glycine max
  Peptide Sequence Number=SeqID_110066
gttgcattgtttttgctaacaagagtgcaacccatgttcatgttgtcttcttagacactctgcgtgacctcagtcagattgggatgtatgcatggggagctattgccctgtgttggatatatgagcactttttgtcagttgcggagtgcatcgctgatctagactacaacgaggtgtcaccacgtgcatgtcggtggattgcgacgaatgcgactgtgaagaccaaatctacagcgacgtacaggcaacgtctggatcgactcaggattcctgatgtctgctggatgccttatggggagcatcaaccggtccgggagtttcatttaatttcatgcttttccggtcggctccgttgggggcttgttgctgtcagacaccgaccagaaagggtcatgcaccagttcggatacgtccagagtattcctacacaacctattgattcatgggagtcatttgatgaaatagacgacaggtggatacactacttagaccatcttgcgccaacag

SEQ ID NO: 18382 - DNA, 228 bp, Glycine max
  Peptide Sequence Number=SeqID_110067
atggctccgagaaagctttccgcaaagagatctaggaagggcgccacggctgaagggactagcgccgctcccaagtttgacagtcatcgtttcaggagcgctaagcaccagcagcgtttcgaagccatcaagggatggtccttccaccgagagagacgcgtccagctcagggacgatgagtacacagatttccaggaggagatagctcgtcggcgttggacgtcgctg

SEQ ID NO: 18383 - DNA, 534 bp, Glycine max
  Peptide Sequence Number=SeqID_110068
atgtgctcagtgatcgctgatgccatctatattttgcagggcctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagtcttagcatgcagagccagggcttcgctcctttttcatgccctactccagaccagttcagggcagaggttgcatggcccggagattggcccgaggcccaagccggagaggcacccccagaagctcccggcgatggagaagaagcccacgaggatgaggagatggctgatttgcttgacttcttgggagggagtggagacacgtga

SEQ ID NO: 18384 - DNA, 420 bp, Glycine max
  Peptide Sequence Number=SeqID_110069
atggaggccatgaaagagaaaatgtccacaatgatggaagccatgatgagtatgagaaaaatgatggaggtcaacacagatacagttgttgctgcaagtaccgccacaaaagtggacccaactcacccatctggcctcaatcaaaataagaattccttcccaccatatggcttgcctcccaactatacaccacccaatgttgcacacattcctgatgagaatgtcgaaaacttcgcacccatgcccattgagagccaacaaccccaatctgaccatgcacatgtctctcaacccatgggggagacacatgaagcacccctagaccacaatctagctgacttcgaacttcaccttggatatgccattgaggggcaagcagttggtggtgtaccccttccaaacactttggagggcccttag

SEQ ID NO: 18385 - DNA, 384 bp, Glycine max
  Peptide Sequence Number=SeqID_110070
atgtggcaacccctaggaggtttatctttgaggccctacaaaagggagcttcgcaaaagcccggacacccccccccccttaatggccaaacctgttcctttcccgtaccaaaatagtcacgcggtcccgtggagatatacacctccggggaagaaggaagaagaagtcactgacgtcagctcgctgtcagctaaagtaacaaatatcacgggactgagtggtgtgacccgtagtggtcgtgtgttcgcacctccggacctaccagtccaacccgccgacgtcaagggaaaaggaaaagtggtggaggaacaagatggcgaagcatcccacgcctcgaataaagatattccagcaaaggggcccccggagaaaaaaggatggtag

SEQ ID NO: 18386 - DNA, 117 bp, Glycine max
  Peptide Sequence Number=SeqID_110071
atggaagagaagcttgcttgtggagcttctatggagggtggatctttgagcttcaatgacgtgggggggtggttttccaccatggagatgcagcggaagacaaaggagaagaggtga

SEQ ID NO: 18387 - DNA, 442 bp, Glycine max
  Peptide Sequence Number=SeqID_110072
gagtcagcaggtttgccgccggactacctggtgtttggtaacgctttcacggagctgcgccgcaacgcgctcggcaaaccgctgcgtctggaaacatcaccgaccaaatacacgcggcatagcgtggaggagggcgtttactggtttgtgaaagagtggaaggaagcgcaccagtttgaggcggatcaggcggcgacgctgttccgccacaagtattaccagaacggcgcacacgcgagttacatactgtatatgaccgacacggcccagagcaccagcgacatcgagcgcatttgtcaggcgatgcgcgacaccaaagggagcggcaacttccgcaacctgttcatacgacctgttaagcgcacaccgcgtgccaccttaaatgacgggcattatttcggacattgctggcgggttcggggatgcggtgaaggcggcgcag

SEQ ID NO: 18388 - DNA, 1083 bp, Glycine max
  Peptide Sequence Number=SeqID_110073
atgaaaaaaggcaagtgtagtcgtttctatcctaaaaagttccagccgcatactgttttagatgctgatggttttccagtctatcgtagaagaaacaacggtaatgcaattgagaaaaatggtgttatagttgataacaagtatattgtaccttacaatgcaagattgctcagaaaataccaagtgcatatcaatattgaatggtgtaaccaaagcacttctatcaaatatttatttaagtacatcaacaagggatatgatagggtgactactattttgattgatgaagataacgatcaaactgagaatggtggcacccataatgatgagatcaaagaatatctagattgcagatacatatctccttgtgaatctacttggagaatctttggatttccaatacatggcagaaaacctgttgttgaaagattacacttccatcttcctggccaacatagtgttctctatgaggaccatgatgatattgatgatgatttgtttctagtttgtatacaatcagaagaaagatgttggcagcttaggaagaaaggctataccattggcagattactatgggttccaccaattacaggggaattatgttatttgagaatgatgcttaccgtttgtaaaagagctacctcatttgaggatttaagaacagttgataatgttcagtattctaaatataaagaagcatgttttgctatgggatttttacaagatgataaagaatttattgaggcaatcaaagaagcaaaagactggggttcagcacattatataagaaagctatttgtgttgttacttttaactgcaacaatgagcaaacctaaacaagtttgggaccaaacttggcattggatggctgatgacattgtctataattataaaaaatcatcaacaagtccagcattgcagcttgatgatagaactcttcaaaatttggtcttgcttgaaattgaacaactgctgcaagcaaatcaaagatcgctaagagactatccttcaatgccatatccagaggatgagaattgtccagcttatctagacaatagccttatattacttgaactgaactaa

SEQ ID NO: 18389 - DNA, 1188 bp, Glycine max
  Peptide Sequence Number=SeqID_110074
atggccaatcaaggagattgggtcccgtttatggatgtgttagctttgctaatttttggggtcgtcctctttccaaacgtagatggtttggaggacctagcagcaatcgacgctttccttgcataccaacatagcaaggaaagtccggtggtagctgtcttggcagatttatttgacacatttgaccgaaggtgcgagaagagtagcgcacggattatctgttgcttgcccgctctctgtgtttggttggtttcgcacctgtccctgcaagacactaggcatccatgtccgctccagagccatcgctcttgtactgaaaagagaagaatagattgggaccagcttttggctgggataggagatagaacaatcaattggttcccccgatggaaggaaggaaaggagggagtccttttctcatgtggagggtacccaaacattccgctgataggaacgaggggttgtattaactacaatcccgcgctcgctataagacaactaggggatttcggcgcgcaaaatttcaaggctatacaaagaatccataaggcatgggaaaccccgttaaggaaagatcaagaacttaggggcattcgtaatggcatcattggtgggtaccatggatggctgaaagttcatatacgaggtttagattggctcgccaagttaaaagtcatcagcgaagagagttttgaagcaccggaagaggacgaagaggtccaagctctcaaaagcgagttaggaaaggcgaagattgccaaggagaagttcaagttggccgctacacacatccggaaggagtgtgccggattatgggaagagaatgcaattaccgcaagagcccttgaacaagagaccaagagggctcacaaggaagagtatggccgtaacaaatttcgcggagctctgtggggtagcaacagtgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagctatcatcaccaagtaccaagaagagttaggtctagccacggcccacgagcatagggtcgcggacgagtatgccgaagtatacgcggaaaaagaggctagaggaagggtgatcgactctttacactaa

SEQ ID NO: 18390 - DNA, 461 bp, Glycine max
  Peptide Sequence Number=SeqID_110075
gatcccacattttcctttagagcaaagacaaaccagttctagaggaaatcaagatatcacatggcagaaacatagaagggatcctctctttatcgaggaagatgaggttgtggggcttgatggccatagaggggtgggaaaaaccactcttgccaagcaagtttatgaccaggtgcgtaacaatttcgagtgccatgcgttgatcaggggggctcaatccttctctactgaaggaggggtgaggcacatgttgaatgagcattgcaaagaaaaaaaggaggaccctcccaaggatgtttctaccatcgagtcgttgacagaagaagtcagaaaccgctggcgcaacaagagggcatttcagtatagttccgatggagattgtccagaagaacttaaagatatatctctagaaattgttagaaagtgtaaaggtttacctctagcaatagtggccattggtg

SEQ ID NO: 18391 - DNA, 222 bp, Glycine max
  Peptide Sequence Number=SeqID_110076
atgggggagacacatgaaattccccaccacaacctagccgacttcgagccttggctcggatatgccactgaagggcaagcagttggtggaaatggtgtttcttcgggccatctcagtgtcacccacaaccacaaccctcacattccaagcttaaagtatgccctcatgctatggcagaaatgggaaagatggaaaggctcagggccatttggaaggaggtga

SEQ ID NO: 18392 - DNA, 54 bp, Glycine max
  Peptide Sequence Number=SeqID_110077
atggccgaccagcaggcgaccaagtccaaagccaaaggtagcaagataccttag

SEQ ID NO: 18393 - DNA, 747 bp, Glycine max
  Peptide Sequence Number=SeqID_110078
atggcgagaatagccaaggtagtcaaaatctcggtgcaagaattggaccgagtaaagcaaaatagaaatggggtggtcggaataccgaggaagcacttggaggagaaggcgaaggctttggcggatcgaggtgaatgggcttcgttcattgatgtcttggcactattggtatttggagtcgtcctctttccaaatgtggatgggctagtggacctagcggcgatcgatgccttccttgcttatcactatagcaaggaaagtctggtcgttgctattttggccgatgcctatgacacatttgaccgaagatgcgaaaagagcagtgcaaggatcatctattgcacacctgctctttatgtatggctggtctcgcacctctttcgtcatgaaagtagacccatctgtcccttgcaaggtcactgcacatgtgctgagaaagggaaggccaattgggagcaactcttggctagtatagtggggacatccgttaattggttccctcgatggaaggaaggaagagtcggagttttgtcctcatgccagggattctcaaacatccccttgatggggacgaggggttgtatcaattataatcccatccttgccataagacaacttgactaccctatgagaggagcttcgtcggaagaaagtaccatgcccttcatcgcatggggtttcagtgaccccaatgcagatatttcaaagggtccgaaaggcacggcgtgtggtgcaaaggaaggataa

SEQ ID NO: 18394 - DNA, 640 bp, Glycine max
  Peptide Sequence Number=SeqID_110079
tcagcgtgactcaaaagtcagtatgacagatcttgtgagcgcggaagataacgcttttcgacttacagacagcaaaaagtttatacggataaccactcgggtatttccgtcccgtcagcgtgactcaaaagtcaatatgacagatcttgtgagcgcagaagatgacggcgcagaagacgacgttagtctctgcgtgctattaggcttttcgtcttacagacagcaaaaagtttatacggataaccactcgggtatttccgcccgtcagcgtgactcaaaagtcaatatgacagatcttgtgagcgcgaaagatgacgtaaatctccgcatgtcaacgggcttgtcggccgcgattgacgaagggcaaaacgacgatgtttctctctgcgtgctatcaggctttttgtcttacagacaacaaaaactttatacggataaccactcggatatttccgcccgtcagcgtgactcaaaagtcagtatgacagatcttgtgagcgcggaagatgacgtaaatctccacgtgtcaacgggcttgtcggccgcgattgacgatggcgcagaagatgacattattctctgcgtgctatcagcttttcgacttacagacagcaaaaagtttatacggataaccactcgg

SEQ ID NO: 18395 - DNA, 318 bp, Glycine max
  Peptide Sequence Number=SeqID_110080
atgtcttccaaggttattttgatgatgccaaagaatcaagagtcaagaaaatccaaagattcaagaatcaagtttcaagattcaagattcaagtttcaagaatcaagattcaagaataatcaagatcaagattcaagactcaagattcaagaatcaagagaagactcaatcaagataattcaagtggaggatacatccacttggtttttcaaagagaccaagggagggtacatcccttgtggatctttggcttgtaaaggattttacaaggttgaaagaaatcccaagaaccacaggttgcttggggactggatgtag

SEQ ID NO: 18396 - DNA, 216 bp, Glycine max
  Peptide Sequence Number=SeqID_110081
atggctaagctcagcaccagcgtgcttagcgagcttagcgcgagattggtgctaagctcaaattcacttactcgcgctaagcacaagaatggcgctaagggcgacgtcgagatcaggaaaccctttttaatcctgatttgcacagaattgaggggggagacaagagaactgttcactactcaaaggcctgaagagtgtggatttcagagagcgtag

SEQ ID NO: 18397 - DNA, 96 bp, Glycine max
  Peptide Sequence Number=SeqID_110082
atgaatggagagttcaacaggggtgggggtcacaaaccactctttgaggattcacctagtgagtgtggtggtgggactgccacggatatgggctaa

SEQ ID NO: 18398 - DNA, 515 bp, Glycine max
  Peptide Sequence Number=SeqID_110083
atgactaggggcaatccaggtgatttacaaccctttgatcctgaaatagatagaacctttcatagattagttaggcataatgtgtatcctgatcattctgtgcattttgagcattttgagcatcctgatcattttgagcattctattgctggtgattttgaatattctgattttgagcattcgactatttattttcatactgggaacatggctcaacctccacctcgtgagaggactcttagggagatggctgcacctgacttcacttatgaaagcctgtgcgttcaatgtcctgatgagggtgttccatatgctctcaagactggactaatacatttgctgcccaagtttcatggtcttgcaggtgaagatcctcataagcatcttaaggagttccatattgtttgttccaccatgaagccccctaatgtccaagaagatcatatctttctaaaagcttttcctcattcactggagggagtggcaaaagattggctatactaccttgctcccag

SEQ ID NO: 18399 - DNA, 411 bp, Glycine max
  Peptide Sequence Number=SeqID_110084
atgatacgcggagatacttatggttatctgcacccctttgccattcagacacagtcgtgtccgatggcacgcagagaccaagtttggtcattctgcacccatgatacgcggagataccttatggttatctacaccccttttgtccattccagacacagtcgtggtccgatggcacgcagagaccaagtttggtcattctgcacccatgatacgcggagataccttatggttattcgcacccttttgtcatccagaggcggcgggcccgatggcacagcagagaccaagtttggtcattctgcacccatgatacgcggagataccttacggttatccgcacccctttgccattcagacacagtcgtgtccgatggcacgcagagaccaagtttggtcattctgcacccatga

SEQ ID NO: 18400 - DNA, 108 bp, Glycine max
  Peptide Sequence Number=SeqID_110085
atgaagatgctcttgataccacatgatatgaatggtagtggaatggagaaggaagagagagaggagacgccacttgatgcaatcctaccccgtaagggcattggatag

SEQ ID NO: 18401 - DNA, 297 bp, Glycine max
  Peptide Sequence Number=SeqID_110086
atgaatagaaaatatgcacaaaccaaaataccccatgggttgtctccttacaaaagtcacgcgctaatgccattgaggcatttcaccgaacacttggtgggcgcgcgtttaggcatcaatagcaagagaacggggacaatgtggcatagcaccaaaaggagatcaaaatacaccaatgaaaagctagaaagcttagggatggaatacttacttgttggtgatgaacaaaagcgcaaaacggaatcaaaaaatgcgaaaaaggatgaccctagggctgcaaattcgtcaatcccgtga

SEQ ID NO: 18402 - DNA, 312 bp, Glycine max
  Peptide Sequence Number=SeqID_110087
atgtccaaatcttgtggatttgggatgaccggccctctcgatgagtcgatctcttgctttctcataagggtggacccttgggtacttgtacctatcaccttgagaggactacatgtcctcgccatcagaggactgcatgtcctcaacttcagagggctacatgccctcgccatcagaggactacacgtcctcgccttgagagggctacacgccctcatcttggttaccctcaccgttgagaggactacacgtcctcgccttgagaggactacacgtcctcaccatcagagggctgcacgccctcacctctag

SEQ ID NO: 18403 - DNA, 228 bp, Glycine max
  Peptide Sequence Number=SeqID_110088
atggcctcaatcatggaagctgtcgcaacatgcccttttgcgagcgaaggcgaggctcacgggtgcgcttttcaaaggaggaaagatgcgcggagtcgccaccaacgtttatttgtggaaaacgtcggaaaaactgaaggaaactggtcgacaaaagcggggcttttgctcctacgtaccctccatcaaagaggaaatcagacctacgtagttctttcttatgcgtga

SEQ ID NO: 18404 - DNA, 186 bp, Glycine max
  Peptide Sequence Number=SeqID_110089
atgacacctacaccattgcacgcacagaagtggaggtcgatctgtggtcatgccgggtctccgactagcttgataacaggaaagcctcacctagagttttcctcttttgatggtacgttgtcgctggtagtccctaccgccacaatgtttgatatcaaagaggttgatatctctagaaacctttga

SEQ ID NO: 18405 - DNA, 870 bp, Glycine max
  Peptide Sequence Number=SeqID_110090
atggagatgcagcagaagacaaaggagaagagtcttctctatccaatgcccttgtggggtaggattgcatcagaagtgtccgctaaagccatcgtgtccctcactcaatactatgaccagtcgcttagatgcttcactttcggggattttcagttggcaccgaccataaaagagttcaaagggatcttaggatgcccgctaggaggaaggaagccataccttttttctggattctatccttctatggcaagaatagcaaaagtggtcaagatctcggaacaagagctagaccgcaaggaaaacccggtcaccactattttggctgatgcatatgatatgttcgacttgagatgcgagaaaagcagtgcccgaattgtctgttgcatgcctgctctttatgtgtggttggtctcccacatttttcgtcatgaaggtaggtctgtctgtcctctacaaggtaatcgcatgtgcgctgaaaagggaaaagcaaattgggaagaacttttggaaggtatggtaggagcgtccattaattggttcccccaatggaaagaaggaggggcaggagtgttatgctcgtgtgaaggattcccaaacgttcccttgatgggaatgaggggttgtattaattataattccatgctagccataagacaactaggctaccctatgagaggtgcaccgtcggaggagatcatcttgcctttcatcgcacgaggtttcaatgaagccaatgtgaagatacttcagagaatccatagggcatggaatacaatggaaaggaaagataaggagcttagtggaagtagcaatggcgtcatcggcggctatcacaattggttgaagtctaggacgcaagggataacttag

SEQ ID NO: 18406 - DNA, 348 bp, Glycine max
  Peptide Sequence Number=SeqID_110091
cgattaacaggggcacatgaagtaccccaccacaatctagccaacttcgagccttgccttggatatgccactgaggggcaagcaattggtggtacctgtcgcaacctacccttttgcgggcaagcgaggcgaggcttacaggtcgacaaaagcggggctcttgctcctacgtaccctccatcaaagatgaaaccagacctacgtagttcttgcaaaaggggcgaatcaatcgattctttttacttggaaggaggtccttttaaggcgttggaccttaaaatgacccatttttacttggtgagaaaaactgaggtatcgaaccttaaaatcctttttatcgaaccttaa

SEQ ID NO: 18407 - DNA, 394 bp, Glycine max
  Peptide Sequence Number=SeqID_110092
atctcaccaacatgtctcttgccactctctttgggaaacttcaagaacatgaaatggaacttatgagactctatcaacatgaagagaatgataaaaagaggataggaattgcactcaaagcctcatcttcttctattcatgaggaaaatgacaaagaagactcaaatgaaaagaacttaaaagaagatgatgatttcagtctctttgtgaagagattcaataaatttctgaggaacaaaggaaatcaaaggagatcaaaattcaatccaaagaagaaaggagaagattcctccttagttccaaaattctatgaatgtgatcaacttgggcactttagatttgattgttgttcgaacccggcaagtgcattggatcacacaagtagtataaaacg

SEQ ID NO: 18408 - DNA, 540 bp, Glycine max
  Peptide Sequence Number=SeqID_110093
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccgcgggccctgacgcttcttgcacaggggcctggcggcggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccg

SEQ ID NO: 18409 - DNA, 236 bp, Glycine max
  Peptide Sequence Number=SeqID_110094
atggaacttcaacgtctcaaccaaaatgaagagaccgacaaaaggaaaagaagcatagcactcaaagcctcctcctcaatgcaagaagaagaagaagaatctgatgatgaagaggacttctcactctttgtgaagaagtttcataaattcgtcaaaaatagaagaatggagagaagccataacttcaacaatgggaagagatcccaagaagtttctcctacacttaaatgctatag

SEQ ID NO: 18410 - DNA, 556 bp, Glycine max
  Peptide Sequence Number=SeqID_110095
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgaaattcataatccaccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18411 - DNA, 267 bp, Glycine max
  Peptide Sequence Number=SeqID_110096
atggtgtcgcttgccaacgtcagaatgcataagcgatttcctcctcaaattttagccagcccgcatcaattagactttgcacttatgtttaagagtcctacaatgctcaatggaatgcctcggaactcccccatgataagcacatgtcaagttggggttgtatcatctaggaaatggagttgctttttgttccactttttctttgttgaaatatattcaaaggaaatccggtttgctggaaagcgcaccggatcatcaagtatttaa

SEQ ID NO: 18412 - DNA, 558 bp, Glycine max
  Peptide Sequence Number=SeqID_110097
atgggtaggctccaagatacacatcgcgttgtgaactctgcatccaactctttatgtaactttcagattcaaactgcgattgcccagacctctgaatggactatggctcgaggaatccatagatatcagaattccccgctcgcatacatgtttcagaaagatattgagctggtagacgaggaagaagcacagattggtgctgatcgttctagtgcaacttcaaataaagctgagatttataacgaggaggcacggaagaaaacacagaagcataaaccaaagagggtggagagtgtcaatgctgatgcagaagcctttgctgaagcactagaacatatgaagaaaagagatacaggccatcaaagtgtgtcattggagaataagacaggagatttaactatgctgaagataggagattcagctaaagttgtgataaaacaagacatgaagggaagaaagcataaatatgggtttaacaacaataaacgtcagagacagagaagaaaagggtggtggatgatgaaattggcgacaaacatcagctggatgaagtcctaa

SEQ ID NO: 18413 - DNA, 306 bp, Glycine max
  Peptide Sequence Number=SeqID_110098
atgtctttagaagtgtttgagaaactggaatcgaaagtacagcaggcgattgacaccatcaccctgctgcagatggaaattgaagagctgaaagagaagaacaacagcctggcgcaggaagttcagaacgctcagcacggccgcgaagaactggagcgcgaaaacaaccagctgcgcgaacagcagaacggctggcaggatcgcctgcaggcgctgctgggacgtatggaagaggataatgccggtattatcggcgtagagatggtccccggagaagaaggtcacgccgccgaaattgacgcgcac

SEQ ID NO: 18414 - DNA, 796 bp, Glycine max
  Peptide Sequence Number=SeqID_110099
aggactacacgtcctcgccttcagaggactgcacgtcctcaccttcagagggctacacggcctcgccttcagtggactgcacgtcctcgccttcagagcactgcacgtcctcaccttcagagggctacacgtcctcgccttcagaggacaacacgtcctcgtctttggaggacaacacttcctcgcatttagagggccgcatgccctcgcctttagaggactacacgtcctcgccatcagaggactacacgtcctcgcctttggagggctgcacatcctaaccatcgaaggactacacgtcctcgccttgagaggactacaagtcctcacctttagagggctacactcccttgccatcaaaggactacgcgtcctcgtctttagagggctacgcgccctcgctttcgttggattacacgtcctcaacttcagaggactacacgtcctcgcctttcgagggctacacaccctcgccatcagaccactacacgtcctcaccttcacagggctatacgtcgtcgcctttagagaactacaagtcctcgcctttggagggctggacgccattgccgttagaggacaacacgtcctcgccttcagaggacaacacgtcctcacctttagagggatacacatcctcaccttcagaggactacacgtcctcgccttcagtggactgcacgtcgtcaccttcaaagggctacacgtcctcaccttcagaggactacacgtcctcgccttcagaggactggacatcctcaccttcaaagggctacacatcctcgccttcagatga

SEQ ID NO: 18415 - DNA, 549 bp, Glycine max
  Peptide Sequence Number=SeqID_110100
gtatggcgctaccaggcacctctggacccggataagtccaacagggccctgggatttcccgccttgatcacaggactctgccagtcgttcggcgtccccgttgcacctagcaaggtgattcggccgcccatcacccgagcttttattgagaagtactgcacacagagacaggtccagggtgatgcaccacaggccacggacgcgtcgccacctcatcaggctggtccagccgaatcgtttgatatggagcggtatttgcggcatttggttcgccagcaggcagccaaccaccgggctcatgtacagacccatgattgtctttatcagatgagtctcagcctgcagagccagggctttacttcttttccgtgccctactccggaccagttcatggcagaggtcgcatggccgggagattggcttgaggcccaggcaggagaggcaccagcaggggcaccagcagaggctcccgacgaggcagatgaggcccacgaggatgaagagatgaccgatttacttgatttcttaggagggagcggggccacatga

SEQ ID NO: 18416 - DNA, 195 bp, Glycine max
  Peptide Sequence Number=SeqID_110101
atgtacatcagtacggcccaaaaatacatcatgaagcatagccaacaaaacatgttatccaacaaaaccccccacacttattcccaaaacaattccaaagctccaaaattccttaaggttaaggaagcatcaacaagaatcaagccaaggctattatgcaagcaatcaatggggaaaaacacaccaaatgattaa

SEQ ID NO: 18417 - DNA, 322 bp, Glycine max
  Peptide Sequence Number=SeqID_110102
gtcgactctagaggatcccccaaccatcagggaagtggttgaaatgcttgcacaagcaaagaaaccaaatgcattccaaaagcagttgcccagaaaagtagcagataatctcattggaatccagcgcagctttttatggggaggagggaccttcaacaaagttcttctcgagaagtggagatgggatttgtttcaccaaagcaaggagctgtgggccagaatattggcttctaagtatggtggtgaacagtatggagggtgggctgtggggataaaattcatttctgggaggattaatggactggaattggtcaaccactaa

SEQ ID NO: 18418 - DNA, 147 bp, Glycine max
  Peptide Sequence Number=SeqID_110103
atgatgcaatcctaccccgcaagggcattggatagaagactccaagtagattgggccagagatccaagggaaagtcctagggttctcatgagccttaggctaagctctagcttctcatctcaaggaggtgacttagctattagagag

SEQ ID NO: 18419 - DNA, 1080 bp, Glycine max
  Peptide Sequence Number=SeqID_110104
atgggatcaaaccaagcaccctcttttaagaaaaggttctatcctgtcaaaatcaagagcctagaagatttggctatgatagaagtttctattgaagccattgcatcccttactcaatattatgaccagccgctaaggtgcttcacgtttggggactttcagttagtaccaatcgtagaagagtttgaagggatcttgggatgcccattaggaggaaggaagctctatctgttttttgggttatacccctccatggcaagagtagcaaaggtggtcaagatctcgacacaagaattggaccgagtgaaacaaaatagaaatggggtggatgggataccaaagaagcacttggaagagaaagcgaaagctttggcggatcaaggagagtggacttcattcattgatgttttagcactgttggtgttcgggttcatcctctttccaaatgtggatgggctagtggatctagcgacaatcgatgtttttcttgcttatcactatagcaaggaaagtcccgcaattgttgttttggccgatgcctacgatatgttcgatcagagatgcgagaagagcagcgcgagaattgactgttgcacacccgctctttatgtatggctggtcgctcacatttttcatcatgaaagtagacctgtctgtcacatacaaggtcaccgcatgtgtgctgagaaagggaaagcaaattgggagcagctcttggtagggttcccaaacgtccccttgatgggaatgaggggggcaccatcggaagagagtatcacgcctttcatcgcacgaggcttcagtgaccccaacgcaagaatgcttcaaagagtccgaaaagcatggaatgcagtgcaaagaaaggataaggagcttaaaggaagcagtaatggcattattggcgaatatcataaatggttaaaggctcggatgcgagagatatcttggctcccgaagctaaagatttcaagtggggaagaggctaaagtccctgaggagagcgaagaagtgctagccttgaaagcagaacttgaaagaacgcgagtggtcaaggaaaagttcaagacgatagccatcagg

SEQ ID NO: 18420 - DNA, 1002 bp, Glycine max
  Peptide Sequence Number=SeqID_110105
atggtggcgacctggcctgcggataccaaagagggctggtggcgctaccgtctgaaaggttcaacgttgctgggtcacgatccggcggagccgctgaagcagccggtcgatgccgaacaggtgaaatcgttctaccagaaatggtacaccccggacgccatgacgctgattgtggttggcaatgtcgatagccgcgcggtggttgaacagatcaacaaagcgtttggcgatttgaaaggcaagcgtgaaacgcctgccccggttccgacactctctccgctgcgcgccgaacctgtcagcattatgacggacaccgtgcgtcaggaccgactctccgtgatgtgggataacgcctggcagcctatccgcgagtccgccgcgctgttgcgctactggcgtgccgatctggcccgtgaagcgctgttctggcatgttcagcagacgctcagtaagaacaacgtgaagaatatcggtcttggctttgactgccgcgtgctgttccagcgtgcgcaatgcgccattaacgttgaatcaccgggcgataagctgaatgcaaatctgggtgtggtcgcgaaagagctggcaaaagtgcgtaaagaggggcttcctgaagaggagttcaatgctctcgtggcgcagaaaaaactggagctgcagaagctgtttgcgacttacgctcgcgccgataccgacattctgatcagccagcgtattcgctctctgcagaaccaggtggtggacattgcgccggaacagtaccagaagcttcgtcaggacttcctgaacggtctgaccgtcgagatgctcaatcaggacctccgtcagcagctgtcgcaggatatggcgttgatcctcctgcaaccgaaaggcgagccggaatatgacatgaaggaactgcagacaacctgggattccattatggctaccgcgccgcagccagcgcaggccgcgacggcggatgatttacacccggatgcgacggatattccgcaggggcagtaa

SEQ ID NO: 18421 - DNA, 1350 bp, Glycine max
  Peptide Sequence Number=SeqID_110106
atgattcctggtccaggccctgttcctgagaaactggtccctaaaagacaacagggagtgaagatttctgaaaaccctagctttgcaacaagccctagggaagaagacactgagatggataagaagatccgcagttttgtgaatagcattttgaaaaatgcttctgtccctgatgctgataaagatgtcccaacatcttccaccccaaatgctgaagtcctcttttcatccagtgaagagaaatcaacagaggaagaggatcaagccacagaggagacccttgcaccaagggcaccagaacctgctccaggtgacttcattgacctagaagaagtagaatctgatgaggaacccattgccaaaaagttggcacctggcattgcagaaagattacaaagcagaaagggaaaaacccccattactaggtctggacgaatcaaaactactgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcgggaaaaagacttgctttagaaagagaactgggaagagatgccttggattgcaaggagatcatggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaaatatgcaatcctgcataggattggcactgccaactgggtacccaccaatcatacttccactgttgccacagaatcttttgctgtcaaattacccattgccttcccaactgtattgtgtggcattgtgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaacgacacatgcaaggtgctggaggcaaccatcaaagccaacacagagaagaaatgcagctggaacgcctga

SEQ ID NO: 18422 - DNA, 126 bp, Glycine max
  Peptide Sequence Number=SeqID_110107
atgggtgcaaatgatatcatcattgataaacagtatgtgtcataccctaatttcgtccggggacctttgctcgatgacgtgcgaccattctttggtcctcgtgaggtgcttggcacccatcattag

SEQ ID NO: 18423 - DNA, 417 bp, Glycine max
  Peptide Sequence Number=SeqID_110108
atgtcacaaaatcttacggattacgcaatcgtcccctctttggcttctggattgttacggaactttacggattgcgcattaacacttccttccaactctcgacatgtcgcggaacttcacagattgcctaacgatgggtgtcaagtacctcgaagtggtcaagcgagggtcgcatcccaacaaacagatggtccctggatgaaattaggcgactctcctcctcaaatctcagccaacctgcatcgatcagactttgcaccttatgtttcaaggtcatacaatgctcaatggaatgccccggggtggtgtttggtcttggatgtgcagcaagtagattttgtggccgatttaggggtggccattgtggatgattgggcattccttgttggtagggtggtgagtaatgggaaggactga

SEQ ID NO: 18424 - DNA, 303 bp, Glycine max
  Peptide Sequence Number=SeqID_110109
atggaaggttcccaacaaaacactcactatcctaaggaaatattgcctaaaattattacacacaaatggaagtttggtaacctattggaggctcccaacacacttccaatgaaaggcctttttgttacaaaacttgaaagcaataaagtgcttcttagtccaatagctcttaaggtggttagccccttgcttcttgactcaattcttcaaggcatggcaccaatcctcctttctaatccctatatggcactcacaaacaaggaaacaaagagacagcaataccaaagaccaaaaaatgaatga

SEQ ID NO: 18425 - DNA, 315 bp, Glycine max
  Peptide Sequence Number=SeqID_110110
atgagaaagcgccacgcttcccgaagggagaaaggcggacaggtatccgggggagcctctagagtcgacctgcacatgcaagctttggtcactggccgttcgtttttcacaacgtttttctgcgttcccgattctgggataaaccctggcgttaccctgatgagctgtaaccctcgccttgcagccgaacgatccccgagtttcgcagcgagcagtgagcgtaggatagcggaagaggccctgcaaccgatcgcccttccccgcgacgttgccagccgatcattggaatgcagcgccgagcggtttcccgactga

SEQ ID NO: 18426 - DNA, 378 bp, Glycine max
  Peptide Sequence Number=SeqID_110111
atgccgatcatccgggccttcattgagaagtattgcacgcctaggcaggcgcagggtgatgcaccacaggccgcagacgcaccgtcaccaccttatcaggttgatcctgctgagtcattaggcatggagcggtatctacaacacttgatacatgagtgtctctaccagctcagcctcagtcagcaaggccagggttccgctccttttacgtgccctactccagatcagtttagggctgaggttgcatggcccagagattggcccgaggcccaagcaggggaggtgcctgcaggagctcccgacgatgtagaggaggcccgcatggatgaggagatgacggagttgctcggtttcttgggaggaagcagagccacgtga

SEQ ID NO: 18427 - DNA, 156 bp, Glycine max
  Peptide Sequence Number=SeqID_110112
atgtcagctgcccttatggcagatagatctggtgttactttccatgaggatattagagtgattttagccattcttgatcctgcgctcattgctgtttcgagaagtggtcctgtagtcattgctggaaagtcaattgtgctgaagcctccaactcag

SEQ ID NO: 18428 - DNA, 384 bp, Glycine max
  Peptide Sequence Number=SeqID_110113
atggccattgaaattttgaccgttgttacgcacccgtcaaaccctttacagcgtatcgcgccagatcgctattttgccgaagttgccgttcgccagcgccttgacgtgctggaagagcagcttcgtatgctggcgaccaaacaggcctttttcgagcggcacaatatcctcgcctcggttaacgtggatggcccgacactgctggcgctgcgtcagaatgcaaaattgcaggaactgatcgccactctgccgtggatgcgttttgaactggtggagcacgtccggctgccgcaggactcctcgtttgcctcgatgtgtgaatttggcccgctgtggctggatgactttggtacgggcatggcgaacttctctgcgctgagcgaa

SEQ ID NO: 18429 - DNA, 456 bp, Glycine max
  Peptide Sequence Number=SeqID_110114
ggtcgatccggagagggagctgagaaacggctacacatccaaggaagcagcaggcgcgcaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccagga

SEQ ID NO: 18430 - DNA, 471 bp, Glycine max
  Peptide Sequence Number=SeqID_110115
atgtcggcatccgaggcagactctacgaaggatagtggccccggagatatggcgatcagtggaggctcttcatcatatcattattttggggacgctacaaaggctactacttcaccttcctccagtgaaagtgaagaagcaaaagggcaagaatctaatgaagaaatatacccccaagaagaaggacaaccattagtggttaaagagaagtgtaaggaggtaagtgtctcctccaagaggttagctaagaaagaaactcattttacaataaagacaaacattaaagaaactttccctcttagacaacctccacattttctcttttgtaaaaagacacttgctagcattgccacacctcctggccttgagtttattcctcaagtaaagaagttgttggatgtgggtttggttcgcaagagcttaaatccttgtgctttgttggtgcccaaaataggtatggggatcctctag

SEQ ID NO: 18431 - DNA, 691 bp, Glycine max
  Peptide Sequence Number=SeqID_110116
atggccggtgaacgcggcatctcccccgaacgtcatgcgcagctgatggcccagtttggtctcgatcagccgatgtggaaacagtacatcacttacatcaacggcgtgctgcatggcgacctcggcatctcgctgaaaagccgcatcccggtgtgggatgagttcgtgccgcgctttaaagccacgcttgagctgggcatctgcgccatgatcttcgccgttgccgtgggtattccggtcggcgtgctggcggcggtgaaacgcggctcaattttcgatcacaccgcggtgggcatctcgctgaccggctactcaatgccgatcttctggtggggcatcatgctgatcatgctggtgtcggtgcagctcaacctgacgccggtctccggccgcgtcagcgacaccatcttccttgacgacagccatccgctcaccggctttatgctgattgatacgctgctgtggggcgaagagggcgactttaaagatgcggtgatgcacatgatcctgccggccatcgtgctgggcaccattccgctggcggtgattgtgcgtatgacgcgttcatccatgctggaagtgctgggtgaagattacatccgcaccgcgcgcgccaaaggcctgacgcgcatgcgcgtgatcgtggtgcatgcgctgcgtaacgccatgctgccggtggtcacggtgatcg

SEQ ID NO: 18432 - DNA, 504 bp, Glycine max
  Peptide Sequence Number=SeqID_110117
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatcacaaaatcgacgctcaa

SEQ ID NO: 18433 - DNA, 423 bp, Glycine max
  Peptide Sequence Number=SeqID_110118
atgccaatctccccctgcagatgtatcgggatcgcgcccacaagacgcccagtgggcccgaagaagttcaacagggccctggggtttccagctctggttacgagcctctgtcagtcctacagggtgcccgttcccccagcgaggtcatgccatcgtgacatagaatcgcacccacaaagacacccagtggacccggagaagtccaacagggccctggggtttccagctctggttacgggcctctgtagtcttacagggtgcccgtttcccccggcaaggtcacgccatcatgacatagagatcatgcccgcaagacacccagtggacccgaagaaatccaacagggtcttggagttgtcaagctctaattatgggtctctgtcagttctacgaaatgcctgccacctccagcaagggcattag

SEQ ID NO: 18434 - DNA, 609 bp, Glycine max
  Peptide Sequence Number=SeqID_110119
agggctacacggctcgccttcagaggactactcgtcctcgccatcagaggactacacgtcctcgcctttagaggactgcacgtcctcgccttcagaggactacacgtcctcgcctttagaggactgcacgtcctcgtcttcagagggctgcacgccctctcctttagaggactagatgtccttgcctacaaagggctacacgtcctcaccttcaaggggctacacgttctcaccttcggaggactagacgtcctcgccttcagatggcaacatgccctcgccttcagaggactacacaggactacatgtcctcgccttcagaggactacatgtcctcgccttcagagggctacacaccctcaccttagaggactacgtgccctcaccttcagaggactgcatatcctcgccttcataggacagcacgtccttactttccgaggactacacgtcctcgccttaagaggactgcacgtcctcgccttcagaggactacacgtcctcgcctttagaggactgcacgtcctcatcttcagatggctgcatgccctcacctttagaggactacaagtcctcgcctttagagggctgcatgccctcgccctttga

SEQ ID NO: 18435 - DNA, 549 bp, Glycine max
  Peptide Sequence Number=SeqID_110120
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctaatttgtctctgcgtgccatcggacatgatcgggcctggatggaaaggcgcagaatgaccataatttgtctctgtgcaccatcggagacgatcgcctctggatggcgaaaaggtgtgcggaatgaccataatttgtctccgcgcgccatcggacacaattgtgtctga

SEQ ID NO: 18436 - DNA, 853 bp, Glycine max
  Peptide Sequence Number=SeqID_110121
atgaccagcctcaacccgtgctacaccgtgggctaccagatcatggaagcgctgaaagtgcatcagggcggcagcaagcgcacgcgccgtcagcgtgccatcgacctgctggagcaggtgggcattcccgatccggcgtcgcgacttgatgtctatccgcatcagctgtctggcggcatgagccagcgcgtgatgatcgccatggccattgcctgtaagccgaagctgctgattgccgatgagcctaccacggcgctcgacgtgaccattcaggcgcaaatcatcgaactgctgctggagttacagaagcaggagaacatggcgctgatcctgatcacgcacgatctggcgctggtggccgaagcggcgcagcacatcatcgtgatgtacgccggtcaggtggtggagagcggcaaagcggtggatatctttaaagcgccgcgtcacccgtatacgcaggcgctgctgcgtgcgctgccggagtttgccgccgacaaagcgcggctggcgtcgctgccgggcgtggtgccgggcaagtatgaccgccctaacggctgtctgctcaatccgcgttgccctccaaatgtcacttcccactggatgatgccgggagaccgacttatgagtcttgataacacgaagcaggattacctgctgcaggcgattgacctgaaaaaacactatccggtgaaaaagggcctgttcggccaggagcgcctggtgaaggcgctggacggcgtctcctttaaccttgagcgtggcaaaacgcttgcggtggtgggcgaatccggctgcggatctgctgaaacacgatccgcaggcgcaaaagctgcgccggcagaaaatccagatt

SEQ ID NO: 18437 - DNA, 287 bp, Glycine max
  Peptide Sequence Number=SeqID_110122
tgacttcctttggataccgtaaggatcggaatggtcaatggctgaagaaagacgcactccctcctcaagatgagcatactcattctcctcctcctcagcgagatgattcagccctcatgactgaagttctttccgagttacggggtcttcattcttatgttggtgaacgtttcgactcgttggatactcgctttgccggaatggatatccgtctcacacaacttgaagaagatgtgggttatattcgtcaaagtttcgatcttccaccaccacttccatcttcttag

SEQ ID NO: 18438 - DNA, 342 bp, Glycine max
  Peptide Sequence Number=SeqID_110123
atggtgaacaacattttcacaccatctaggtacaaagaaatcatcatggtgcagcccaaaccaagtgcgggcctaaaggggaaacctcaccaacatgctctcactttcatgccttcttgcattaaaaaatcaaaggcttgggtccctagacttaaatcatattttggcatttaccctaacctctgcaagctgtccacacatccaaaaatgcaatattcacaaacttatgcgcaaacaccattgaggcatttcactgagcacttggtggatgcacttttgggtaccaatagcaaggggatggggacaatctggcttgccccatcatttcagaacacaacctag

SEQ ID NO: 18439 - DNA, 421 bp, Glycine max
  Peptide Sequence Number=SeqID_110124
atggcagaaccatcaaagaagcgaaagaactcttcgagtcaaagccaacggctttccgagactcaggaaacgcagattccttcctccatttcctcttcctcattgttctcaacagaagaacaatggatacggtacacaaatcttttctcttctcgttccattattgatccaaaattcattgacatggatttcttttccaatgagagttttgaatgcattcaggcatttgagaactccaatctcattcctttcatgtctttaaaattacctatttattctaaattagttaaagccttctattctaatcttgaaattcaagaagacactttgatttctgaagtttacgggataaaaatggtcattgaccaatccttattctatgacttgacccaattatctagtgaaggtgtaccatttgaag

SEQ ID NO: 18440 - DNA, 363 bp, Glycine max
  Peptide Sequence Number=SeqID_110125
atgatatgggttccaaaaggatcttttatcaaagttgacattcaaggaccgaataatgtttgggtttctctgaagaagatttggtacattgatagcggatgctctaaacacatgatgggagatgcatcaaagttcactcatatttcttccaagaatagtggacatgtgacttatggcaacaacaataaaggtagaatccttggagtcggaaaaataggaaaacaagtaagggggtaccttatggttatccacaccttttgtcaaccagaggcaaacgagcccgttgacgcgcagagactaatgtcatcttctgcaccttttgtcaaccagaggcaagcgagcccgttgacacgcaaagactaa

SEQ ID NO: 18441 - DNA, 315 bp, Glycine max
  Peptide Sequence Number=SeqID_110126
atgaattcgtggggctccagactcaatggtggaggaggcatgaacagtgctagccaaacaattcatggggccccagactcgatggtggaggatgcacgaacagcgctaggcaatcaattcgtggggctccggactcaatggatgcacgaacaacgcttggcaatcaattcgtggggctccggactcgatggtggaggatgcatgaatgacaatcaattaatggggctccgaataagatttgatggtggaggatgcacgaacagcgctaggcaatcaattcgtggggctccggactcgatggtggaggatgcatga

SEQ ID NO: 18442 - DNA, 786 bp, Glycine max
  Peptide Sequence Number=SeqID_110127
atgaccaaccctctcaatgagtcaatctcatgctttctcataagggtggacccttgggtactagaacctattgcctttagaggactacacgtcctcgccatcagagggttgcacgccctcaccatcagaggactacacgtcctcgccatcagagggcttcacgccctcaccttcagaggactacacatcctcgccatcaaaggactacacgtcctcgcctttagaggactacacgtcctcgccatcagagggctgcacgccctcgccatcagaggactacacgtcctcgctttcagaggacttcacgtccttacctttagagggctacatgtcctcgcctttagagaactacatgtcctcaccatcagaggactacacgtcctcgccttcagaggacttcacgtcctcacctttagagggctgcacgccctcaccttcagagggctacacgctgtcgcctttgtaggactacacgccctcaccttcaaagggctgcacgtcctcgccttcagaggactacacatcctcaccttcatagggctatatgccctcacctttagaggactagacttcctcgccttcagaggactagacgtcctcgccttcagaggactagacgtcctcgccttcagagggttgcacgccctcgccatcatagggctacacgccctcaccgttagaggactacacgtcctcgcctttagagggctgcacgccctcaccatcagaggactacacgtcctcaccttaagaggagtacaagccctcgcctacaaaggactacat

SEQ ID NO: 18443 - DNA, 234 bp, Glycine max
  Peptide Sequence Number=SeqID_110128
atggagatgggaggagatttccatgaccacatcaagaagttcaatcagttagtaagtcaactgttgaatgcaaatgataaactctctgatgaggagcaggcgctgttgttgttggcctcactaccaaggtccttcaaagctttggtccaaacgttacttgtgggaagatcaactttgaatttggatgaggtgactatcgctcttagagaaaatgaaagaatcatgagaacttaa

SEQ ID NO: 18444 - DNA, 432 bp, Glycine max
  Peptide Sequence Number=SeqID_110129
atggcagcgcaattaatccatgaccgagtggagatggagtgcctagagggagtttgggagaccctcgaaggcaatgcgaggtgccaattccagggcacgattcgattcacaactacttcattagtacatccagaggaacccgcacgcacgcttcagcacactatggagtggatattacctacacctactccatatcgactagtggagccagtccaagtgatagaggtgacgtcatctgaagaagaccctgaggaggacctagaggagcaacctcctgagcctgttgtggatgctcttgactttccagagggtgatgaggatccactcccggaggtggattctcccgaggacgtcatgtcggcatctgaggcagactctacggaggagagcggtcctggagggatagcgactagtggaggttcttcatcatag

SEQ ID NO: 18445 - DNA, 183 bp, Glycine max
  Peptide Sequence Number=SeqID_110130
atgtcgcaacctaccctttggcgggagggcgatgcgagactcacgggtgtgtcttccaaggaaggaaaacgcgcggagtcaccaccaacgtttattcgaggaaaacgttggaaaaacgagaaaaggtgtggtctacgaaccgtaagtgtgaaaggtttgggagttgtatttacgcacaggaag

SEQ ID NO: 18446 - DNA, 123 bp, Glycine max
  Peptide Sequence Number=SeqID_110131
atgacccttcgcttagcgaacatgcacaactcatccttcttccagattcttcctcgcactcagccgaggagtgttgcgctcagcggatggctcgctaagctagcagattggcttagcgaaaag

SEQ ID NO: 18447 - DNA, 327 bp, Glycine max
  Peptide Sequence Number=SeqID_110132
atgacggtgaaaacctctgacacatgcagctccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatgccgagggaactccaaaaccaaaagaggaaatgctgaaatctga

SEQ ID NO: 18448 - DNA, 669 bp, Glycine max
  Peptide Sequence Number=SeqID_110133
atgacggcactgggcgtaccgcttgaacaaaccacttcagtaccgagcggtgtggatacgcagcgtttctatcctgatgacaaatatgatgcccgagcgtattgcgagctctcgcagaacgatttttggctaggtgtcgtatcgcatctgcgccctaacaaaggccacagcgtgttgctgaaagcgttagcgcaaataaacgatcccacggtgaagctggcgattgtcggtgaggggccgcaccgtgaggccctggaggagcagattattcagctcaatctgctatctcgtgtggtgatggcaggacatcgccctgacccgcagcgctggttcccggcttttgatgtggcaattagtccttctcatgatatggaaggcgtgccgcagggggtcttacagtctctggcttcgcggatagcgacgattgctactgatgctggtggtactggtgatgcggttatcgaccgccggacggggttacttattgcgcagaatgatgttgatgcgctacgggaagcgatcgttactctctatcaggacgcatcactgcgccgccagttagcggagcagggctatgagtatctcacaacccattttactcgcgaatgtatgttagaggcgatggaaagcgttttccgctcggcggctcagcgtaaaagatcgcgataa

SEQ ID NO: 18449 - DNA, 342 bp, Glycine max
  Peptide Sequence Number=SeqID_110134
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccttcatttgatccagattgaggttgaggctaataagtggaagcctatttag

SEQ ID NO: 18450 - DNA, 1128 bp, Glycine max
  Peptide Sequence Number=SeqID_110135
atgatctggtaccatgtcggatcggcggacgaagcgcccggtgtttcaggcattgcgcatttcctcgaacatctgatgttcaagggaacgaaaaatcaccccgccggtgagttttcagcaaaagttgcctccattggcgggcaggaaaacgcattcacttcttacgattatacggcctatttccagcgcgtatctcctgaagctctggaaatggtgatgcagttcgagtcggaccggatggagaatctggtactcaacgaagaagccgtgaaaacggaacgggatgttattctggaagagcgtcgcatgcgggtcgattccaatcccgcttccatgctgatggaaaataccgatgctgttcttttctataaccatccttatcgcaagcccgtcatcggctggcagcaggagatggaaaagctgagcctgaagaacgctatcgacttttatcagcaatattacacaccgaacaacgcgacgctcgtgatcgccggagacgtttcgccggaacgcgtgcgcgaactgaccctgaaaacctgggcaaacgttccgaaacgcgctgaagtcctaccgcgcgaacgtccacaggagcccaagaaacatgccgcccgaatagtgacgctgcatgatgagcgcgtgagcacgccttcatttcgtgtatcctggctggtgccgtcttatgcgaatgaaaagcggtttccgaatgcaaagccgggggatgcccccgcgcttgatctcctgagcgaaattctcggcggttcgttgcgttcacgcctttatcaggaactgatagtgaggcagggcatcgctgccaatacaggtgcgagctatggcggtgacgcgctcgatgacggcacattctccgtttatggcgcaccacgcaatggtgccacgctcggtgacgtggaaaaggccgtcgaagccgaagtcgcacggatcatcaaggaaggtgtgagccagacagagcttgatcaggctcgtaaccggttcctgaaagcggttatttttgcacgcgatagccagacaggcatggcgcgaatttatggttcgtcactgtccgttggacagacggtcgacgatatccagaaatggccagaagtcatcaagcgcgttacggggatcctctag

SEQ ID NO: 18451 - DNA, 889 bp, Glycine max
  Peptide Sequence Number=SeqID_110136
aaactggcataaacagctgaccaacttgactgagggaagcattgatgtggcaattgtaaaggaattctatgcaaatctatatgtccctaaggacaagtctcccaagcaagttagggttcgacggcacctaataaaatttgatgttgattctctcaacacctttttggagactccagtggtcatggagcaaggggagagcttgccctcttactccaggtttgctagactgaggcctaatcctcaggagcttgcagcctggctgtgtatccctgggaggggatttgtacttaatgtcgagggtctaccgtggaagctcttgaggaaagatcttaccactctagcccaaacctggaatgttctatcttattctaacttggccccgacatcccatacttctgatcttaatctggatagggccaagttagtctacaagcttgtaatgaagatgaacatgaacttaggatcacttatttctggtcagatttcactcattgctcagtccaactcctcgcggcttggatttccagccctgattactgccttgtgcaaggcccgaggagtcacctcagattctcttaccttcgagtcactcagcccagccattaatttggcttatattaagaagaattgctggaacctggatgacccttcggtaacttttctagggacccaaaaatccatggctagaagatctgaggccctatcttcttcagctactcctgctccccctacccctgctccctttacttttgctctcccttcagcaccagtaactccagttcttccaggtcctttcgctcagagcttagagcctttcatgtctatgctgcaaagcttgcatcagggccaactcctgatcatgcagagtttgcaggatgtggtccagtag

SEQ ID NO: 18452 - DNA, 522 bp, Glycine max
  Peptide Sequence Number=SeqID_110137
atgaagcggttgcccactgatattagagaaattgaggttgccttatgtatcccaggtcgggggtttgttttgaatgctaaaggccaccctgggaagattctcaggaaagatttaacaactcttgctcaggtgtggagtgttctctcatactccaacctggctcctacttcccacacctcggacctgatggtagatcgagctaggctgatctttggcctagtctctcagatggacatgaatgtggagctatcatctctatccagaggggttgcttctgatagcctagtcttcaagcgcctgagcccggttattaacttggcctatatcaggaaaaactgttggaaccctgatgatctgacagttactatcagaggggccaggagagcgaggacaaggccagctgaggccccttccacatctacagctcctcctccagcacgtaccctagcagctctttctgccctaacttctgcatattttcagcgtcttgaagccatgcttcaaagcatccatcaggggtag

SEQ ID NO: 18453 - DNA, 327 bp, Glycine max
  Peptide Sequence Number=SeqID_110138
atggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcagagtggaccattatgcacttgttacacaacaaccacttagaggaagggccaagcagggaggacaacgggtag

SEQ ID NO: 18454 - DNA, 357 bp, Glycine max
  Peptide Sequence Number=SeqID_110139
atggcacgcagagacaaattatggtcattttgcgcccttttgtcatccaaaggcggcgagcccgatgacatgcgaagacaaattatggtcattccgcacaccttttcgccattcagacacaatcgtgttcgatggcacgcagagacaaattatggtcattttgcgcccttttgtcatccagaggcggcgagcccgatgacatgcggagacaaattatggtcattccgcacaccttttcgtcattcggagacaatcgtgtctgatggcacgcagagacaaatggtcattctgcgccttgtgtcaaccgagaggaacggattcggaagtatcaggatgatgttggtcgttcggtgctga

SEQ ID NO: 18455 - DNA, 414 bp, Glycine max
  Peptide Sequence Number=SeqID_110140
atgtacaattatcatgagaaaagaagagctcctgatcttgaaagtgtattggcagacttcatgacatatcaagctaactctaatgcatttaaaagagctgagactcagattcgtaagttggtagacgacatgattaaagttatggtcagaagagaagaagagtatgcagagattgaaacacatcaagaaagcattcttcaagttaacacaatacatcatcaattgatcaccaaagaagaaaaggatgaagtctccattattccagaatatccctgcatagcaacaactggatatgttgtaggcaaagataaaggtcggttggaactcagtgtagaggatcagaaaatctcctttgacctctttgaagcaatgaagcaccccgatatgagtgatgcctattttgaagaagaagag

SEQ ID NO: 18456 - DNA, 120 bp, Glycine max
  Peptide Sequence Number=SeqID_110141
atgaagagatgcattatgcgatcaaggaaaccagacatgggactatcagtgacaatgcatcaccaaaagaggaaaactctagatgagacttcattgttatcaagcgagttggggatctaa

SEQ ID NO: 18457 - DNA, 357 bp, Glycine max
  Peptide Sequence Number=SeqID_110142
atggcctatgggtacaggggtacccttttctattcattatttgtggctgaagaccatgatgagtcctctgtgcataaggtggaaatagagcaaacaaaaatcgtatccttttcacttcaagctttgataaagatgtcttctcctttggaaattagtgaaccaataacatccactcatacaaatgataatgaggtgaatgtacaagttcctgcagattcaactcaagtagaagctaacaatgaagaaaatgaacatcaagaaccagttgtcaggagaaagaggaaaaaaactttagttgtttggaatgattttgatgaaatggaaatctcccctggggtgaagaaagttgttttgtag

SEQ ID NO: 18458 - DNA, 330 bp, Glycine max
  Peptide Sequence Number=SeqID_110143
atgagattactgatgctagaagaaggagaagaagatgcacaaaacaaaagaggaccctatgggtgcatagatcgcattcaaatccttaaaacaaaaactaaccgaatgacgaatgaagaacgatatagaagtcgattacggtctaaccttgctcgcccaggtgagcttagctcgcataggcgagctggttacatcacccctaagctatttgggggcccaagcgagccagaggctagcctaggcgagccgaggttcagaaaaccccctgaaatgacccttttgcccctccttttcagtatgttttgcattcttgatcaaaacattgaatga

SEQ ID NO: 18459 - DNA, 450 bp, Glycine max
  Peptide Sequence Number=SeqID_110144
atgatgatggaacaacaggacaatgtcttgatgagcttaagcactatgttgatggtagatgatgatgaaattgatgctttgctctctaagccaactattaaggagtccatgtttacatcttggctacaaactaatagcattttcaatgaatcaaaacatctaacatatatgcaattcataacaaagtctacatatctagccaaggatagatgttggaagccacgtaaaggaggttatacaattggaaggcttaattgggtgcctccaagtactggagaattgtattatattatgatgatgttggttgtggttgaaggaccaaccagttatgaagaaatttgtacagtgaatggtcaattatatcctttgtttagagaagcttgctttgttatgggtttcttacttgatgataaagaatacattgaggctttaacagaagcataccattaa

SEQ ID NO: 18460 - DNA, 108 bp, Glycine max
  Peptide Sequence Number=SeqID_110145
atgctcaggatgctcaaaagggagaaaaaggattgtaagtcagatggattgccactagtcatacactatattcagcatgcacaactagttgccttcttatgcaagtaa

SEQ ID NO: 18461 - DNA, 507 bp, Glycine max
  Peptide Sequence Number=SeqID_110146
atggctttccaatcctttgaggtggtgagctgcgcctcggtggaaccaagtccgtcgctaccttctctctccaaagcggccataatggtggcgcgtgttatgctcaggaacggatttgatccaggaatgggtctaggcaaggactgcctcgggaatgccgacgtggtcgatatcaaaggaaatccatacaagtatggattagggtacgaacccgagatgccggggaggaggaacgtgacgtcaagatttcgggtggataaggtatggcccgaccgtattagccagtgtttcaccagcgctggaatggcgtccgaggaggaggtggccgcaatagaagaggagttccctcatgacccaccaagttttgtgcaaccatgccaccccgatttccaagtggggaactggcgcgtaatacgccagtcagaagtctataccgctgattcaatgtacttagagcctatagatttccgttctcttttgttttgtgaaacctaccttattaaataa

SEQ ID NO: 18462 - DNA, 333 bp, Glycine max
  Peptide Sequence Number=SeqID_110147
cagaagctcctggctgagaagacgaagaagaagctggaggaagctgcacagtcaggaagcgttgatggcgtcatcgaccctccatccccggccacacagggatccttcgtcccccatggacgtcaggatgttctcgccgctgctattggacgtccagagcaccctggacgtgtccgtgctgctggagccggtgtcaccatcaagcaatactatggatcggctccacggacgtcccgcagcgcttcctccctgcctcctgacgaattgcagcagctgacccagcaaatcagggatcggctagaggagtccatcacagagaaagtgacgaggtag

SEQ ID NO: 18463 - DNA, 336 bp, Glycine max
  Peptide Sequence Number=SeqID_110148
atgcccccacataccaatacagcaggcccctctgataatccaaagaatgtccagactaatatgtctgtccctcctcacagaaaacatgttctggttgcaaatcatgttcctgtccttcagaattcttctgacctcaaagaaacagggaacactgagttggatgatcttatagaagaggggtttgttcaggtgaaaacaaaacaccagaaaaaaggtaaaaaagtgtcactcataaagacaacccgtattgaggatatgcaagctgatgtccaaagaggaagaaatcataaagctgtaactagggtcgaggaggcttcctcccgtccgaatccatga

SEQ ID NO: 18464 - DNA, 657 bp, Glycine max
  Peptide Sequence Number=SeqID_110149
atgacggtgaaaactctgacacatgcagctccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggagagactcaagtctttgttgcggaggttcccaaaccatagtttcgatgatgctgcacaattacctattttctacagtggtttgaaacctcatacaaagatgattcttgatgcctcagctagaggtactatgatgtctaagagcccgaaggaagcaattgtaatcattgactccattgcagctagtgattatcaaagtcaccatgatagggctcctgttcaaagaaaaggcggtttgcgtattgggcgctcttccgcttcctcgctcactgactcgctgcgctcggtcgttcggctgcggcgagcggtatcagctcactcaaaggcggtatacggttatccacagaatcaggggataacgcagaaagacatgtga

SEQ ID NO: 18465 - DNA, 123 bp, Glycine max
  Peptide Sequence Number=SeqID_110150
atggaccctaagagaataaaggtcattcctgagtggcctactccaccaagtgttgaggaaagaatccatgagtttcaagaacccctggatttgagtcaaatccttttcaaggggagggaatga

SEQ ID NO: 18466 - DNA, 138 bp, Glycine max
  Peptide Sequence Number=SeqID_110151
atggctgagcgccaatcagggtcgcgaagggcctgggtgatggtgttgggttcaatgggagaggaggcttggacatggagattaagcttttggatggacagttgcggggatgattgtgaggttggaggaggagattga

SEQ ID NO: 18467 - DNA, 720 bp, Glycine max
  Peptide Sequence Number=SeqID_110152
atggtttggcagtctccaaatcaaaaatcaatcttttccaaactcgaattcgattccttggtcacaatatatatcaaggcattcaaaattgtcgaaactgatgcttcagacataggttatggtggcatcctcaaacaaagagtccatggccaagatcataatacatcaagggcacctcaaattcactaccttactaccttacccgtgaattcttacagaaaagtggtaatgtctcctaaggcatcgggaatctccctacggggaggaaggagtacaggcaaaggagccagactggctcttccagagccaaccatcaagaaatcatcaacctcttctgggtcaccaacccaggctgggtcatctacccagaaaaccaatttagaagggtcatcaacccagattgcctcaatcaaacctgagccatccactcaggaatctcccaaaccggcaaccgccaaacaaacatcggccgactatgcatggccaattgaaacccttcaggcccttcaagacatgggtctgaccaaatttccaaaaataatcaaaaaatcttgggcagacattgcctcagaatctgatgatgaatctgaatcaaatttacaaacaatgatccaaaaagcgtcaatgaccaaaacagccaccaatactaaaggaaaactacctttagccaaagctcaacaccacctacaaaacaaactaacaattatatttataaaataa

SEQ ID NO: 18468 - DNA, 408 bp, Glycine max
  Peptide Sequence Number=SeqID_110153
atgggtgaagtagaggagatacaagagaagatgaaggccgacatggaggccatgaaagagcaaatggccgcaatgatggaggccatgatgagtgtgaagaagataatagaagccaatgcggttgcaattgccgctatcaacgttgttgctaaggggaacccgacgtccctattcggcatcaaccaaatgaatcatccaacctcagatatggtaggcaaagatttgggaagtacgggcggcccccatgatgtgcaaattcaaaataagcacgccttcccgccatatggcctgcctcccaactatacaccacccaatgtggcgtacactctcaatgaggatgtcaataactccactcctatacccattgagagccaacaaccccaaactaatcatgcatatgtctcttaa

SEQ ID NO: 18469 - DNA, 732 bp, Glycine max
  Peptide Sequence Number=SeqID_110154
atgtcaatccttaattcatcaccatgtattgaaccacatacaactacaggttgtcgacctactcaaattggcatgacttctcaacatataaattcaggtagatacacaatattcaattcgaaactaatagagcacatctcgcatgacactgatgacgaactcgatataacacagggagacattgttacagattattcatttgatgacataacaactgaggattttgctcataccgaatatgatggcaatcttgaagcaccatatgacaatgaaaataccggtgcaggttacaaagatattggaaatcctatttggcaatgcaagcaatgtaaagcaaagatgtggtatgatgagaggattaacaaagataaacagacaaaaaatccaaagttttcattatgttgtggtgatggtaaaatacaactgccaatactacatgatgctccgcaacccttgtggcagctactctttgacagcagagactcacaagtaaagaaattccaacaaaacatacgtttatacaacctaatgtttgcattcacatctctcggtgtcaaagtagacacatcctataatactggaagaggtcctcctacattgcgcatacatggtcaatcgcatcaccttattggaagcctcctacctataccggataactcaccaaagtttgcacaactatatatttatgacacggagaacgaagtcaacaataggctttcacaatacccgtaa

SEQ ID NO: 18470 - DNA, 259 bp, Glycine max
  Peptide Sequence Number=SeqID_110155
atggcttccatgatggaggccatgttaggaatgagacaactcatggagaaaaacgtggccaccactgccgctgttagttcggctgccaaagcagacccaactctccttgctaccgcgcaccatcctcccccaaacgcgggaggacgagaaaggaacacactggggcacagcagcaacccccatttgggatacaaccgggtggcttacccttatggattaccgcctaattacacgctgctagtcatgcatgatgacgcgg

SEQ ID NO: 18471 - DNA, 354 bp, Glycine max
  Peptide Sequence Number=SeqID_110156
atgttcttcgagggaaggttgtggaggggcctcaactgttggctgtttctggggttgctgctgttgttggattggtggaggaatgtatggtctgcttgggccagcagcattttggaaggaaggagcaggctgctgttgttgttgctgagggctggaccatctgaggttagggtgattcctccatccagggttgtatctgttgctggaaagcataagcttcaggctgctcaattgctccaggttgctgcatggaagggcaaaggtctgtatggtggtcagcagaggagcacaaaccacaaacccttgcgacaggtacagatttctgattcaaggccagctgggttaccaagttga

SEQ ID NO: 18472 - DNA, 297 bp, Glycine max
  Peptide Sequence Number=SeqID_110157
atgtaccttgtggggggcggcggtccacgggacatagtcctttcaggcagtggccgtttagtccatggtccattagatggtcgatgcaaggccagaaattggaacacattgattccgctcgttcctgtccttcacttcagggcctgtccctcggtgtgggcctctttcctcctcccttttctgctcactcgtaaggggtccggacccccacaaaggttaaggagtcgactgaacatctcagccattggcgggaatttcgcccgcatccgatccccaattcttgttcaccccggatga

SEQ ID NO: 18473 - DNA, 88 bp, Glycine max
  Peptide Sequence Number=SeqID_110158
ggtgttcaagcgcaccatcacccttaataatgatttgcttcaaaaacgcagcagattctatgcaactagggttggtggaagaaggtga

SEQ ID NO: 18474 - DNA, 156 bp, Glycine max
  Peptide Sequence Number=SeqID_110159
atgaaagataagagggatgaggaagaaaaactagaaaaactagaaaaacaaaagaaaaagaaggatagaattaatgaaacattgggcttaatccggattttggttgtggacttgaagagggcaaataaagcagcgcttaccttagttaatttctaa

SEQ ID NO: 18475 - DNA, 324 bp, Glycine max
  Peptide Sequence Number=SeqID_110160
atggaactagctacggaggagttgattaacaaaacacaactccctcccaaaataatctcaacgtcatcatgtcggcttggcggttccacaaaagaatctcacttcacgtactctaccactgtcattctgctcccacgaacaaaggttcacgatcatcacatgtactcattggaatggagaaggaagagagagaagagaagccactccaaggagaagataagtctagaagaagctcatcaccataggaggccatggataagagcttggaggaagaaggtgttgaaagaagggagaggaagagaagagcatgaaatcttgtgctaa

SEQ ID NO: 18476 - DNA, 453 bp, Glycine max
  Peptide Sequence Number=SeqID_110161
atggaggagatcaaagtgaggagactaagggacaacatggtcttaccgaatacggagggagagttgaatctagtagaaatattcaaaggtggcaacgagtggtgggaggaaatgaagattttgggagccaaggtgaaaaacaatgttattgttggtttggaagaagaaagatggaaactgatgatgaatcatcagcttatggctatgatagggaatgagccatttccagtgcctctgaatgctcagagtgaggaaagcctaaaagataaagaaaagggagatgagggcacattagtcgacattagatgtggagaaaaggaaaaagtaatgaagcaacaaatagaggagacattggatgagagagaggacacacatgtcaatgtgggaaaggaaagacaacaagttgatgatagtgctgaactgtcaagggggaaggctcctacaagaggatga

SEQ ID NO: 18477 - DNA, 384 bp, Glycine max
  Peptide Sequence Number=SeqID_110162
atggcaacaatgatggcaatgatagtggtggtggtagttgcggtgacgacaatggtggtaacaatgatgacaatagtagtaatgatggtgacggtgtcagtaatagtggtggtttcggtggcgacaatgatagtggtggaggtggtggtagtgattgtggtaatggtggctgttgcggtggtgacaatggcaatggtgggggtgattgtgacagcgaaaatggcagggagttgtggcagtaacggtggtggtggttgttatggcgacgataatcctggtggctatcatggacatggtggaggaaacaatggtgggaatggtgtcagcaatagtggtgacgatgattcttatagcaacaatggtggttgtggtgacaatagttga

SEQ ID NO: 18478 - DNA, 264 bp, Glycine max
  Peptide Sequence Number=SeqID_110163
atgaattttttgagtggtgcaaccctcttttgtaaaattactcgtgctcctgacatcttcatggtgtctgttcatagggacccattaggtagtgatcaaggggttcccatgaaccctaagagaataaaggtaattcctgagtggctcactccaccaagtgtcgagggaaggagcccagagtatgaagaacctcggtatttgaggtcaaatcctttccaaggtggaggtaatgatgcaatcccaccctgcaagggcactggatag

SEQ ID NO: 18479 - DNA, 446 bp, Glycine max
  Peptide Sequence Number=SeqID_110164
ttaggccaccacttcaagaactctgttagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 18480 - DNA, 647 bp, Glycine max
  Peptide Sequence Number=SeqID_110165
atggaagtgaaggacaaggttgagctcgttccatataggaacttagatgtactagtccaactttacataagggtagagcaacaacttaaaaggaaggctacttcaaaatcttatggctctcactcttatccaaagaaagacaaaggtcaaggcatcttaggggctgcaacttctaagaaaaaagatgataaggggaagaatagaaaaggaaaagaagaacaatctttaatggttaaggagcagtgtaaggagacaatctctgcatcttctccttgcaaaggaacacttgttagcactgccatacctcttaagcttgaggttattcctcaagtaaaggagttgctgcataagggtctggttcataagagcttaaatccttgtgctttgttagtgcccaaaataggtattttgaggaaccaaatccctatgataggtggtatgatgaatgtgttgagaggtgcaaccctcttatgtacaatcacccatgcatccaacatcttcatgattcacatacatagggactcattaggtagtgatcaatgggttcccacgtaccctaagagaataaaggtcattcctgagtggaccactacaccaagtataagggaaatttggggcttccatgacttaacaaacttttacaaaag

SEQ ID NO: 18481 - DNA, 93 bp, Glycine max
  Peptide Sequence Number=SeqID_110166
atggtttccggggcttccgcgacttccgtaaaatttccgaaaaccttggttttctttttcttcccttttgacgtgcttaagccatttatttaa

SEQ ID NO: 18482 - DNA, 674 bp, Glycine max
  Peptide Sequence Number=SeqID_110167
ggtggacccttgaggactacacgtcctcaccttcaaaggactacacgtcctcgccttgaggactacacgtcctcaccttcagagggctacaagccttcacctttagaggactacacgactacacatcttcgccttcagaggactacatgtcctccccttcagaggactacacgccttccccatcagagggctacacgccctcaccttcagaggactacacgtcctcaccttcagaggttgcacgccctcgccatcatagggctacatgctctcaccttcagaggactacacgtcctcaccttcatagggctgcacgccctcgccctcatagggctacacgccctcacctttagaggactacacgtcctcgccttcagagggctacacgcccttgcctttagaggactacacgtcctcgcctttagagggctacatgccctaaccttcagagggctacacgtcctcacgttcaaagggctacacgtcctcaccttcatagggctacacgccctcacctttagaagactacacgtcctcgccttcaggggctacacgccctcaccttcagagggctacacatccccaccatcagaggactacacgtccttgcctttagaggactacatgtcctcccctttagagggatacacgccctcaccttcagaggactacat

SEQ ID NO: 18483 - DNA, 554 bp, Glycine max
  Peptide Sequence Number=SeqID_110168
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctaatgcttcgaattcggagagtggagagcgtgaaggaacgccggccaggacgatagctggccgttacgatgcatccattggaaccaagctaatgcttgaccttccaggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 18484 - DNA, 336 bp, Glycine max
  Peptide Sequence Number=SeqID_110169
atgccgcaggcgcgcctttaccaggcagagagcggaaatttgcggggtggatcggcacgtcagggattgcgggctgataatcgcagcgtgaggaacggtgctttgagtgacgaagcggcggcgttaactgaagccagtataatgcgcagatctcaggcgcaacaaaaagttatcaggcaacttccggaagtgatggctttcgaatacgaagcggaggcaagtgatcgcacaaccggggcagataatcatccggctggcaggctatgtacaaatcccggtgcaatgaccgggattcactctaataaggctgatagtcctcatattgccaaaaactaa

SEQ ID NO: 18485 - DNA, 426 bp, Glycine max
  Peptide Sequence Number=SeqID_110170
atgcagctccgaagacggtcacagctgtctgtaagcggatgccgggagcagaccaagcccgtcagggcgcgtcagcgggtgttggcgggtgtcggggctggctttaactatgcggcatcagagcagattgtactgagagtgcaccatatgcggtgtgaaataccgcacagatgcgtaaggagaaaataccgcttcaggcgccattcgccattcaggctgcgcaactgttgggaagggcgatcggtgcgggctttttcgttattaccccagctggcgaaaggggaatgtgctgcaaggcgattaagttgggtaacgccagggttttcccagtcacgacgttgtaaaacgacggccagtgccaagcttgcatgcctgcaggtggactttagaggatccccaggaagctgtcttaagagcttgagataa

SEQ ID NO: 18486 - DNA, 817 bp, Glycine max
  Peptide Sequence Number=SeqID_110171
ggctgcacgccctcgccttcagaggactacatgtcctcgcgtcctcgccatcaaagggctacacgcccttcccttcagagggttacacgccatcaccattagaggactacatgtcctcccctttagaggactacacgtcctcacctttagagggttgcacgccctcgccttcagagggctccacgccctcgtcttcagagggcttctcgccctcgcattcagagggctacgtgtcctcaccttcaaaggactacatgtcctcgcctttagagggctacacgccctcaccttcagagagctacacgccttcaccttcaaaggactacacgtcctcaccttcaaaggactacacgttctcaccttcagagggcttctcacccacgccttcagaggactacacgtcctcaccttcagaggggtacacgctctcaccttcagagggctgcacgccctcaccgttagaggactacacgtcctcgctttcagaggactgcatgtcctctcctttaaaggtctgcacaacctcgcttttagagggttgcacgccctcgctttcagagggctacatgccttcacctttagagggctacgcgtcctcactttcatagtttccttttatcagttccttttcttgggccacccccctgatcctggagaagtgccaactgtgctagcacaaccccgaggaggaggctatcatgcagctactatgcataccggggcaagatttcacccgtgccgctacaaagagacgagtgcggatcatgcacaccaacatgaccactcttacccaaatatggatgacgttgctacttag

SEQ ID NO: 18487 - DNA, 700 bp, Glycine max
  Peptide Sequence Number=SeqID_110172
taccctcacctttagaggactacacgtcctcatcattagagggctgcaaaccctcacctgcagaggactacacatcctcgccttccaaggactgcacgtcctcacctttagaggactacacgtcctcgccatcagagggttgcacgccctcaccttcatagggctgcacgccctcaccttcagagcactacacgtcttcgcctttagaggacttcacgtcctcaccttcagagggcttcacgccctcgccttcagaggactatacgtcctcgcctttagaggactacacgtcctcgccatcagaggactacacgtcctcgccttcagagcacttcacgtcctcaccttaagagggttacacaccctcatcttcagaggacttcacgtcctcaccttcagagggttacacaccctcatctgtagaggactatgcgtcctccccttgagagggccacacgccattgccttcagacggttacacagcctcatcttcagaggactatacgtcctccccttgagagtactacacgtccacgctttcggagggctacacgccctcgcctttagaggactacacgtcttcaccatcagaggactacacgtcctcgccttcagaggacttcacctcctctccttcaaaggacttcacgtcctcaccttcagagggttacacatcctcgccttccaggggatcctctag

SEQ ID NO: 18488 - DNA, 284 bp, Glycine max
  Peptide Sequence Number=SeqID_110173
agcatgatggcacttgggtaaaaaagggtgctcaaccaaatgatgatgaaggacaattaccggttcaagaagactcttctctccttcagagtattttggataggtttgatggacttcaaacctatgttggtgagaggtttgactccttggaacatgaagtggacacacgattcgaggagatgaactcaaggattgcaaaggttgaagaagatgtaccatcattcgcgactgctttgatttaccttcaccaccaccatcattttagacattactattattattaa

SEQ ID NO: 18489 - DNA, 204 bp, Glycine max
  Peptide Sequence Number=SeqID_110174
atgcagctcccgagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 18490 - DNA, 681 bp, Glycine max
  Peptide Sequence Number=SeqID_110175
atggtgcacgccctcgccttcagaggactacatgtcctcgtctttagagggctaaaagtcctcgcattcagagggctgcacgccctcgtctttagagggctacacgctctaacctttagaggacttcacgtcctcgccttcagagggttgcacaccctcaccttcagaggactgcgcatcctcaccttcagagagctacgcgccctcaccttgagaggactatgcgtcctcgccttcagagggctggatgtcctcgccttcagaggactacacgttctcaccttcagaggactatatgtcctcgccttcagaatggtgcacgccctcgccttcagaggactacatgtcctcgtctttagagggctaaaagtcctcgcgttcagagggctgcacgccctcatctttagagggctacacgctctcacctttagaggacttcacgtcctcgccgtcagagggttgcacacgctcaccttcagaggactgaacgtcctcaccttcagagagctacgcgccctcaccttgagaggactatgcgtcctcgccttcagagggctggacgtcctcgccttcagaggactgcacgacctcaccttcagagaactacacgtcctcgccttcagagggctaaacactcttgcctttagaggagtacacatcctcaccttcagaggactacat

SEQ ID NO: 18491 - DNA, 681 bp, Glycine max
  Peptide Sequence Number=SeqID_110176
atggggacaaatcaaatcggcaagatgttttaccaagtcaaggttaaaggcctagataccaccagcatcaaggaattagggcggttgatggaacctctccaaatgcaagccttccgcaagacttacggaaagatcttagatttgaccatagcagaggtatccatagaggccattgcgtcactcacccaatactacgaccagcctttgagatgcttcacgttcggagacttccaattggtaccgaccattgaagaatttgaggagattctaggatgtcctctcgggggaagaaaaccatatcttttctctgggtgtctcccctctttgagcagaattgcaactgtggtcaaggattcagcaagaggtttggaccgcgtaaaacaaactcgaaacggcatagcgggcctaccacggaagtacctagaagacaaggcgagggatatggcaaatcaagaagagtgggtcccgtttatggatgtgttagcattgctaatctttggggtcgtcctctttcctaacgtagatggtttggcggacctagccaccatcgacgctttccttgcataccaccatagcaaggaaagcccggtgggggcagcgcgatcaattggtttcctcgttggaaaaaaggcaaggaaggaattcttttctcgtgtggggactaccctaatattccattga

SEQ ID NO: 18492 - DNA, 285 bp, Glycine max
  Peptide Sequence Number=SeqID_110177
atgcagtcccaagagcaacagaggttgatgagacgagacaatgtagttgaaggtgctttaccagtcaagcaccatcatgctaaatccagtagaaagaaatatgtcaagaagaaccagccaacaagcaatgaagatagtgcaaacaaccaaaacaaaggtaagggtaaaaagaaaattattcaccttgtaagcattgcggaaaattgggtcacccaccatacaaatgttggaaacaaccagacgcaaagtgcagcaagtgcaatcaacttgggcacgaagctataa

SEQ ID NO: 18493 - DNA, 204 bp, Glycine max
  Peptide Sequence Number=SeqID_110178
atggagcatctgataaacctcgatctagatgttgctgttttatccagaatgaaacaatttagggcaatgaacaagctagggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 18494 - DNA, 402 bp, Glycine max
  Peptide Sequence Number=SeqID_110179
atgaagtcgctaagaggaaaggagatcgcgttggtgaaagtgcagtggggacccgacgagggtgattcaacctgggaggtagaggatagggtgagagaattgtacccaaggtctcattctgagcgttttgatatatatattgcctactttcgaaaacgggccccgacgggtgcagagaaacgcgaactggaaccagagaggtggcacgcaaaccgaggtaggattttagcatccaaaagcttcaaaattcctcctcatttctactccaaattgcaaggagaagtcattttcggagtcttggaacccccctcaacttcgtggggcttcaaatttcaagtatgggtggacttcttctcacatgaaattcgtgggtgttgggtttttgggagttatgatgggtag

SEQ ID NO: 18495 - DNA, 432 bp, Glycine max
  Peptide Sequence Number=SeqID_110180
cttggagggattgatggggacccggtgttgagaggaacaaggataaaggctacgtgggagtacgtgagttcagttgaaggtgggcaactggggatggtggatttatgtatgatttgtggatgtggagagtcgacttgcaccatcgcccgatcgccacctagtaccacatatgacggagtggtacctagagatatgtcgcgggggtcaggagaccttggggacgtcaggcgagctcctggcagtcaaccgataaaagaacaaagaccacaaagcaaggaagcttgtgtggtggctggccaactatggatcttgagtgatatctggaatatggcctctggtattcaattaccaagggccttaaaagggggacatgaagttgagatggcctctggtaatcgattaccaaggggtgtaatcgattacaaggcttag

SEQ ID NO: 18496 - DNA, 255 bp, Glycine max
  Peptide Sequence Number=SeqID_110181
atggcaaagaaagcccggtcgtcgccatttggggccatgtatgacacgttcgaccggggatgtgaaaagagcagcgcaagaattgtttgttgtgcactggctctctatgtgtggctggagtcaagaacttcccgattgctagccaaggccaaagcagtggcggacacctactccgcccccgaagagatccacggacttctcagctattgtcagcatatgatagacttaatggaccatatgattagaaaccgctag

SEQ ID NO: 18497 - DNA, 222 bp, Glycine max
  Peptide Sequence Number=SeqID_110182
atgccgaggattatgacgagaggagaccgcgtgcatgccgatggacctctagcagggcactgcccgtgtcgacatgtgtatcagcaaccgatggcggcagcggcacctgatgaagcagacgttgatgtgcatcgtcctggacatgcagtggatggttatgtagcaattgctgataagttggagagactactgaacctgaggatcctgatcgaaggaacataa

SEQ ID NO: 18498 - DNA, 147 bp, Glycine max
  Peptide Sequence Number=SeqID_110183
atgcggaaaggaccactggaagaaggaggaactaaggccattgacagtgttgaaacactcagaacttgggcgctcagcgcgcatcaggcgctaagcgagcaactaactggaggcgctgggcgtggcggaaaccgttacgcgcgctaa

SEQ ID NO: 18499 - DNA, 216 bp, Glycine max
  Peptide Sequence Number=SeqID_110184
atgggatgttacagcgaatggattaagttcaacgtcaggctttttgtaagatgcttcacctttggggactttcagttaacaccaaccatagaggagttcgaagagatctttggatgcccgctagggggaaggaagccataccttttttccagattctatccttctatggcgagaatagaaaaagtggtcaagatcttggaacaagagctagactga

SEQ ID NO: 18500 - DNA, 150 bp, Glycine max
  Peptide Sequence Number=SeqID_110185
atggcgactccgcgcgtattcctttcttggaagacacatcccgcgagtcacgcatcgcaatcccaccgaagggggccctatacccgggtttgtgggaacataaggagtggaggtgaatctgtgatcattctaggtctccgacttgcttga

SEQ ID NO: 18501 - DNA, 384 bp, Glycine max
  Peptide Sequence Number=SeqID_110186
atgaacgatcggttggattttattttaacagtgattaaacgagattacaacacaaatgatcggttgaaattcattttatcatttattaggcaagataacggcttaaataaacggttaaagagaaaagagggaggtggttgccgcccagctcgcgcaggcaagcagggttgcttccaccagaaggcaccgcctttttttggaaccctcaggaaagcccaagtgggcctgaatgttgcgaaacttcacggattacgcaacaatgctcgttttccttctggaacattgcgaaactttacgaattatgcaacgatgcttgtttcgagggttccgaagggagcaaacaaggttcaaggaccgaccacaagtactctcggacgaaattag

SEQ ID NO: 18502 - DNA, 267 bp, Glycine max
  Peptide Sequence Number=SeqID_110187
atgaagcttgcttctacagataacacatacacggttactctaaccaaattgactttgagcaagagaatggatgagtcaacaaacaggcataatgataatttgggtgtgaacaaaatggggaaaaacattaggaagaccaaaagagaccagcccaattatggcaagaacaacaacagcagcatgaatggggtagacagcaacatccctacagaaagagtggatcctcctggctgcaggaatttgataccgaacagtaggatttattaa

SEQ ID NO: 18503 - DNA, 375 bp, Glycine max
  Peptide Sequence Number=SeqID_110188
atgcaggtttcattgccaaatcacaagagtactgagtcagccattaaaaatttagagatccaagtggaacagctggccaagcaaattgttgacacttgttccaacaaatttggagcaaacacaaagaacaatcccaaggaagagtgtaaagttgtgatgacccgtggtaggatggcaaccatggctgaagaagagaaggatgagaaaatggtggatggagataaacaacagctggtaattgaactagcacctgaactagtggaccctttttgtgaacttgaggaggtggaagatgaagaggatgataaggagaaggagaatacaataagcaagaatgagagggaaataaatgatgagaaaaagaaagaaaaataa

SEQ ID NO: 18504 - DNA, 576 bp, Glycine max
  Peptide Sequence Number=SeqID_110189
aggactacacatcctcaccttcagaggactacacgtcctcaccttcagagcactacacgccctcaccttcagagggctacacggcctcatcttcagaggactatacgtcctccccttcagagggctacacatccttgcattcagagggctacacaccctcacctcagaggactacacgtgttcgccttcagaggactacacggccttaccttcagagggctacacaccctcaccttaaaaggactacaggtcctcgcctttagagggctacacaccctcgcctttagaggtgtacatgcccttgcctttagaggactacatgtcctcaccttcagaggactacatgtcttgaccttcagagggcaacacgccctcaccttaaaaggactacacgccctcgccttccaagggctacacaccctcaccttcagaggactactcatccttgccttcaaaggactacacgtcctcaacttcagaggactacacgtccttaccttaagagtgctacacacccttaccttcagaggactacacgtccctgccttcagaggactacacatcctcaccttcaga

SEQ ID NO: 18505 - DNA, 237 bp, Glycine max
  Peptide Sequence Number=SeqID_110190
atgaccacattagtctttacttgtcaatcggacttgggatctctgaatgacgaggtgcggataaccgtaaggtgtccccgcatgctaccggactcttgggtcatgatagcaaaaggtggggtggtcaacaaaaccgaggctcttgctcctacgcatcctccattcgtgatgaggaacttagacctacatagttctttcaaaagcgagactaaaatagtctcggtgttctctcactaa

SEQ ID NO: 18506 - DNA, 654 bp, Glycine max
  Peptide Sequence Number=SeqID_110191
gcggacaggtatccggtaagcggcagggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtacccagtattggaatcgcgctgttgtgttgagtgtgtcagcaattgtgttgggtgcacaaggcaatagcccctctagcaccacccgcggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18507 - DNA, 601 bp, Glycine max
  Peptide Sequence Number=SeqID_110192
atgatgcgctcaaagataagctgctggcctctctgccgtttaaccgaccagcgcaaggcgcgcgtaaccgccgagattgaacgcgatatggcgctcgacgtgccgatgatgcgcctggtgcagggcgacgtagggtccggtaaaacgctggttgccgcgctggccgccctgcgcgcaattgcccacggcaaacaggtcgcgctgatggcaccaaccgaactgctggctgaacaacacgccaataatttccgcgcctggtttgcaccgctcgggattgaagtcggctggcttgccggaaagcaaaaaggcaaagcgcgccttgcgcaacaggaggccatcgccagcgggcaggtgcagatgattgtcggcacgcacgctatcttccaggagcaggtgcagttcaacggccttgcgctggtgattatcgatgaacagcaccgcttcggcgtgcatcaacgtctggcgctgtgggaaaagggactgcagcagggcttccacccgcatcagctgatcatgaccgccacgccgatcccgcgcaccctggcgatgacggcttacgccgatctggatacctccaccatcgacgaacttcccccgggtc

SEQ ID NO: 18508 - DNA, 306 bp, Glycine max
  Peptide Sequence Number=SeqID_110193
atgatcgttcatacccttgggttcgatggccctatgagtctatcccccatggaaaacctgaaggggaggaatgacattcagattgctggggagaccaatactgctccaattgccatggccgaacgtttgacactccatcaaaccatacagatgccatttgtcctggtcctaaactgtctagtttttcctcgaacggtcatgcatgcctcatccgggaattcgggacctgcatgggctgatagtcgttgggctgctgagccaaataatctgctaggcgctttcttttatcccttttgggtgacataa

SEQ ID NO: 18509 - DNA, 308 bp, Glycine max
  Peptide Sequence Number=SeqID_110194
atggccagaacacgaagtttaggtcgtgccataggtagagttgtaggcagagatagacctgctgacgatgatgctggcgatgttcctgagaggcgtaggcctactgcctcagcccgtagactacgcgtttatcagatgactacggagggacgtgatatgactgaggacgtcgctgacatgactgatgatgtccctgagcagcctacggaggcacctgagatgcgtgtggacgcacagggtgctgatagtggtgaggggtcagatggtgatgatgctgcagagggattccttggtggtccacgagaccc

SEQ ID NO: 18510 - DNA, 201 bp, Glycine max
  Peptide Sequence Number=SeqID_110195
gattcctttgaggagcaggccacacagggatccttcgtccttcatggacgtcaggatgttctcaccgcggctattggaagtccagagcaccctggacgtgtccgtgctgttggagccgatgccaccatcaagcaatactttggatcatctccacggatgtcccacagctcttcctccctgcctcctgacgaattgcagtag

SEQ ID NO: 18511 - DNA, 1383 bp, Glycine max
  Peptide Sequence Number=SeqID_110196
atgaatgagtgttgtcctgtgtcaggtgtggaaaccttgaccagtctaagagaattgcaagtcgacgtggcttgtcaagcccccgagcttggacaagtgttgttcgggctgtttttatcaagtgagtgcattgaagacaaacgttacttttgtctactgcaacagacgtgtgcggtgcatgtgcaacactcttgcatacatgtcactcatggaatgggcacgtactggagtagtggttcatgcgtgagtgggaagcgttatggtcattgttcattgtcttcttgcttccttgctttcttgctagcttttgtgctttctggctttcggtttccatttcttcttcctccaacttccaaaggcggttccaggtctaaggatactcaccaaggtgcgtccaataacgagtcatcctctactaagagggtgagggcctcgcgtcaaacaggtgggggtgcttctcgccctagaggagggtcatggctttccgctactgccggggagcctgtcccagtcacggtgaacctccccccttctgcttccgggggtgtgaggaaaggccgtggcggtggacatgtgagggcatctccctgcatgcgacgtagcctttgtgttaggttgccgttgtccatcccgaccattgctggctatgagtgggtgaagctggaaaaccctaaggactcctgtcctgggtgtcaatttacccttgaccacttttcagtgtgctctactggagcacttgaatgtggccccttcctaacttcacctaaacagttgggcgatgttgagtggcaagatcagagtggtttccttaaacaacgtgtccaagaagctgtcttagttattgatgccatggatgatgacatgccactaatgcttaatagggatagggagccctgcttcccgttctactgggagtctaaccccactaggttcaagtcttatgacaaggatttgttgacctttgtggatagggccattttgtctgttccttcagtgagcgatcctctcgctgccttagatggtattatgggtgacttcacctggaggccactcatgaagcagcctgctggtgaggttggtcctgttgctattgctgttgaggtcacccttaatgctccttcctctgttttggcaaagaggaagatggatgatattgttgggtcatctggccacaagaagttgaaggcccttatgagtcttcacgcccaaagatgggctgcagggttgatgcccacagcgggttgcctttcgactgtgcaagatgtgcctctggctccactgaccgtcaagactcttgctactcctgctccttcacctcctcccgcagttgctattcaggaggttgcccatgctgctgatgaagtttttatgccagctgcttag

SEQ ID NO: 18512 - DNA, 906 bp, Glycine max
  Peptide Sequence Number=SeqID_110197
atgactgatcgcgttatcgctttctctattttatgtctggtattcgggttgccgttaggcgtggccgccctctttaccggcgaactgattctggattttgtcttcttctggccgctgtttatgtccgtgctctggataaccggtgggctctatttctggtttcagcttgaacgacactggtcatgggatcacgacacaccggcccccacgctcgccggcgagccgctgatttccattctgatcccctgtttcaatgaggaaaggaacgccagagagaccatcagcgccgcgctggctcagcggtatgagaatatagaagtgatcgccattaacgacggctcgtctgacaacactgcgcaggtgctgcaggagctggcgctggaacagccgcgcctgcgggtgattaacctcgcggaaaatcagggcaaagcgctggcgctcaaagccggggcggcggcggcccggggcgatctgctggtctgtattgacggcgacgcgctgctcgatcgcgataccgcggcttatctggtggcgccgctgatccagtacccccatgtcggggcggtgaccggcaacccgcgtattcgcacgcgctccacgctgattggccgcattcaggtgggcgagttctcctccatcattgggctcatcaagcggacgcagcggatctacggtcgggtctttaccgtctctggcgtcatcgccgcctttcgccggcaggcgctggcggatgtcgggtactggagcccggacatgatcaccgaggacatcgacatcagctggaagctccagctgcgccactgggatatttttttcgaaccgcgggcgctgtgctggattttgatgccggagacgctgaagggcctgtggaaacagcgtctgcgctgggcccagggcggcgcggag

SEQ ID NO: 18513 - DNA, 336 bp, Glycine max
  Peptide Sequence Number=SeqID_110198
atgagtagtgattgcatagtgcaattctccattctcaccctttttcggagcccctggaatggggttttggttcatgtgtcctccactttagagttgggagctatgggtagtgattgcttagtgcaattctccattctcaccctttttgggagccccataaatggtgttttggttcaggtgtcttcccctttagagttgggagctatgggtggagattgtttagggcatttctgctttctcaattttagcttgcatgcctgcaggtcgactctagaggagccccaattcatgtgtcctccaccttcgagtttggagctatgcgtagtgattgcttag

SEQ ID NO: 18514 - DNA, 213 bp, Glycine max
  Peptide Sequence Number=SeqID_110199
atggggaaatggctccgaagaaactctccacgaagaggtctagaagagacgccgcagcaaaagggtccagtgccgcccccgagtttgatagtcatcgtttccggagcgctgagcaccaacagcgattcgaggccatcaaaggatggtcgttccacagagaaaggcatgtccagctcagggaggatgagtatacatactttcaggaggagatag

SEQ ID NO: 18515 - DNA, 1304 bp, Glycine max
  Peptide Sequence Number=SeqID_110200
aaaactatgcgttgacactctcgtccggtaacgccgtcgaacggtgccagattgcttatcagccagcggtgctctttgccgcgatcgagctgctactggcggatgatgaactggaaggcgcggaagtcgtcgttgagctgtggtcggaagcaggcgtgcgcgaacgtactctgacgctgatggcgaatcaaccgcagcgcgtcactcggctattagcaaatcatcaatatgctatttgcctgcagccgacgacgatgaacaaccagttgctgacaacgcctgcgcagcctgcgaccttcgtgccgacggtaggcacgacggttcaggcagacgttgcgctacaaaaaacgcccgttgcgagcgataactttgttgaagttgcggtgacggtattaggcttaccacagggtacggcagctcaacgctatcgtttccgctgcggcagctaccagtacagtttcgtgctggccagtgatactcgccagcagaagctgccgctgcgtttatctgccggggaatatagcgtgcaggtagcagatgtatacatcgccggtacgccgtggcgctgtgatgtcagcgcgccgttgcgtttgctgcaaagcgttaataacgtcacgcttgagtttatccagggcgttccgttgcaggtaaaaggttggccgaattatctggcgcacggcggcgtgacggtgaatgcggcggagacggtcgatctttatcgtggcgtgccgttcagcgcgctgtttaaatatgatggttttgatggcggcggcgatccgattccggcggcggaagtggacactaacggcgatggcttccttgattatgcctcactaccgatccataaaaccgtgcctttggttcgcgagatcgaggccgacgccggccgtgcggtgatgccggtgatggtggtctataccgccaatgccagcggcggcagcgcggtatcggacctgcaggacgaacagcgtctacgcaatcactttggtagcttcattacccagtgtctggcggcgcaatcctggaaagatgaccagcatccggttccggcaacctttgtcctgaatccagacttccttggcgccatgcagcaggagtcttatggctataccgcgctgcgtaaggccaatagcgtacaggtcaatgtccaactggcggcggcgattaatgcgcttccttcgatgccagggttcagcgcgccgacgctgccgactttcagcaacgatttgtacggctacgtacaggcgattaactatatcgttcgccagttcgcgccggacatcgctttcggctggcagaccaac

SEQ ID NO: 18516 - DNA, 339 bp, Glycine max
  Peptide Sequence Number=SeqID_110201
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagtatgggtgatgaagcagggaattatactgaactatgctgatcacttggacaatcgtattggttaa

SEQ ID NO: 18517 - DNA, 282 bp, Glycine max
  Peptide Sequence Number=SeqID_110202
atgtatttggcaccctttgttgtacaatacgtgaagttccgagacatgccagaaatcaaaagggggtattgttacgcaatccagggaggagtgaagaaggaaagggtcagccttcttggcacttcgtattcacttgaaattactgaggaaaattgtttccgtgaagaaaatccaagcagaggcgcttccgtaacgtttccgtgggtgatttcgcaaagattttcaaccgttcttcgtcattcatcgtccgttcttcattgttcttcggtcttcaactggtaa

SEQ ID NO: 18518 - DNA, 273 bp, Glycine max
  Peptide Sequence Number=SeqID_110203
atggggcactgcgccccaaatgcgcaagtaaggagagatgatttttcgggccctcatcatgtgtattcccgagtctttcatctctatgaaatgttgtcgaagtattggcgatcaaattgtcattctttggattatggggttgaaccaagctcatgcttttacgaaaaggttcatcaagtcaagttgaagtatggaagtaaccatcttgcaaaaattggggcaaaagatggatcgtgttacatcattgcttcgtctactgccaaacacgtgtag

SEQ ID NO: 18519 - DNA, 718 bp, Glycine max
  Peptide Sequence Number=SeqID_110204
atggccctcaagcacaaggtccagagcttgatcgaggcgggatggttgacgttccaagaagacgagccaaatgtgaagatgaacccgctcgccaaccatggaggatcggatgtaaatgcaattgaggtggataaactgcaaaagcctaatcatttaaaggatgtaatgacctctaggaggtttatttttgaagccctgcaagaggcgagcgtggttcctctcagtgggcataagggggatccttgcttaatgcatccggctgcaccgcatgatatgaaaacatgtttagtagtggaggagctgttgcagcggatgatagaccaaggccgactagagatcggtgaagagggcatgaaaaagcaacacgtctgcatgcaatcagcagacaaggaaagtcctaggaaatctaagcctttgaagccaagcgagaggaagaagggggccgccagcattgactcactttctgccaaagtgaccaatatcactggactaagcggcgtgacctgcagcggtcgcatctttgcggcacctgacatgccggtacggcccgtgaatgccaaaggaaaagcaaaggtggtcgcagaggagaccaacgaagcaagccccactccggacgaggatgttccggcggggtggttcgctgaaaaaagggaaggcttcggtgaaaaagaggtatccttggaggaggccaacaagttcctccgcataatccaaaaga

SEQ ID NO: 18520 - DNA, 924 bp, Glycine max
  Peptide Sequence Number=SeqID_110205
gatccgtacgcctcccgtacggatcgaagttccgccatcatttcccgccaggatccggtggtctatggagaaggcaagtacgccgacgccctgagcggcgagcagatcggcagctacgagcgcgatggtttcctgctgctggagaacctgttctccgaagccgaagtgcgggcgttgtcggccgaggtcgagcgcatgacgcgcgacccgtcgatcgtgcgccgcgaggagtcgatcaccgagcccggcagcaacgccgtgcgctccattttcatggtgcacgtcctgaaccccgtgctggcgcgcctggtgcgcgatccgcggctggtcaacgtggcgcgccagatcctggggtccgaggtctacatccaccagtcccgcgccaacatgaagcccggcttcaagggcaaggagttctactggcactccgacttcgagacctggcacgtggaagacggcatgccgtcgatgcgcgcgctcagctgctcggtgctgctgaccgagaacaatgactgcaacggcccgctgatgctggtgccgggctcgcatcggcagttcatttcgtgcgtcggcgaaacgcccaacgaccactacaagcagtcgctcaagaagcaggagcggcatccgcacgatgacggccaaggcggggtcggtggtgttcttcgattgcaataccatgcacggctccaacagcaacatctcgccgtggccgcgcgccaacgtgttcatggtctacaacagcatggagaacacgctggatccgcccaagcgttcaaggctggtcacgccgctcgacacgttgaagctggtcggcagctagcgcggcaccttgtccgtggcggatgcttgccggcgctggtcggggcgtgggctgaccggccgcgcgcgggggctacccatgccgttcccgctgcgcgctttccc

SEQ ID NO: 18521 - DNA, 870 bp, Glycine max
  Peptide Sequence Number=SeqID_110206
atggaacctgaattttgggacaaaaatcccttcaaggcgacggccaaggctttcccaccaggatttcactacaaaccaaccaccatcctgaagacaagaactttttatgaattgattttggtagattcaaactcagtatctatcaaacatttcaaagatccaaaagaccaaactttaaacacccactcaaccatccaaatactaaaagttcttcaaccaagacactttggttcggacttgaacaaaggaaagagattttcagttccatttgatccggtaggttatacctattgggattacgttgatgcttggactaaggtgttttggcaccaaaatacccgcttcaagcattcatggctgatatatttcaagaccaacacaatttacaattttcccaactggtttttgcaatggtgggacttctttggaccaatcccagagatattcccaaaaacgcttgcactgtcatggatattctcatggcaatatcgttacagcaagactgaaaagacaaaccaatatccatcactacaaagacacgcatttgtaaaatggtggacacaatttgactcatccaaagcggatccagaacaagtaaaactatggttccaatcccatccagaattcctcaaggcagctgatccagagacttctgtgtttttgaaccaaaagtctcatctggcagcatttttagcaggatcgacatcaaaggaggtcttagctaaaaatctgaaggaagttctacaaatgttacaacaggaagaagaagcttcatcctcaaagaaggaagaaacaagttctgctgaagaagacgaagaagatcccttttaccaaaacgaagattattgttttggtatctgtttagattaa

SEQ ID NO: 18522 - DNA, 406 bp, Glycine max
  Peptide Sequence Number=SeqID_110207
atgtacggaaagattttagatttgaccacaacggaggtatttacggaagccgttgtatcccttgcccaatactatgaccagccgttgagatgcttcacgtttggggacttccaaatagtatcgactgttgaagaatttgaggagattttaggatgccctcttgggggaagaaaaccgtatcttttctccgggtttcttccctccttgagcaagattgtagctgtggtcggagattcagcgagagagttggatcatatgaagcaaactcgaaatgctgtagtgggcctaccgtggaaatacttggaaggcaaggcaagggatatggcgaatcaagaggagtgggtcccgtttgcggatatactagctttgctaatctttggggttgtcctctttccaaacgtggatg

SEQ ID NO: 18523 - DNA, 385 bp, Glycine max
  Peptide Sequence Number=SeqID_110208
atgggatgccacagtgttcggggtctttaatccagatttccccctctacataaagcacgaagacctctccgaaattgcacacgatggtcaatgtctcagcatatcagtgttacagttgtctgggcaattgcagtttgagtctgaaagttacataaagagttggatgcagagctcacaacgcgatgtctatcttggagcctacctaaatggcggatactggcagatggtggtcattctgcccaaggaacacctagttgtctggttttgttcattgcataacaggccagacaactaccttaaggggattattaatagtgctttaaaaggtcttgataatgctccacagcctaaatcaaaggcttctgctaggtggattgttgtcaag

SEQ ID NO: 18524 - DNA, 300 bp, Glycine max
  Peptide Sequence Number=SeqID_110209
atgacggtgaaaacctctgacacatgcagctcccgggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagaattagggatttag

SEQ ID NO: 18525 - DNA, 222 bp, Glycine max
  Peptide Sequence Number=SeqID_110210
atgaacaaaaagggaataacatcagtctgtatggcctttgctggcggccaaggtgtccacactaaaagccaaggaacgacgtttagagagggaggtttagagaagaaggtgttgatgatactgacaatggttagtggtgatgaagataacaacgatgatgaaaatggtgggagttgtgacaacggcgatcgtagtaattattatgacagtgatgacaattga

SEQ ID NO: 18526 - DNA, 1535 bp, Glycine max
  Peptide Sequence Number=SeqID_110211
actccgacggcgacttcctcctcatcgaggccgccttccacctcccccgctggctcaaccccgacagcgcgcaccaccgcctcttcctccgcgacggaagcctccacatcgtgccgcgtaaccgcctccccaacccctccctcattgactccctcaacttcatcgttaattcccctcacgaatccctcgcctccgacggaatccagcgcgccgtcagaaaacgcataagtaattaccccgaacaagctaggaagaacatgcatagggttagggttagggttccggtgtccgtggcgcaggttctgaagcacgagccgcggctaatttcccttgcagtggaagggttctacgatagagatatagacacgatgaagttcgcgtcgaggatggagaggtttgtggagagagggaaagcggaggagttggtgtgcgtttcggtgaagatgtcgagggcgatgtacgcacagctggtgcagcagaggtttcaggctcccaagtgttacccggggatgccggctcggagcgagaaggaagggtttgcggaggcggagctggggatgaagatagcgtgtgggttggagatgatgtatcagcagcggaagcgcgacggggtggaagggaaagggagctcttgggaggcgtttaggaagagtttggagagtagtgggtacttccaagggatgcttccgggttcctctgagtatcagagattgatgcagagtgctcaagagtattatagaaatacttctctgcactctaaggccagtgacttgctgaatgctcttgttagacgcatagatgaaattcttgctctgcctcatttggtggatgattttaaggatcaggaggttcctccatctgatgatgattcctggctttatggtggagaggaagagttgaactctgttcttatggaaagacaaaaggagatggaactatatgacttaaaacacaaaaagaaagggaaagcaaaagagggacaagatgctggtccatcatctgcttcgaatgctgacgagtttgatcctggtgatatagcaaaaaccatgcaggcatttgtccataagctgtcaagttacaagggtgctgaagctcctgaagacaggaataaggaagtagaccttgatgtggaccaatttattaaagacatggaatcaataatgatgcatacagacggtgaagttgccaacagcaatattgaagaaggatcgtcgtctgacctggactttgatgattctgatgagagtgatattgctgaattggatgaggatactgaggatggagaggaaattttcatgcggtcctattctgatgctatgaatgaagaactgaagacaaccacccttcagaaaagttttgttcgtgctaatgaacaaattccaaagaaggatcagggaacgtcaaatgcatcagaacatattgtggacgaggatttttctcctgtagatgtggatcaagggcttcctggtccagcttccaatttgcttggcctcatgggggtgcagttaccacaagatggcaagaagggcaaatga

SEQ ID NO: 18527 - DNA, 222 bp, Glycine max
  Peptide Sequence Number=SeqID_110212
atggcccaacccagcatctcgcttagcgcgtacctcgtgctaagcgagacaggagacatagaactcgcgcttagcgcgcaacagaaaacagaacccgctaagcgagaggagcccgctaagcgcgcgatccaacagaagcaccaagcgctaagcgagagaggtcacgctgagcgagcctacgaaggcccaaagcccacttcagtagctataaataagagctag

SEQ ID NO: 18528 - DNA, 381 bp, Glycine max
  Peptide Sequence Number=SeqID_110213
atgtaccatcccacgagggatgtctcatctcaagtagaagaatgcacagtcttgcatttattaattttaccaaacaacttgcaaacttatatcttggacgaactcaaggcaatcctaacggatttggtgagggcctttaagagagacagaggaatacagaggaagagggaaagaggtggatgcagaatggaagcagaagagaaagctgagaagaaggggtttcaaaaatgctgtaaagaagccaaatatgatcctattgggattaaaggaattttaagcatgaagtattactacttgttgcgtaacttggccaaaattcaaaacgtaggtgttgctcatttagaatacagtcgatttgatgtggaatattacaatttctaa

SEQ ID NO: 18529 - DNA, 132 bp, Glycine max
  Peptide Sequence Number=SeqID_110214
atgccgctcggcaacagtataagcacaaaggtccttagtttttcaatggaaggcctatctggttttgttcaaggcttcctagcaaccaaatgggtggaagtatgctattgtgataagtgggaggtggcataa

SEQ ID NO: 18530 - DNA, 561 bp, Glycine max
  Peptide Sequence Number=SeqID_110215
atggctgaaccgcaccttgcaccgtcggcgacccttggcctcttcactcccttccacttctcctccatcaacgaaaaaacctcgtgtgccgtcgtcgacggcggcctggtgataaacaatctggtagcagctgccatcatgcacgtcctccacaacaagcgcgattttctgtcagtgaacagtgtggaggatctcctcgtcctgtccatcgaaaacgaagctcaggcgaagagaatgaacaacatcggcgagtgctcgacgtcgacggtggttgacattgcgctcgaaggcgttttcaagaccgttgaccagatgctagaaaacgcctttttgaacgctacttcttgctatgttttcgatggacagaatgaggagatttgccacgtcgttcaccgatgggaaatcacgtttgttgttgaggacgagaagtggaagggagtgaagggaccaggggtcgtcgacagtgcgaggtgcggtcctggcaacaataatttaatgatgttaagcaattttaacggtagggaccatgatgcaatcctaccccgcaagagcattggatag

SEQ ID NO: 18531 - DNA, 171 bp, Glycine max
  Peptide Sequence Number=SeqID_110216
atggccattgagggctttacaatgagaaggggtgaaagaaagggagtaaatgaaacccctaggagagggggcgcgcttagcgcgacaccctctcgctcagcgcgtgtagatcgcgcgcttagcgctcatgttgcaggcttagtgcgtgcttctgttagattgcgggcttag

SEQ ID NO: 18532 - DNA, 1899 bp, Glycine max
  Peptide Sequence Number=SeqID_110217
atgcaagaccccgccacctccgacaccgatcaccaaacgacgccgtcgccgaagcgcagcaacaccaccacgactaaccgttctagcaagcgccccgtgttcaaggtcctcccggggcagatcgcgttccgcctcgtgtgccacgcgtccaccgtcggcgggctcatcggcagctccggctccatcgtgtcgcagctccgccgcgagaccggctgcaaaatccactgcgaggactccctctcctccgccgaggaccgcgtcatcctcgtcatcggctccctctcgccgcgaaagggcctcctgctcggcgacggcggcgaggtcgaggtctccagcgcgcaggaggccgtcgttagggttttcgagagggtttgggacctcgaagccgagaaaggcgttaattctaacagagctgttaacggcgaggttttctcgaagttgctagctcacacttcgcagattggtgccgttgttggcaaaggagggaagaacataacggccattaggaacaataccggtgccaaaattagggttttccctcctccgcaatgcgccaccaaagacgaagagttagttcaagcatttttgcctatattttttaccgggggtgttaaattgcctacaaagggatataggataactggtggaattttggctgttaagaaagcgctgatttctgtatctcattgtcttcaagattgtccgccattatgcaaagttccagttacttctagtacaccaactgttagctcttctgataggttgtcctctgatccaaatgctgaacttttccctcaccttaattcattgttaacctccatggaaggtttatctatatacgaacggaccacaaactctaatgaaacctctaaccgtgactcaaaaggtgcagaacacgaagttgtgtttagactcctttgctctaataatgtagctgggagcgtaattggcaaaagaggggctatagtcagagctctagaaagtaaaacaggtgcttctattatctttgcagctcctttaagcgagcatgccgaacgcattgtcaccatttctgctgtagagagccttgagtcttgtaattctcctgcacaagatgctgttattcttgtctttgctagaattattgaagatcacattggaaagggttttctccaagtctctagcatggaatcacctgtaactgcaaggcttttagttgcaacaagcacggtaaattgctttagtggcaatgaaggtcaggtgatttcagaattgagagaagtaactggggctgacatacaaatattgcatggagagtcagttcctaatggtgcttcagatgaggatgtggtggtgcagtcaagtttatacttagagagagattttgtgcagatcactggagagtacagatgtgtacaaaatgccctatataaaattacttctagaatcagggataatctttcacccaatgaggtggttgctgaagcaagaccaaaatccaattggaaagtgaataaggatcctataaagggtaaaccttttgcccgtggaaaatctgcttttccttctggaaggtttctgccacggaatgcaggggtgcatgctgaaacaatattacaaaatggagaattacatacggatttaagtgagaatttggaacgtgggagaggaaacatgtttgctacggtgacaaatactactgtggagataatagtttctgaacacgtctttggttctgtttatggtgaagatggtggcaatttggatcgaatcagacagatttcaggtgcaattgttacggtttatgatccttccgttggtacaagtggagggaaagttgtcatatctgggacaccagatcaaacctttgcagcgcagagcttgcttcaagcctttattcaaacgggacaagcaagctga

SEQ ID NO: 18533 - DNA, 321 bp, Glycine max
  Peptide Sequence Number=SeqID_110218
atggaatgggaaactggtggaaaagatgtggcattcaaagtgttgtattgtggggtgtgtcactttgacctccacatggtgaagaacgaatggggcttttccaactatccactagtccccgggcatgaggtagttggtgtagtgaaagaggttggaagcaaggatgcttggttgattcctgccgcacctgccagaactgttgtgacattcttgaggattattgtccacaatttacgctcacatatggtgcaaagcataaagatgacaccatcacatatggaggctactctgactcaatggttgctgatgagcattttgtga

SEQ ID NO: 18534 - DNA, 216 bp, Glycine max
  Peptide Sequence Number=SeqID_110219
atgaagcaatttgttgatgccaatagacgagaggaaaactaccaccttgaggacaaggtgcttccagatgagcaaggggatgttatgaagcaacccagcataggggagctgcaagtagacaaggaggagacaagcactaacctcagagctaaaaggaaaacgagcaagcctcactacctggatgattttgtaattaactctgaccctaagcgctaa

SEQ ID NO: 18535 - DNA, 87 bp, Glycine max
  Peptide Sequence Number=SeqID_110220
atggagaagtgggagtcaaagcctgacctcaaacaagaaagaggaggaagtgcaatgggttttggcatggaagggagtgaaaagtaa

SEQ ID NO: 18536 - DNA, 1884 bp, Glycine max
  Peptide Sequence Number=SeqID_110221
atgaatctgtggacggacgagaactcctcggtgatggaggccttcatgtcgtcctccgatctctcctcaatctggccctcgccggcgccgccgcaatccacggcggtcttcaatcaggacaccctccagcatcgcctgcaggccttgatcgaaggcgcccgagagacctggacctacgccatcttctggcagtcctcttatgactattctggctccactctcctcggctggggcgacggttactacaaaggcgacgacgacaaagccaaagccaaggccaaggccaaggtcaaggtcacttccgccgccgagcaggaccaccgcaaaaaagttctccgcgaactcaactccctgatctccggctcctcctcctcctccgccgcctccgacgacgtcgacgaggaggtcaccgacaccgagtggttcttcctggtctccatgacgcagtccttcgtcaacggcggaggacttcccggacaggccttcttcaactccgctccggtgtgggtcaccgggggcgaccgtctctctgcctcggcctgcgagagggcgaggcagggacacgtgttcgggctgcaaaccctggtttgcataccgtccgcgaacggcgtcgttgagctggggtccaccgagttaattttccagaacccggatctgatgaacaaggtgaaggttctgttcaatttcagcaacaacaacttcgacatgggttcttcttggcccgccaccagcgccgatcagggcgaaaacgacccttcctcgctctggctcagcgatcccgaattggaaagttctattcaaacccctggttccagtactttaaccgaaacccctagttctattcacgcgattccgcagaaccagagcgtcttctccagagaattgaacttttctgagtatggtttcgacccaaagactgggaacaatcagaatcaccattctctgaagccggaatccggcgagattctcagcttcggcgagagcaagagaacctcctacggcggcgtcaatgggaattccaattccaattcccattttttctccggtcagtcgccgtttgttgctgctgcggatgagaacaccaacaaaaataacatcaacaacaatgggaagacaaagtcaccgaattcgcgcggtagcaacgacgacggaatgctttccttcacctccggcgtgattcttccggcctcgaatttgaagtccggtggcggcggcgattccgaccactcggatctggaggcttcggtggtgaaggacccggtggtggagccggagaagcggccgcggaagagagggcgtaagccggcgaacggaagagaggaaccattaaaccatgttgaagcagagagacagaggagggagaagctgaaccagaggttctacgcgcttcgtgctgtggttcccaacgtgtcaaagatggacaaagcgtcactcctgggcgacgccatatcttacatcacggagctgaagtccaagcttcagaccctcgaatcagataaagatggaatgcagaagcagctggaaggtgtgaagaaggagctcgagaaaacaaccgagaacgtttcttctaatcacgcgggtaatagtagtagttgtaacaacaacaacaagttgtcgaatcagaagttaattgacgtgttggagatggacgtgaagatacttgggtgggacgcgatgataaggatccattgcagcaagaagaaccaccccggggcgaggttgttgacggcattgatggagttggacttggacgtgcaccacgccaacgtaaatttggtcaacgatatgaccatgctacaagcaacggtgaagatgggaagtaggttttacacgcaggagcagcttcgtgcggctctggcggctaaggttggggatgcacgatga

SEQ ID NO: 18537 - DNA, 2145 bp, Glycine max
  Peptide Sequence Number=SeqID_110222
atggcatccgaggagccaatggatgctccccccgcgccgaatctgctttccgaaaccctaagtgccgccgaattggtcgccgatttgggcggtgattacgctctgttcccgcccggcggcggttctaccgagttccggcagctcgacgacgacgtctcgtcttcgctttggtcgtcggcgttggtttcgaattcgcgcgtctccgcagtggcgccggaatcgtggattgctccacaaggaaattggctcttacctgaaaatgaaggttcagacaatgctgaatctgcctctgaagtcgtgccttctaagatgggagcagggcttgtgaatcttggcaatacttgctttctcaatgctattctgcaatgctttacgcatacagtgcctctggtgcagggtcttcgttccagcactcatcctatcccttgttctggtcataaggatgggttctgtgtcatttgtgctcttcgtatccatgttgaacgttccttagcggcttcaggagggacattttcacccttggaatttgtgaacaatttgaaatatttttcttctgattttagaagataccagcaggaagatgcccatgaatttatgcagtgtaccttggataaactggaaagatgtttcctaggtttgaagaagagtaatttaaattttgaagatgttaatcttgtagagaaagtatttggaggtcgtctcattagcaaacttcaatgttctacttgtgaccacacttccaacacttttgagccacttattgatatgagtttagagatagataatgtagattctcttccaagtgctctggaatcttttactaaggtggaaaacattgatgataaccttcaatgtgataactgcaaggaagaagtgtccatggagaagcagcttatgttggatcagacaccatcagttgctgcatttcatttaaagagatttaagacagatgggatccttgttgaaaagattgataagcatattgatttcccattggagttagacttgcagccttacaccattaaagttatggaagacccaggggctgaaaatgatgtaccattgaaatatgatttatatgccattgttgtgcatactggactttcttctacttcagggcattacttctgctttgttcgctcagctccagacacatggcataagttggatgattcaatggttactgaggtctcagtagaaacagtactgtctcaggaagcatacatattgttttatgcgcgacagggtactccatggtttttgagtattatggaagagaaaacacaatgtttgaatccaaatattatgagtacatctcctaagtctgttttagacgttggtgacaacatgtctaaatcaaatcctattttacttccaaatattgaaagaagtgtggctgaagaatccaaagagtattctgagcctcagtttgattattattgtcaagaagatcatggttttcttgaaataaatgacactgaagatgtgactcatggctctggacaattgctctctggatcaaatcaggaaattttttattcgaatacctctaaagatgttgatgcccaaaagctgtttagtagtagggggggacataaagttgctactcatggctgcggacaattgctctctgggttaaatcaggaaagtgttggtttgaatagctcaaaaaacgttgatgcccaacagctgtttaggaactggaccaccttggatgatagtgccatgtttgacattgggaattcatatattgagaacggtagtcttgataatgacaatacctttcaggaagctgttgattttttagagaaggccggtttccattctttaactctgcctagcttgcctcctgatgatgctccagataagttccacatctcatgtgataatttgaagagagagaatcatcggagctgtaaaagatcatcaaataagttaactggggattctgaagaaagacgagaagctgtgaaatatctttgcaagaatcgttcaaggagaggggcacttttgaaatttgttactccaaacaaagttttggacaagaagagaaaaaatatggattcattgcagtgtaagaaaagcaccaaaaaaccaagccatacatctgtcaccccccctgtggccgcaggaagttcacggtga

SEQ ID NO: 18538 - DNA, 835 bp, Glycine max
  Peptide Sequence Number=SeqID_110223
gtggaaccaaataatcttcaaggaagcaagtatagatgttgatcgtgtttttgatgcagcccgctatcgtgcttggagctggtgcaaggcggtggttgttgttgaatccgatattggatgctttccaggtgttcattggtcgaagttggtagtggaaatattttttatcagggtgaaatctacttggtcagctattgagtatggaggcttgtcgagtccaagttgtatagttattgtgttgatcacacctcgaagtaaagttttgggtgaagggttctcatccggacgtggtgcttctactgcttcgcaaggtagtgcaatttttagtgttgtgactagcgacttggtgatatcgacaacacttggatttggtgtaatggctaaacttggaccgaggcggtctatcggctctagattttctttgattatggtcgctctcgattttcacctctcgttgtccgagaaggaacttgacttcagtgctataatcattaagataagcacgacttttgggttcaagtttttaatccgtactgagactaatgagaacctctccatgaaatcgcgaagtggttcatcttcattttatctgatgttggcgagtgccacaacagtcaggtggtgtggtatgctcgtcatatatggagctccaaagcgcatgataagtgtcacaaacgagtcaatggagtttctcgttaaccgagtataccagtggaatgttgtacctttcaatgtcgtggggaacactcgacacatgattgtgttgttattcataaacaaattggtttcgatggttggccacattggtgttatcgttgtttgcaaccatttatga

SEQ ID NO: 18539 - DNA, 246 bp, Glycine max
  Peptide Sequence Number=SeqID_110224
atgacgttagtagtaacaccaagtggttgtgattgtaacgataatcgtggttgtgatagaagtgacgaaggtgatagtaatgtagtaacaactatttatgacaatgacaatggtagtagtgataataatattggtggtgtgatggtgatgatgatggaggtggtaatggtagtgacaatgataaaagtgataataatggtgacaacaaaaaatgttattgttaaatgtgagaaatgtattttttaa

SEQ ID NO: 18540 - DNA, 327 bp, Glycine max
  Peptide Sequence Number=SeqID_110225
atgaagcttgatatgatgaccttgaaacagagtcttttcgaggccaagaaaatccaggatgaaactatagatgataataatagaatgagtacatcaattgaggagctctgggtagcattgcaggatgcccaaaaaaacatcatcactctcaaaacagaaattagggaacttgaagagaagcttgatactgccaacaaaaactctagaaattcttctcaaaaggataagtactggctggaaaacaaggacagatcacagtttgagactcaatcttccttgaatgtgcgaggcaacaactctaccatactggaggacataagttgctga

SEQ ID NO: 18541 - DNA, 486 bp, Glycine max
  Peptide Sequence Number=SeqID_110226
atggtgattgcacaagatcgtgattttgggaatctgatctggaaagggtatttgagtttcggggggatccagcagcttggaatgagtatgagaaaattgggtttgttattattcataggtgctaatctggataaccttgagagctatacaagtgactacactgcacaagtcttggtggggtactgcgtggtagctaaaagaagaaagggtttgttgaactacatgctttttctaagactgactccgaccctgcccaacacatttattaattttgcttctccaattgtggatgtgccttatcatattttcttcttggcaactgttattgggctgatacctgctgcctatgtcacagtcaaggctgggttggctcttggagagttacaatccgtgggtgatctctatgatttcaactcaattgctactttgtttctcattggtgtagtttcagtcacacccacactaatgagcaagaacgaatcatag

SEQ ID NO: 18542 - DNA, 1059 bp, Glycine max
  Peptide Sequence Number=SeqID_110227
atggttaagactagaggattaggccgtgcgttaggtaggattgttgccagaggtctagggagaggggatggtgatgattctgacggtgctccccagcaccgaaggctgaccgcatcggcacgcaagcgacatctacttgtcattgttgacgatgatgtgcctgcgatacctgtagactcgcctgctgtactagaggcagaggctgctgtagttggggatgagcccatggatgctgtagatgagcctgagggatttcctggtggaaccagggacccatcagtgcttatggagtatgctgaccatgttgcggccagcgaacatcctgagttgaagttatcctctcatggaaggaaggtgcataacttaggcaggcttgttcctgcaattgaggacatggttgctgggacaggattaagtcctttgatcgcatgttcgatagacaccggcgatcatggacttatatcctcctttgtgggggagcgacgaggcggtgctgttgttggttgcgttactgatggtctcaccagaggtggccatggccgagataggccaatgtggtggaccatacgtgcgcctgcacacttttcgtcaattgcggagtgcaatgctgatccgaactacgacgaggtgtcaccacgtgcgtgttggtggattgcgacaaagaagattgtggagaagatacagaccagagagggttatgcaccagttcggctatgtccagtgcattcttgtgtccattcatgggtgtcatatgatgacttcttcttcatatctcatccattcatgattgcgccacaaacggatcctcctcgagatgcatatacaacgcagccaagtcatatccctcatgaggtagcaccgacatcgacacatgtggatcctgatgcagacgagcttagacatgcaatggaggcttgccatgcaatcgcttacacgttggagcgtcatctcatcctaaatgaagtcacatcaggcacatcgacacatgatgtcattctaaaatgcctcaggattaccaagggtgtcacagaagacgacaatgtatatgtgaggtcttga

SEQ ID NO: 18543 - DNA, 687 bp, Glycine max
  Peptide Sequence Number=SeqID_110228
atgggtgactgcatgcgacacacagcgagagtattgatcattggtgaggtctctgcaacactaaaagaggtcatagatgatatcgaaggaggcaatgttagcaaagttattgtggttgacaaaggcgatggagttgacggggagatgaagagtgagttgatggtgttttcacaggggaaatccgatgggattgtgttgtccatagttaaagatctcacgcttggtaggggtgtggtggctgagatttgtgaagaggatgatgaagatgtaagtgtagctctgactgatatcttgaagctacctctgatggataaaagcaatggctgcagcttctctagcatatcttcaattgctgtcttttcaagtgctgtttttgttgtctccttgattttggttcgtctcctttatgtcttatactgtagcagcaagcccttgagcaaaagggcttcaaaaccttttagtacccttattattttaggatcaggtggtcatactgctgagatgcttaatctactggcagtgttacagaaaggtaggtttaatccaagattctacattgctgctgctactgataatatgagtcttcaaaaagctcagttgttggagaattccctggctgctgagtatcgcaagagtgagaaggctctccttgagaggcctgctcctgtacaagttgcggatggctga

SEQ ID NO: 18544 - DNA, 1737 bp, Glycine max
  Peptide Sequence Number=SeqID_110229
atgttggggagcaggacgggggatatcatactcatccctgccccgccccaccccacccggttgtcatgccatctcctgcttaacttttgctacgaagttgtaagcaagacagctcagttgttaggtgtttatttcaaaggcctttcagtgagaatagggattgccaaatattctggatgttatggtcttcaccattgccaccgcagtttctttgaaactgctcaaggtctagggttctatttaacttctgcacctgagcttttatatttaagagtgcttatagatattgggctaggtgatagaaatggaagcaaaatcgcaaaggaattgaatagggttgcactcaatctgaagcgcaagcaagcgacccgatatgctgcacatttaagtggagcttcccaaccaatgttagggcattggtcatctcttacgtcaccagcaagcagggctgtcaaacgcatgagattgggtggatatagaaacaggctgacaaatgctggtcgtcatattggacggtccttagctaggcgttttttgaattataaaaagagtgggagactggagcgtttgatgttctatgagaatggggaatggttggactttccaaaggatgttgttgacttggttaagaaggatcttgaagtcaagaaggcagctgtggagatagagtcaaatgggtatcatcttttgtttgattttttacatctgcataaggtggaccttaaaactggcttgcaacaacctatagctttgattgatgcggcagggtggtgtttttcccccgaaatctatgctgcttctgatgaagaaccttataatttgagcaaacaggaatgtggaagaagtccggactcatatgcatctaacgaaataaaattacatttagaagttgacataaatggagtggatcaatccaggttgagtgagtgcagtggggagtccaatgctctagttaagggtattcaaattgatactaaacaaaactgctgtcaatatgatgtagaagttgaagatagcattaacaaaaaggactgtggaaatgttggtgaagacattcagcaacatcaagacatagatttagatgcttatactgaatcagtatatggaatattggatctgaattctgtacaaaagatgtttcttaagggaatgagtagttttggcagtactgattctgacatatttgagatttaccaatgctcaggtgcgtcaatgcaagcacgatgggagctgttccagaagcaagctgaaattagcaaaaagaatcatggggaagctaacattcagtatgattggcttgcttcttctaaaggagaactatctacaatgatgaactatggactaagtcattatggactatctggatcaaagtgcacatatgacattggtgttcatcttgctgctgttacttgccctgatgccagtttgttttatccttgtcctgtacttgaaggttccttaccttcaaatggtagtaggtcaagagaaagagtgggaatgcattttgcagcaggtggcagctccaaccagaaggcttatggaatgttcacctcattaaggacaaagcattttccctccgtgacaaggattatgcgaccattcattcctgcttggactaccatccatggcaggcaattcagtgcttctacgcctcaaattgttggatcaaattacagagtgaattgctcttgcggtgttattaggaaggacattatgcagtggatgctgcatagataa

SEQ ID NO: 18545 - DNA, 84 bp, Glycine max
  Peptide Sequence Number=SeqID_110230
atgtgtagagatcaagttgccgcacacaacaatcagaccaatgaatacgaagccagcaaggaaccaaagagtgacaatgaataa

SEQ ID NO: 18546 - DNA, 972 bp, Glycine max
  Peptide Sequence Number=SeqID_110231
atgagctttcaggacatcgaggccggccgttccttcgcttcccggcgaaatctaatcaacggcaaacaagaccccacgcaggcggtggcttccggcatctttcagatcaacaccgccgtctccacgttccagagactcgtcaacaccctcggaacccccaaggacacccccgaactccgcgataagctgcacaagacgagactgcacattggacaattggtgaaggatacttcggctaagcttaagcaagctagtgagattgatcacaacgttgaagttaatgcaagtaagaagatagcagatgcgaagcttgcaaaagattttcaggcggtgttgaaagaatttcagaaggcacagcgtctttcagcggagagggaaactgcttacactccttttgttccgcaagcacttcttccatccagctatacagccagtgaagtagacattggttctgataagactccagaacagcgtgcacttcttgtggaatccagaaggttgcttctcgaattcagccaattgcttttctcatctgtaatggcattgatactaaagagggtgagccctggtgcagcggtaaagttgtgccttggtgacttgttggtcatgggttcgaatccggaaacggcctctttgcatatgcaaggacaggaggtattattcttagataatgagatttccttcaatgaggctatcattgaggaaagagagcaaggcattcaagaaatccagtcgcagattggtgaagtaaatgagattttcaaagatcttgctgtgcttgtccatgagcaaggagcaatgattgatgatatcgggtccaatattgagcattcccatgaagcaactgcgcaagcaaaatctcaacttgccaaagcttcaaagacgcaaagatcaaattcatctttgacatgcttgcttctggtgatattcgggatcgtgcttctaatcgtcatcattgttcttgctgcttag

SEQ ID NO: 18547 - DNA, 180 bp, Glycine max
  Peptide Sequence Number=SeqID_110232
atgaaggaggaggatgaggttgatgattgtggatctgtcgagagtggacatgttatttttatggaagaaggtagtttgagaatggtgaaaacgtcttcattggagacaacaactatgatggcaatgactttctcaaacaagttcagtcgtgcttgctgcgtagttggggtgaacaattag

SEQ ID NO: 18548 - DNA, 945 bp, Glycine max
  Peptide Sequence Number=SeqID_110233
atggcgtcgtttttgtcttttctccctgccgtttccgctcgtcccattcccaccagcgccttctctcccaaaagacctctctttcaaactccacccaccttgcatttcaaaaatcaccggtttgcagttagttgcagttatgcagaagcaggtgtctatgctaattctagctctaacaccatagatgttgtggctgatgttagaagtgagcggattgtagtcttaggagggaatggctttgttggttcttccatatgcaaggcagcagtgtccaagggcatagaagtcataagcctaagcaggtcagggagacctacttactcaggagatgttttttatgtaaactgggatgaagtacttgttggagctactgcagttgtttcaacacttggaggttttggtagtgaggaacagatgaaaagaattaatggggaggctaatgttgtggctgtgaatgctgcaaaagaatatggaattcccaaattcatcctgatctcagttcatgattataatttaccatcatttttactttcatctgggtactttacgggaaagaggaaagcagaatccgaggttctctccaaataccccaattcaggtattgtcttaagacctgctttcatatatggcaagaggagagtggatggttttgagcttcctttggatttggtaggggagccagcagaaaaaattctacgagcagtagagaacttcaccaaacctctaagctctcttcctgcatctgatctactcttggctccacctgttagtgttgacgatgttgcgttggctgttatcaatggtgtcacagatgatgacttctttggtatttttacaattgaccagatcaaggaagctgccaataaagtacgggccaggagaaactaccatgaggccattttcctcatgttaataccggcagcttttggagcacaatctttttaa

SEQ ID NO: 18549 - DNA, 1860 bp, Glycine max
  Peptide Sequence Number=SeqID_110234
atggggatttcacaaactgtgcaaaatgggaaggaaaatctcactggacagcgacaccgtacgacgattcatggaggtgaagagaacttgtaccatcttaggtttggagataacatagggcaacatcaaaagttggattttgggatgattgggagggaacaaggtgcaatgtattggttggttcctgttgggtggtttaatgtatattttgaagatactgatataagtatgggcagcagtgagatggataaaactccaaaagagaaggagtcaaagacgccgccaccaccacctacgtcacaggagcagtcttcgaccaccagcactggaacaattaatcctgagtggcctggctttcaggcatattctcctatacctccacatggtttcttggcatcaaatccccaggctcacccttatatgtggggtgtccaggaagatgactggagggatgctcaggttgaaaagctggctggagtgttgcatgacctaggaagaagagtttttgtcggggctagagatggtgcagtgaggcacacaatgacaaaagtgggtgggtggttgaacaaggctagaccagatctgaagacaggagatcacaggtcaagcaaccatggatcaagcaagaatgtgctgcaccagtggctagtcagctctcagctgcagaacattggagggcctgcagccattgataaccatgagtatgactgcacgagagaaaggttgttgcaattgcaaaaacacatgcccgaactgatggttgtggcatatcaattgtactctggtaatggcactggtgatgctgggctggttagcggtgtgcaatttatgcctccctatggtactccaccacatccctatgttgcaatgtatccccctggtggcatttatgctcatccatccatgcctccgggatcttatccttttagtccttttgccatgccttctccaaatggcattgctgaggcatcaggaaacactcctggcagcatggaagctgatggtaaacctcctgaggtgaaggaaaaattgccaatcaaaagatcaaaaggaagtttgggtagtttgaatatgatcacagggaaaaataatgaacatggtaaaacaccagggacatctgctaatggaattcattcgaagagtggtgagagtgcaagtgaaggcgaaggtactagtgaaggaagtgatgccaattctcaaaatgactctcaattgaaatctgggggcaggcaggattcttttgaagatgaaccatctcaaaatggcagtttggcatatactgctcaaaatgggggactaaatacacctcatacagtagtcaatcaaactatgtctatcatacctatctctgcaggtggtgctcctggagctgttcctggtcccacgacaaacttaaatataggaatggattattggggtacaccagcttcatccaacattcctgcacttggcagaaaggttccatctactgcagttgctggagggatggttaccgttggatctcgggatagtgctcagtcacaactttggctacaggatgaaagagagcttaaaaggcaaaggcggaagcagtctaacagggaatctgctcgtaggtccaggttgcgaaagcaggctgagtgtgatgagttagctcagcgtgctgaggctttgaaggaagaaaatgcttctctccggtctgaagtaaatcgaatcaggagtgattatgagcagctagtctccgagaattcagctctcaaggagagactgggggaactacctgcgaatgatgatcatcacaggtcttgcaggaatgatcagcatgtgggtaatgacactcaacagagtgggcagacagaggccatgccgggcggtcagtag

SEQ ID NO: 18550 - DNA, 708 bp, Glycine max
  Peptide Sequence Number=SeqID_110235
atgcctcaccgtaacaaccctgcacctctccccctcgtcgtgaccctaaactgcgtcgaggactgttccctcgaattcgaatccctagccggcgtcgccaccgcggtggaggaagttgtggatcccaagtgtaaggaagccagaaatgatgacgataagaagcctcatgagctattcactgaaaggcacaaggagctggtgaaagctggagagaaatgggcaaaagaaaccgctaattcttttacacttgtgggtactctcatcactactatcatgttcgctgcggtcttcactgtcccaggtggaaacacgcaagatactggagtgcccattttcttaaaggagaagatatttactgcatttgtggtcgcagatgcaatatctctcttcacttctgccacttcagtcttgatatgcatttggatcgtcgcatcgcgttatgctgaacaagacttcctaagaagattgccgtataagttactgttgagcattttctacctttttctgtctgaggtgtccatgatatttgccttttgtgctgcacttggtatactactcaagaactattgggcgtataagcgactctttataggaggcgtcatatcggggagcataccagttattatactcgcgttaagcctgaataatgacattggccggttaaatggtccaaatgttctttattatcgccagtttctctccgcataa

SEQ ID NO: 18551 - DNA, 957 bp, Glycine max
  Peptide Sequence Number=SeqID_110236
atgtcttcaatttcatgcacgaagctgacactgttcagcttagcagcggttgcgattcagttcatcggtctctccatcttcgttttcggcttcttccccgtcaaaccacttctctccggttacagtggctgcgagagtttccgacgaccaacctgcgataacgatggcgctgcaaatcagagctacgcgtctctctctccagatcgccgcaggtttttatatcaggaaggatccgagattcctcctttgtatgatcgacttgtcttaatggttattgatggtcttccagcggaatttgtgcttggcaagaagggtcagcctcctagcaaggcttttatggaagctatgccatatacacagtcattattggcaagtggtatggctgttggatatcatgcaattgctgctgctccaaccgttacaatgcctcgattgaaggctatggtttctggagcaattgggggtttcctggatgtggctttcaactttaacaccctggcttatttagatgacaatcttgttgcacagttctttaaaattgggtggaaaatggttatgcatggtgatgatacatggctcaggttatttcctggtttatttgcaagacatgatggagttagcagtttttttgttaaagacaccgtacaagtagatcaaaatgtgtctcgacatcttggtgatgaacttagcagagatgattggaattttctgatactccattatctaggcttggatcatgttggacatattggtgggcggaactgtgtgttaatggctccaaaactttttgaaatggatgaagtggtgaagatgattcatataaatactttgcgaaatctagaaaatgatcaaaggaagacacttctgagtatgaagaaagttatttcatcaatgtattatttcgtgagagcagagatacattatatagaagaaaatgaaaaaggaaagaataaatag

SEQ ID NO: 18552 - DNA, 1104 bp, Glycine max
  Peptide Sequence Number=SeqID_110237
atgacaagagaaaattgtgggagttcaaaaaccctgatgattgtaaatgtgtgtccaaattcttcaaatttatctgagacattactgtccctcaatttctctgccagagctcgaaattctgtattaagcctcggaaaccgagatacaattaagaagtggagagatgttgcaaatgatgcacgtaaggagttatatgagaaggaaaaagaaatccaatatctgaaacaagacggtctgagacttaagcaagcacttaaagatgcaaatgatcagtgtgctctactcttcaatgaagtacagaaggcatggaaagtttcttctgcactgcagacagatttaaagtcagagcatattttgctggccgataattataaggtagagaaagaacaaaatgctcagcttagaaatcaagttgctcatatgttacagttagaacaagagcaaaatttgctgatacaacagcgtgattcaaccatccaaagtttgcaggctaaaattggaagccttgaaatacaactcaatgaagcccttaagtccagcaacactgggtcaaatgttggcccagaaactctgtctggaactctatctaatcccaggacaacgggggatggcacggattcgtctgcagtaaccaagaaactggaagaggaactcaagaaacgcgatgctctgattgagaggttgcatgtagaaaatgagaaattatttgataaattgactgagaaagcatctctggctggatcacctcagctgtcaagtccattatctgggggagcagttaatgttcagcctcaaaataggggaagcatatggatattggctttattctcgttatattcaaacaggaatggcaccagcaccactgcgagagctcgttctctggatgttcttccttcttctttgatgacagataagaatgatggcactgttgctttagttaagtctgattccgagaaagttaagactacccctgctggtgaatatcttactgctgccctgaatgactttaatcctgatcaatatgaaggactcgctgccatttctgatggtgcgaacaagcttttgatgctggtatgggtcttgagtgttttgggttcagtttaa

SEQ ID NO: 18553 - DNA, 366 bp, Glycine max
  Peptide Sequence Number=SeqID_110238
atgagtcctgaaagcccaagctatgctgttgacataagccataaagcaaaacaagggaaagaagtagaacaagccattgacgtggatcaacaacaacaacaacaacatggtaataaggcaaaagggctgttgtgtttgaagcaccctgatgatgaaacaagccctgatagcaacaatagcaataatggtagcagaaagaaactgaagctcacaaaggaccaatcagccagcagtgaagatattttcaagctgcatagcactcttaaccccttaagggtttgtaattgtaatgccaccaagggaatgagtaacataggaaccaaaactagtacccacaatgcagtgccaaggcgaaccatacgatga

SEQ ID NO: 18554 - DNA, 364 bp, Glycine max
  Peptide Sequence Number=SeqID_110239
atgactaggggcaatccaggtgatttacaaccctttcatcctgaaatagatagaacctttcatagattatttaggcatagtgtgcatcctgatcattctgtgtattttgagcattttgagcattttgtgcattctgaacattctgttgctagtgattctgaacattttgattttgagcattcagctgctaattctcatactgagaacatggcacaacctccacctcatgagaggaatcttagggagatggatgcacctgacttcacttatgaaagcttgtgcattcaatatcttgatgaggatgttccatatgttcttaagactggactaatacatttgttgcccaagtttgatggtcttgcag

SEQ ID NO: 18555 - DNA, 198 bp, Glycine max
  Peptide Sequence Number=SeqID_110240
atgacattaggtgctgaattcaatgtgaaaagcttaacatgtagagattggaacacatcatcgaaagtatcccaaaaggaatgtgttcggttctgtgcaagaaagaaaaggactacctatataagcatgaagtttagccgcttcaagaagctgggacttggctttgatatgcttatgaaggatagggacacaggctag

SEQ ID NO: 18556 - DNA, 303 bp, Glycine max
  Peptide Sequence Number=SeqID_110241
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatcccctcccacccatcgtcctgatcttggcttgaagtatccaagtagcgctaaaacgaaaaagcgaactattggaattcttgtcttgggcttagccctcttttacaccaactcaataacaagcgccgaacaaggatga

SEQ ID NO: 18557 - DNA, 1218 bp, Glycine max
  Peptide Sequence Number=SeqID_110242
atgggacctctccaaaggcaagccttccgcaaagtgtacgggaagattctagatttggccacagcggaggtatttacggaagctgtcctatccctcgcccaatactatgaccagccgttgaggtgtttcacgtttggggacttccaaatggtaccaactattgaagagtttgaggaaatattaggatgccctcttggggggagaaaaccgtatcttttctccggctttcttccttccttgagcaagattgcagctgtgattggagattcagcaaaagagttggatcgcatgaaacaaactcgcaatggagtagtgggcctgccacggaaatacttggaaggcaaggcaagggatatggcgagccaagagaaatggggcccgtttgtagatattttagctttgctgatttttggggttgtcctctttccgaacgttgacggtttggtagacttagccgccattgatgctttcctcgcatatcactatagcaaggaaagtccagtggtggctatcttggcagatttgttgacacctttgaccggagacacgagacacccgtgtccgcttcaaagctatcgctcatgcgccgaaaaaggaggagtcgattgggaccaacatttggctgggatagggggcagcgcgatcaattggtttcctcgttggaaggaaggcaaggaaggagttcttttctcgtgtggggactaccctaatgttccactgatagggactaggggttgtattaattataatcccgcactcaccataagacagctagggtatcccatgaggggagcgccaatcgaagaaagtctctcgcctttccttgtgagggatctaggcgcgcaaggtctcaaggttatacaaagaatccacaaggcgtggaggagtccgttgaagaaagacaaggagcttaggggcatccaaaatggcgtcattggaggttatcatggatggctaagaattcatgcgcaagggttagattggctctccaaattgaaagttatcgatgaggagaacttcgaagctctggaggaagatgaagaagtccgagctctaaaattagagctagggaaggcaagactcgccaaggagaagttcaaatcagctgctacacacatccgaaaggtgtgcaccgagttacaagaggaaaacgcggccactgcaagagcccttgaacaagaaaccaaaagggcccacaaggaggaggggatcctctag

SEQ ID NO: 18558 - DNA, 204 bp, Glycine max
  Peptide Sequence Number=SeqID_110243
atgattggacctcctcgagcattcattaagcacgacattcagtggctaagcgcgaggaataatccagaagaagatgagttgtcaagtttgctaagcgcaccgctccaggtcatcaagcgcaccgcttcagctcatctgctaagtgagagaagcgcgctacgccaaaaatcactaacgtgcgctaagcagtccatacgtgcatga

SEQ ID NO: 18559 - DNA, 168 bp, Glycine max
  Peptide Sequence Number=SeqID_110244
atgacgggagatgtatcaaaattcacacatatctctcccaagaaaaacgagcatgtaatctatggtgacaacaacaaaggtagaattcttggagttggaaaaatagcaaatataatgatccatggctatggcataaaaggattgctcacattaacatggaacacttaa

SEQ ID NO: 18560 - DNA, 396 bp, Glycine max
  Peptide Sequence Number=SeqID_110245
atgttaattttgatgctaagagaaaggcagattctatcaaagaattgcatgcaaaagttcaagccagcattgagaaaaagaatgaacaatatgcaaagcaagcaaataagggtcgcttcaaagttatttttaaagcaggggagtaacaaatcatattcaaggatgaatttctgtgtcggagagggagggaatgatggaggtgcaactagctcatctaatgaccctttactagggattggaggtcctatgacaagatccatgactaagaggatgaagcaagcattgcaaggcctgattctaaagatcaaaaagaaagaagaccaatgtgaactaagggctacacctaattgggtcactcccttacaagttgatgaatatgttttgaggtcaacttga

SEQ ID NO: 18561 - DNA, 240 bp, Glycine max
  Peptide Sequence Number=SeqID_110246
atgaaaccaaaaggaaaaagaaagaaagaccgcgaaggtcgacatgttatagttaagaagtataaatcattcgtaaagagcaaacgtatcttctggaaacaagggactgacgctaagagtttattttacggaataaccgagataagaatggatgaattcattgaactgatgaaagaacataacatggaaacgttgggatctgtttgtgtaaatttccaccgtagcatcacaatgccataa

SEQ ID NO: 18562 - DNA, 285 bp, Glycine max
  Peptide Sequence Number=SeqID_110247
atgcatacgcatacgcatgcatattgttgtggtaaaacaggggcaggatcatctcgagctaccttttggggtagagacgaagttaaagcagcaggaaaccaatcaaggtacttagggacggatgcaagtggggatggggtcacgaccgaccgatcgttgccccttctctgcgctaaacaagcagagaacgtcgctgcaaggcagcctagtatcctttgtattcgcagttttcttttactatttgtttgttttaaaataagtaatcgacgcctaattctaacttaa

SEQ ID NO: 18563 - DNA, 337 bp, Glycine max
  Peptide Sequence Number=SeqID_110248
atgttggatttcaaacctcaacattgtggaagcaatgacttccaagattattttgatgatgcaaaagaatcaagagttaagcaagttccaaagaatcaggcttcaagaatcaagattcaagaacaattaagtttcaagattcaagattcaagaacaatcaagatcaagattcaagattcaagagaagttgatttcaagattcaagagaagaaatcgagaagcaacaatcaagacttcacaagggaagtatttttcaaaaatccaaacatagcacaattttgttttacaaaagagttttttcaaaaattttctaagttaccagagtatttactctctg

SEQ ID NO: 18564 - DNA, 663 bp, Glycine max
  Peptide Sequence Number=SeqID_110249
atggtagctcctccaggatcaattctgtcaattgagcagttccttgagcaggtgtcctggcctagagctcaaccctcgattgtgagaactggtggaaggtttgcagctcaggcacctcaacaggagggatctaacgaggcagctgctcttcctgagcctacacctatgaggaggatgctcagacttgggatacccaggatctgtcttaggacttttaaattcctgatgattttgctttttggaacttatcatccttttgatcatcctgagcattccattactggtgaatctgtgcattctgttattggtgattttgaacatcctgattttgagcattataattttgagcattctgattttgaacattctgagaacatggcacaacctccaccccgtgagaggactctaagggaaatggttgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcatattgtctgctccaccatgaaacccccagatgtccaagaggatcacatatttctgaaggcttttcctcattcattagagggagtggcaaaggactag

SEQ ID NO: 18565 - DNA, 177 bp, Glycine max
  Peptide Sequence Number=SeqID_110250
atgagaagcgccacgcttcccgaagggagaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 18566 - DNA, 485 bp, Glycine max
  Peptide Sequence Number=SeqID_110251
atggcgcccactaggcaccctttggacccagataagtccaacagggccctgggattccccgcactgatcacaggactctgccagtcgttcggagtccccgttgcacctactaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatggctccgcttctttttcatgccctactccagaccagttcagggcagaggttgcatggcccggagattggcccgaggcccaagcaggagaggcacccccagaagctcccgacgatggagaagaagcccacgaggatgaggagatggccgatttgcttgacttcttgggagggagtggagacac

SEQ ID NO: 18567 - DNA, 351 bp, Glycine max
  Peptide Sequence Number=SeqID_110252
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggccagagaatttgttgctggatgctaagggggtgcttaaagtatcagattttggaatgaggccactgtttcaacaagttccacttcacacaccgtggggtaccgagctcgaattcgtaatcatggtcatagctgtttcctgtgtgaaattgttatccgctcacaattccacacaacatacgagccggaagcataaagtgtaa

SEQ ID NO: 18568 - DNA, 327 bp, Glycine max
  Peptide Sequence Number=SeqID_110253
atggctacaccacccagctctcctcctcctcctcctggtgcagcatcacagttgccatctaccttgaagcagacaagaaaaaccacacaactaagatcattggcgactagactaattagggcagaaagaccgggaaggccgacgccgacaaggaaagtgtcgatgacactgtatgtgaaaagtacgacattagcaaggagaagtggacccaattttgtcagacccgcagagacccttcgtgggaggatgtgcgaaaaaagccataggccatccaaaagcaaaacactttccctcacgtgttgtctcgtgggggttatgcatatttag

SEQ ID NO: 18569 - DNA, 279 bp, Glycine max
  Peptide Sequence Number=SeqID_110254
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctgtgcggctaggtcgcagcagagaatgggtcatggtcgtggcggagagtgggtctcaagtcgctacctcgacggagagtgggtcgaggcgtgactgcgttaggcgtcaagctcgagcggctgtgatggaaagggagtga

SEQ ID NO: 18570 - DNA, 366 bp, Glycine max
  Peptide Sequence Number=SeqID_110255
atgctccttccgccaaacctcaaacccaatgtcatcaacacccacactcactccgaccccaacgaaattcaacaaagaagacatgaaaatgcaagaggggagttcagacttcaacgtcgacaggggcacgatgatcttgagaagacgacggcgaagtcgcaactagcagcattcttagcaagctcaaaatctaaagagagtcttactcataatctcaaagaagttctccaactacttcaacaagaagtggaagacgaacctcccaagaaggaagccgaatcatccgagactaatgatgaccaagaagatgatccattctaccagaatgaagatgactgttttggtatatcgttagacgacgattaa

SEQ ID NO: 18571 - DNA, 234 bp, Glycine max
  Peptide Sequence Number=SeqID_110256
atgaaactggccaaatacaggctaaaggcccaagtggagaaggacgaaggcccaagtggagaaggacaaagcccccaagtggagaaggatgaaggctcaagtaatccttgtggcgtctacccagacttatcttccttcatcggaagtggcatctaccctgacttatcttccttcactggaagtggcgtcaaccaaaaactctacagcctgtatcaagcgatccgtgccccgtaa

SEQ ID NO: 18572 - DNA, 562 bp, Glycine max
  Peptide Sequence Number=SeqID_110257
atgttggtgtgcatgatccgcactcgtctctttgcagcggcacgggtggaatcttgccccggtatgcatagtagctgcacgatagcttcctcctctggttgtacttgcatagttggccctcctccaggatcagggggtgacccaggaactgataaaaggaaattactggcccctgaaccgagagttcaagtgtggatatggagtccactgaaagtgaggacgcgtaaccctctaaaggcgagggcgtgcatccctctgaagttcaggacgtgtcgccctttgaaggcgagggcgtgtagctcactgaaggtgaggacgtgtagtcctctgaaggcgaggacgtgttgtcctctgaaggcgaggacgtgtagtcctctgaaggtgaggacatgtagtcctcagaaggtgagggcgtgtagccctacgaaggcgagggcgaggaagtctagtcctctaaaggtgagggcgtgcaaccctctgatggtgaggacgtgtagtcctctaaaggcgaagacgtgtagtcctctaaaggcgaggacaggtagtcctctagaggcgacag

SEQ ID NO: 18573 - DNA, 303 bp, Glycine max
  Peptide Sequence Number=SeqID_110258
atgggtaggctccaaggtagacatcgcattttgaactttgcatccaactctttatgtaactttcagcctcaaactacgattgcccagacctctgaatggactgtggctcgaggaatctatacagatcaaaattccttgctcgcatacttgtttaaagaggttttcgtgctttatgtagagcgggaagtctggattaaagaccccgaacacggtggcatcccatgtaacctggtaaggcctcaagaaaagctatggaatggtcaatgtcatcagataaagcagatcatcgacctccagatctag

SEQ ID NO: 18574 - DNA, 377 bp, Glycine max
  Peptide Sequence Number=SeqID_110259
tgaaccttctggctgattcaatatcaccggagtctgctcagggttccaaaccagaagcgaagtttcttttctacgatacactggaatcggactcttcccccggcccagtagtggagcttgaccctcgccctacgccgattgagatctttccttgtgcggtacaggtaaattttgctcttgagggaatacccggttcatcggaacttcaaccagaagaggtcggtgaaactgtccctgtagctaaagtcaagccagttcattcattcatggcaatcggtctacaatcctgcttcggtagcagacttcggtcaaggaaatcgcttcaagcaatggctttggatcgacctgacttcttagagaggaaagccagtgaatga

SEQ ID NO: 18575 - DNA, 606 bp, Glycine max
  Peptide Sequence Number=SeqID_110260
atggcggcggcccagtcgtcctgggcgggcttcaggccgtccgcctgggtgggcggattggcgcgggattgttcggcgagcgcgtcggcccagtcgtcggccggggacgagccagagccgggctcgttcttgtcagtcatgggcgtactggccgttgaagacgccgtagccgcactccatcagcggcacgccgtcgacgtgggcgatgacggtctgcggcacatccacgggcaggatgtcgccgaccttcatgcgcatcagttcgcggatgctggacggaatgcgggcgaattcggcgaccacgtcgatgtcggcgctgcgcacctggcgcgagagctgctgcgaccagcgctggtcgacttcctcgagcgtggtttcctgcagcggccgcgtgagcaggtcgcgcaccggctcgatcatggagtagggcaggcagatgttgaggtcgccgccggtcgcgccgaattcgatgtggaaggaggtgaccaccaccacttcattgttgccggtgatgctggcgaacttggtgtgcatctccgagcgcacgtaatcgaattcgatcggatagacgggatcccaggacttgccgtagctttccagggtcag

SEQ ID NO: 18576 - DNA, 603 bp, Glycine max
  Peptide Sequence Number=SeqID_110261
gtcgactctagaggatcccctcccaaagtggtccaacatttgatagatgctggatggctgacgtttcaagaggatcgacccaacgtaaaaacaaacccgctcgccaatcatggaggtggagcggttaatgccattgagtcagataggccgcgcaagtttaagcctttaaaggacgtggcgacccctaggagggaagagcagcatatatgtatgcagtccgcaaatgagagaagttttggaaggcctaaacctttggtgatatatttcaccaaggacgcagcttcacaaaagcccagatacccctcgacagctaaacctgttcctttcccataccaaaacggtcacgcagtcccgtcgaggtatacacctccgagtgaaaggaaagaagaagccactgacatcagctcgttgtcgaccaaggtaaccaatatcactgaccgcagcggtcgcatgtttgcaccccccgacctgccgacacaacccgcaaacgttaaggggaaggcaaaggtggtggatgaatatgacaagatgaccctcactccgaacgaggatattccagtgaaaggtcttcctgagaaaagggatggttgtggcaagaaggaa

SEQ ID NO: 18577 - DNA, 249 bp, Glycine max
  Peptide Sequence Number=SeqID_110262
atgactgttgcaaacaagcggcatgagtgggacattggtggaattgcagagtttaccatagacagtaagggaattagtgcacagccaacacccacatgggcaatagggatgcccatcatgtcattatgcccaaagttgcaccaagatgtaatggtagaactccttaggcaaatcaatgatcttgagatgccctttgcttggccattcttgtcaaaaacatccacaactacagtgaagggattgggttaa

SEQ ID NO: 18578 - DNA, 297 bp, Glycine max
  Peptide Sequence Number=SeqID_110263
atgacggtgaaaactctgaccacatgcagctccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgtttgccctaattaa

SEQ ID NO: 18579 - DNA, 644 bp, Glycine max
  Peptide Sequence Number=SeqID_110264
tgctggattgatgagcattttccctcagttgtggagtccatcgctgatcaagactacgacaaggcttctccgcgtgcgtgcaagtggattgcgacgaagaagaccgtgaagagtattcgcacgccgtcgtatagggagcgcctggaccgactccagattccggatgtctgttggatcccgtattgggagcatcgggaggtccgggacttccacgtcagatcatgctactccggtctcttgcgctggggggcctgttgctgtgtattaccgaccggagagggtcgtgcggcagtttggttacacgcagaccattctgctcctcctgtcgattcatgggtctcgtatgatgatatacacgacaggtggatgcactacgaggatcatatcatacctgcaggtgaggtgtgcgttgtgccaggggcgtgttccagtgactacatcaactggttcttccgcatctcccatcctttcatgacaccaagccacgcagtagatcctctgcctcatggtcacgcctcgcagccccgagtcgtccctcaggccccgcagatggatatccctcgcgtgccggagccaggagcatcgtcgacatctgcggaggagcccagacatgcagtggaagtttgtgatgacattgctgagag

SEQ ID NO: 18580 - DNA, 450 bp, Glycine max
  Peptide Sequence Number=SeqID_110265
atggtgaatcaagaggagtgggtctcgtttatggatgtattagcattgctaatctttggggttgtcctctttcccaacgtggatggtttggtggacctagccgtaatcgatgctttccttgcatatcaccatagcaaagagagcccggtggtagctgtcttggcggacttatttgacacattatatttgaccgaaggaatgaggggttgcattaactacaatcccacacttgctataagacagttagggtaccccatgaggggagcaccaacggaagaaagcctgtctcctttccttgtgagagattttggcgcacaaaatttcaaggttatacaaagagtccataaggcgtgggaaagcccgttaaggaaagataaagaacttaggggcattctaattgaggccgtacccgaatcaaataaacatgaaaatgcagtaactaggaagtga

SEQ ID NO: 18581 - DNA, 570 bp, Glycine max
  Peptide Sequence Number=SeqID_110266
atggcaaccgcttccagtacggttagggaagtggagccggtactgcaacccgctttaaatccgggccgagacagaaacacggccgtccaagcccttacttttgaggggcaactcccgccttatgacgactatcccgggcaagacgatgaggaaggagatacccatcttggccccctgcagcacctcaaagatccgtccccacatgaactaccccaaccgaacatagtccgccataacccgacttcacccacacccgtaaaaaaatttgttcccttcatggaagataagggaaagattgaggcgcttgccccccccccccagagcagtcgagggcctcggcaattacacattctcggatttagtggatttatgtctcgtgcccaacatcgtcatccctcccaagttcaaaggtacccgggactttggataagtacaaagggacggacatgtccgaaggggcatctttctggatgtatttgccggaagatgggggcgtattctgcggacgaaaaatgttgtccatttctttcaagacagctgggccagagcagctgtagcatggtatactaa

SEQ ID NO: 18582 - DNA, 357 bp, Glycine max
  Peptide Sequence Number=SeqID_110267
atggagaaggtcacaccgtctgatccccgacctgctccaattattgaaaaaattaaacatgataactccagaaaggtagaaataaccttcaatagaagaaattcattttcatcaaggatagaagcctctaggtctgaatatgaatcggctagaaggtctttttcagtaagaactcgttcaatccctgtaggattaactagatctgagtcacataaccagttccctacggttaatctccaaggtctagatactacttctagtatacctagagcaacctacaatcaagaacaggaggatgaccaaaagtctatccaatccccaacttactcttctatggaactttatgatgttatctga

SEQ ID NO: 18583 - DNA, 241 bp, Glycine max
  Peptide Sequence Number=SeqID_110268
tattatggcacgttctccagacaagataaagagcatcgatggctcaaaagaaactcttaaacttagtgtgaggatcagtgatctatggtttattggcacgcctaacaaatctgagcaagctgaaatggtgtttgtggactccgatgtttattacttattgttcagttcattgtgttgtaaccttaatgcaatccagggtgatgagatccacgctgtttgtaaagaagaccaattgaagtaa

SEQ ID NO: 18584 - DNA, 243 bp, Glycine max
  Peptide Sequence Number=SeqID_110269
atggccaagtttgaccctgagatagtcctagagttctatgctaatgcttggcccacggaggagggagttcgggacatgcgctcgtggttttggaggaaggccaacagtgtgagttcagttagaggaggaacatggccgacgatttcgatgaggaagccattgcccagctgtggtgcataccgggttaggatttcgcccggaccgttgcagggaggcggatgcggatcatgcgcaccagcatga

SEQ ID NO: 18585 - DNA, 528 bp, Glycine max
  Peptide Sequence Number=SeqID_110270
atggcacaacgggtggtaatggtagtggatatgcaaaatggcgtgctggcaacgccgcgttacgaccgcgccggacgctgcgcgcgcattaatcagctgatggccgccgccgatcaggtcatttttattcagcatagcgggccggatttagccgctgactccgcagactggcaaatagtcgccgaactggaacaacccgccggcgcgctttacatcaccaaaaccgcctgcgacagcttctggcaaaccgggctcgcggcgcagcttgaacagcatcagattgaaagctttgtcatttgcggctgcgccaccgattattgcgtcgataccaccatcaaagtcggggccagccttggctatcacatcaccgtggcggccgacgcgcacactaccgccgatcgcacttatgtgtcagcgcagcagcttattaatcagcacaacgaggtgtgggcggatttgatcatgccgggcaatccggtgcgggttaaaaccacggaagaattactgcgggagtggcgcgcgcattaa

SEQ ID NO: 18586 - DNA, 729 bp, Glycine max
  Peptide Sequence Number=SeqID_110271
atgtggcaggcgcaaagtgcgctcgagcggcagggcgcgctgctggatctgctggagtggctgcgtccgctggcgcagcagggcgtcgcgcggccgcgcgaaggcgcccaccgctttgatgtggtaaaagcctggctgcgcgataacctggcagaaccggtgcggctggaggagctggcggcgctggtatcgctgtcgccgtggcattttctgcgcagtttcaaacaacactttcacgtcactccccatcaaatgctgatggccttccgcctgttcgaggccaagcagcggctggcgcagggcgagagcgccgccagtgtggcggcggcggttggcctcaccgaccaggcgcatctgacgcgggcgtttgcccatcgctacggcatacgccgggacgctatcaaaagcaggaatagtgtttgccctcgcggcggggctgatgtggggcatgatttttgtcgggccgctgctgatacccgattatccgggcacgttgcaatcagcgggtcgctatgttgcctttggtctggtggtgctgccgctggcgtggctcagccggcgccggctaaaacagctgacgcgcccggactggacggaggcggtgaagctgtcgctggtgggcaatctgctctattacgcctgccttgccagcgcgattcagcgcaccggcgcaccggtctccaccatgatcatcggtacgctgccggtggtgatcaccgtcaccgctaa

SEQ ID NO: 18587 - DNA, 651 bp, Glycine max
  Peptide Sequence Number=SeqID_110272
gcgataaccttgcagaaggaacaggctatgatgcaacaggaaatcatccattcactgactaactggatcgatcagaatctggataaaacattgtcgattgatgaagtggcggcaaaatcgggttactcgaaatggcacctgcagcgtatgttccgtacggttacgaaacaaacgctgggtggttatattcgtgaacgccgtctcacgctggccgccgaagccttgcgtcagacgcagcgtccggttttcgacattgcgatgcagtacggctacgactcgcagcagacgttttcacgcgtgttccgccgtcagttctcgcaaacccctaccgcttatcgtcacagcatgcgtcgccaggcgatggtgcagcgtccgcgtctggtcaacttcgactgcagcgaaggcatgaacagctttgcccagcgcaccaccggcgagtgctgcccgaggtttttcgccgatggctacgttaactaccagtctgatcgtcatgcgttgggaactgctcagcgcgcgatgtcatgctggttcgttaccggtctgctcggcattacgctgagcatggaaaacgtgcataactttatgtccatcaccaaagaagcgtttattcaggtgatgagccagacaccagccgactggccaatgccgtaa

SEQ ID NO: 18588 - DNA, 1605 bp, Glycine max
  Peptide Sequence Number=SeqID_110273
atgccggtcacggaaatcagcgtgaacagcaggcccatcaggaagaccgcgcccagcgccaccggcacgctaatgtgctggcccagtaccaggctgaacgcggtgaaggcggtcagggagatggcacaaccaatcgccatcggcaggttggcccacagtcccatgatgagggagccaaagctggccaccagacaggtcaccgcgcggctcgcgtttgcgcatcatcctggtgaagatgtctcagagagaaaagcaggcaaacgattacgtggccgcgtattccaggtcaaaaaggggataatgcgcagctctggcgccattatggctggtgttacgctagcgggagcaggaaatcatggaggaaaaaggctggcatttcaggtggtttgctgcggtgccgcgacagcgcgtcgcggcatcctgtttcgttgcgttaccgctgcgcctcagcccgtgaaccggcaaaaaagcgctgctggctcagatgctgctcaatcacgcgcccgtggagcgccagctgcttgttcagccacgctttctgaatgcctttactcagcgccacgccggccgggcgcagcagccatggcaccggctttttgcccagttgcgcaaacaccagcttcatcaccagtagcggcatcagcgaaccttcagcatagtgcagccagtaacgcgcctgaatttgctcctcttcctcatgcagcgccagcagatgctcgctgtccgtttgatttgatacggcaccgccagctcttccagcagccacagcacccgatgagaacgggagttttccagatggtgaacggtaatcatgcgcgattccttgctgctaagggttggcatctagaccgctccggagccctgctgccccaggcggtcacccggattgcgcagtggacagtcgcgcatcgacaggcagccgcaaccaatgcagccgtcaagatcgttgcgcagacgcgtcagggtttcgatgcgtttatccagctcttcgcgccagtgctgcgtcagcgcgtcccactcctgcgtcgacatgcgcttattcgccggcacgtgcatcaggctgtcgctgaccgtcgccagcggaatcccgatgcgctgggcaattttgatgattgccacacggcgcagcacatcacggctgtagcggcgctgattaccgccattgcgcgtgctgctgatcaagcctttgctttcataaaagtgcagtgccgataccgccacgccgctgcgtttcgccacttcgcccggcgtcagcaccggtttcgggctatgatgcaacaggaaatcatccattcactgactaactggatcgatcagaatctggataaaacattgtcgattgatgaagtggcggcaaaatcgggttactcgaaatggcaccttcagcgtatgttccgtacggttacgaaacaaacgctgggtggttatattcgtgaacgccgtctcacgctggccgccgaagccttgcgtcagacgcagcgtccggtattcgacattgcgatgcagtacggctacgactcgcagcagaccttttcgcgcgtgttccgccgtcagttctcgcaaacccctaccgcttatcgtcacagcatgcgtcgccaggcaatg

SEQ ID NO: 18589 - DNA, 1038 bp, Glycine max
  Peptide Sequence Number=SeqID_110274
atgtctggcgaatcacgcccggccaggggaaaactggacgcctggttccacatttcagcacgcggcagcagcgtgcggcaggaagtgctggctggcctcaccacctttttagcgatggtctattcagtcatcgtggtgcctggcatgctcggtaaagcgggcttctcaccgacggcggtgtttgtcgccacctgtctggtggccagctttggctccctcatcatgggactgtgggccaacctgccgatggcgattggttgtgccatctccctgaccgccttcaccgcgttcagcctggtactgggccagcacattagcgtgccggtggcgctgggcgcggtcttcctgatgggcctgctgttcacgctgatttccgtgaccggcattcgcgcgtggattctgcgtaacctgccgatgggcgtggcgcacggcaccggcgtcggtatcggcctgtttctgctgctgattgccgccgatggcattggcctggtggtaaaaaacccggcggcaggcctgccggtggcgcttggtcacttcacctctttcccggtgatcatggcgctgatcgggctggcggcgatttttggtctggaaaaacggcgggtaccgggcggcattctgctgaccatcattgcgatttcgctgcttgggctgattttcgacccggcggtaaagtggcaggggctgtttgccatgccgagcctgcgtgatgccagcggccagtcggcaatgtttagcctggatatcatgggcgcgctgcagccggtggtgttaccgagcgtgctggcgctggtgatgaccgcggtgtttgacgccaccggcaccattcgtgcggtggccgggcaggcgaacctgctgtataaagagggccagattatcaatggcggtcgcgcgctgaccaccgactctatcagcagcctgtttgccggactggtgggtgcctcgcccgccgcagtgtatatcgagtccgctgcgggtactgccgccggcggtaaaaccggcctgacagcgattgtcgtgggtctgtgttcctgctga

SEQ ID NO: 18590 - DNA, 1653 bp, Glycine max
  Peptide Sequence Number=SeqID_110275
atgaagcgcctgctctccgcctcgctggctatcgtaccagccagcgtatttgccgcagatgccattaccggcgcggtgcaaaaacaggccaccaactacgaagcgatcatcatgttcgtggtcttcgtggcggccacgctcggcatcacttactgggcctccaaacgcacccgctcgcgcagcgattactacacagccggcggcaacatcaccggtttccagaatggcctggcgatggccggtgactttatgtcggccgcctcgtttcttggtatctccgcgctggtctacacctccggctacgacgggctgatctactcgctcggcttcctcgtcggctggcccatgattctgttcctgattgccgaacgcctgcgcaacctgggccgttatacctttgccgatgtggcgtcctatcgcctgcagcaaaagcccatccgcaccctttccgcctgcggttcgctggtggtggtggcgctgtatctgattgcgcagatggtgggtgccggtaagctgatccagctgctgttcggtctcgactaccacatcgccgtggtgctggtcggcattctgatggtgctgtacgtgctgtttggcggcatgctcgccaccacctgggtgcagattatcaaagcggtgctgttgctgtttggtgccagcttcatggccatcatggtgatgaaagccaccggtttcagctttaataggctgtttaccgaggcgatggcggtgcatccgaaaggaagcgcgatcatgcagccaggcggtctggtgaaagacccgatctccgcgctgtcgctcggtctgggcctgatgtttggcaccgccggcctgccgcatattctgatgcgtttcttcaccgtcgccgatgcgcgggaagcacgcaaaagcgtgttctgggccaccggctttatgggctacttctacttcctgacctttattatcggcttcggcgcgattctgctggtcggcgctaatccggccttcaaagacgccagcggcgcgctgattggcggcactaacatggcggcagtgcatctctccaatgcggtcggcggcagcctgttcctcggctttatctcggcggtagccttcgccaccattctggcggtggtggccggcctgacgctggccggtgcttcggcggtgtcgcatgacctgtatgccagcgtgatccgtaaaggtcaggccaccgagcgtgaagagctgcgggtgtcgaaaattaccgtgctggtgctgggcgtggtggcgattgcgctgggcattctgtttgagaaacagaacattgccttcatggtcggcctggcgttctcgattgctgccagctgtaacttcccgattattttgctgtcgatgtactggtcaaagctgaccacgcgcggcgccatggtgggaggctggctgggcctgctgacggcggtggtgctaatgattctcggcccgaccatttgggtgcaggtactgggacacgcaacgccagtctatccgtatgagtatccggcgctgttctcgatgctggtggcgtttgtcggcacctggctgttttctattaccgatcattcccagcagggggcgctggagcgcgcgaaattccgcggacagtttatccgttcacaaacgggcgtcggcatttctcaggggaaagcgcattaa

SEQ ID NO: 18591 - DNA, 1956 bp, Glycine max
  Peptide Sequence Number=SeqID_110276
atgagccaaatacacaagcatcccgtacccgctgccattgcagcgaatgccctgataaatgccgatcagtatgcggcgctgtatcaacagtcggttgacgatcctgaggccttttggggcgaacagggcaaaatcctcgactggatgacgccctacagcaaagtgaaaaatacctcgtttgcccccggcaatatttcgattcgctggtatgaagatggcgcgctgaaccttgccgccaactgtctcgatcgccacctggctacgcgcggcgatcacccggcgattatctgggaaggcgatgacgccagcgaaagcaaaaccctgaccttccgtgaactgcacgccgacgtctgccgcttcgccaacgtgctgaccggccttggcgtgaagaaaggcgatgtggtggcgatttacatgccgatggtgcctgaagccgcggtcgctatgctggcctgcgcgcgcatcggcgccgtgcactcggtcatttttggcggcttctcacctgaagcggtggccggacgcgtagtggattccagtgcaaaactggtgattaccgctgacgaaggcgtgcgtgccggacgcagcattccgctgaagaaaaacgtggacgatgcgctgaacaatccaaacgtcaccagcgtgaaaaacgtggtggtgttccagcgcaccggcaaagagaccggctggcacgaaggccgcgatctgtggtggcatgaactgatggcgaaagccagcgatcagcatcagccggtagcggtcgaggccgaacatccgctgtttatcctttatacctccggctccaccggcaagccgaaaggcgtgctgcacaccaccggtggttatctggtgtatgccgccaccaccttcaagtatgtttttgattatcatgacgatgatgtgtactggtgcaccgccgacgtgggctggattaccgggcacagctatctgatctacggtccgctggcctgcggggccaccacgctgatgttcgaaggcgtacccaactggccacagcccagccgcatggcggaagtggtggataaacataaggtcacgctgctgtacaccgcgccaaccgctatccgcgcgctgatggccgagggtgataaagcgattgccggcacccagcgcagcagcctgcgcatcatgggatcggtcggcgagcccatcaacccggaagcctgggagtggtattacaaaaagattggcgacagccgttgcccgatcgtcgatacctggtggcagaccgaaaccggcggcttcatgattacgccgctgcccggtgccaccgagctgaaggccggttcggccaccaaacccttctttggcgtccagccggcgctggtggataacgaaggtaatacgctggacggtgccaccgagggtaacctggtgatcgtcgactcatggcccggccaggcacgcacgctgtttggcgatcacgatcgctttgagcaaacctacttctcgacgtttaaaaatcgctacttcagtggcgacggcgcgcgccgtgacgacgatggctattactggatcaccggccgcgtcgatgacgtgctgaacgtctccggccaccggcttggcacggcggagatcgagtccgcgctggtctcgcatccgaaaattgccgaagccgcggtggtggggataccgcacagcattaaaggccaggcgatctatgcttatatcacgctgaatcacggcgaagagccgtcgccagagctgtacagcgaagtgcgcaactgggtgcgtaaagagatcggcccgattgccacgccagacgtgttgcactggaccgattcgctgccaaaaacccgctccggcaaaatcatgcgccgcattctgcgcaagatcgccgccggcgataccagcaactttggcgatacttcaacgctggccgatccgggcgtggtggagaaattgctcgaggagaaacagtcgatcaccatgccataa

SEQ ID NO: 18592 - DNA, 2663 bp, Glycine max
  Peptide Sequence Number=SeqID_110277
gttcctgcggcgtgataggcgatctggtcgctattgttaaagatcggtgtcgatccggcggcgatattaaccagcgcaccgtccagcgcttcggcgccgatggcgccactgccgttgagcgtgagcgtgccgccgttgaggttcgccacggcctggctaccgctggcgctgacgccgcgcgtacggcgggtggtgttgccgccattgacgtcgatattgccgctgttgctggcggtggtggcgaaggtgctgcccgcgctgttcaccgcgataccggtgccgccgtcgctgatgctgatattgccgctgttgctgccggtcgccccgctctccacgcgcaggccagtggtattggccccgctgaagttgatgttgccgctgttgctgagctgcgcgcggttgcgagccagatagccggtaatgccgttctgcgccgaattgagttctgcggcggaagtcagccgcgtgctggcgaccggcgcacggctgttgcaccggtcagcgtatgtttctgcccgtcggcaatcgcgcccgtggcgttgctgccactgagggtaatggtggtcgccgcgtcaatgttgccctgcgcaccgccctcgatattgacgccggtggcaccggtgccgctgacgttaatcgtggcgttgttggtcttcaccaatgttccgccaccgccggtgccgttcaccgccaccgcacccgcgccggaggcggtcagcgtggtgttagtcccgtcaaacatcgcgccctgttcgatgcggaagagcgtcgagttagtggtgcgcattcgggccataggcaaaaaaaccaatttgattgctgccggtgctgaagcggggaatggcattctgcgtgacgttaaccgtggcgttgccgcgcgcgtgcacgccaatcgcgccgttgccggtgaggttaatcggcccgtccacgttcgctgcggcagtgccgctaccctgaccttccacccacacgccaaagttgcgcgtgccgctggccggatcggctccgcccgccacgttgatggtcccggtggagctggcggcggcgctgttaccactggtggccagcactttcaggccggtgccgttaacgccgttgaggttgatggtgccgcgattctccagcgtaccgttgctgttagtgaccagcatgccgacgttctcgcgcggcacgcgcgcagcgctgccgttgacgtcgatggtgccgctgttgatcagcgtggcattgctggcaccgctgaccgacatcccggcggcgttctgtacgcgcgagccaatcacaatcgccccgtcgttggtggcgctgccgttggccagcagcgcaatgccgctggtcagcccgctctggttcagggctgtctccgccacgttgtcgctcaggctgttctgcgcgcctcgcccgaggtaaatcgtgccgccgctgttgttggtaaatcggctgctgtcgctggtgagcagcacgccggaagtggtgccgcgcgcgctggaaccgttgacgcccacgttgatattgccgctgttagcggcctgcgcattggcatcaaggcggatgcccgccacgccgttggtcagattgctgccggtggtaccgaggttaagcacgccattgttagtgaaatcaccgccgttttgcaccgttaccgccgtggcgttgttgctggccgcgccgacgccggtgccatcaatacggttgaggaaaccgccgttgatgacgccgctgctgctgttggtagccgtcgcgccatccagcgccagcgcggtgccgcggctcgccagtttcccgtcgatggtggcattggccccgctggccacgcgtaccgcgccatcgctggcccctaccacttccagcgttttaccggcggcgatagtgacctgcgaaccggcgccttcggcattgatcaccacgcggctacctatcggctgcgtcacttcatccggcgcagtggcgctgacgttatagacaatatcgccgttggtgatagtgaccgcctgattgaacgcgctgaggtagctggccggcgcgagattgccagcctgcagctggctcaccagccagttattgtagctttgcagctggctggcattggtgacgttgaaggcggtggttttgccgtccagcgtctgcacgctaaagctgccgttataggtcgcaaggttctgtaccgccaggctgtcggtcacctggccgccggaaacgttggccgcagaaccgttaaaggtgatgcggttgttgttgttccagttgagggtgccgccgttactgacctgaaacagcgtggtgtttttggccgccatggtccaggcgttggtgctggcgctgctattggcgttagcctgaccaatgctgacatccagcgaactgccgctgccgctgacgtcggcgatacgcgcatcgatatactgattgtcattcacgttttgcagatccggcaccaccgtgctggcggtaaccggtgcctgcgccaccaggctggcggaatcaaacacctgaaaagtggtgttgccgccggtagtgggatccggcacggtgatggcgaggttttgcggaccgggatcgagacgtgcctgattaaggtattgtgcgcccgccgcgatggtcacctggccgagcgtggtgttgaccgccccgtcaatgcccggctcaaatgcctgattaccggttaa

SEQ ID NO: 18593 - DNA, 1227 bp, Glycine max
  Peptide Sequence Number=SeqID_110278
atggggctgatgcagctattttcctcttctgataaagcgctgtggcgactggcgttgccaatgatcctctccaatatcaccgtgccgctgctcggcgtggtcgataccgccgtgattggccatcttgatagcccgatctacctcggcggcgtggccgtaggcaccacggcaaccagcttcatctttatgctgctgctgtttctgcgtatgagcaccaccggtttaaccgcgcaggcgttcggggccggcgataaacaggcactggcgcgcgcactgatgcagccgctgctgatcgccctcgccgccgggttgctactggcgctgctgcgttctcctgccagtagcctggcggcaacgctgatgggcggcagcgcggaagtccagcagcaggcgcagatcttcattgaaatccgctggctgagcgcaccggctacgctggctaacctggtgattctcggctggctgctgggcgtgcagtatgcgcgtgcgccgatggttctgctgattgtcggaaacctggttaacatcctgctcgatctgctgctggtgctgaaactgcactggggcgttgccggtgccgccgccgccacggcgctggccgaatacgtgacgctggcagtgggattaaggatggtggcgcgcgtgttgaaactgcgcggcatcgatttcaaactactgaaacacagctggcgcggtgacgcggcgcggttatttcgccttaatcgcgacatcatgctgcgctcgctcatgctgcagatttgctttgcctcactgaccctgctgggtgcacgcatcggaccggatgtggttgcggttaatgcggtgctgttgatgttcctgacgtttactgcctatgcgctggacggctttgcttacgcggtggaagcctgctcgggtgaagcggtaggggcaaaagatcgcagccggctgctgctgatctggcatgccgcctgtcgccaggcgggtatcgttgcgctgctgtttgcggttatttatgcgctcagcggcccgcacattgttgcactgcttacctcgctgcagccgctgcgtgagatggccgatcgctttctgctgtggcagcatgatcatggcagcagccggtttcggtatcactttgctgacgctgccgtggttagggaatcacggtttatggctggcgatcacggtgtttctggcgctgcgcggcctgacgctgggatggatgtggcgccgccactggcagcgtga

SEQ ID NO: 18594 - DNA, 699 bp, Glycine max
  Peptide Sequence Number=SeqID_110279
atgtcgtcgaaaaccgcagatgtgatcgccgccgcactatgcgaacggattgaaaacggagagtttgtcaccagacgattaccggccgagcgcgcgttgagcgaacaatattccaccacgcgcatcacgctgcgtgaagcgcttggcctgctggaagcgcagggcgtcatctaccgcgaactgcggcgcggctggtttattgcgccgccgcgcctcatctataacccggcacatcacagccactttcacgccatggcgctgcagcaggggcgcattgccagcactgaggtgatggaggcgcgcgaggtgccggcgcagctggcaattgcgcgccatctgcaactactggaaggcgatcaggtgtaccgcattcgccgcctgcgccgcatagatggtcgcgcagtgctgtacgtcgagcattacctcaatccggccttctttcccggtctgctgcgagaagatctcacccgctcgctgaccgatctgtatgaccagcgctacggcattcactacggcggcgcacggtttaccattgtgcccggtccgcttccggcgcgggcggcgcccgcactgaacgtggcgagcggcacgcccggcctgctgattacgcgtatcaaccgtgaccagcataagcgggtgattgactgcgactgcgagtactggcgttatgacgcgctgtgcgttgatgttgaggtgtga

SEQ ID NO: 18595 - DNA, 528 bp, Glycine max
  Peptide Sequence Number=SeqID_110280
atgcttatgccaaacctcacgcccgaaaaactgctcacgcaggctgaatctctgtgccttgaccgtggcgtgcgcctcactacgcagcgcgcagaagtgctgcgcctgatggcggagcagaacggttccattagcgcttacgatttgctggaccagctgcgcatcagtgaaccccaggcgaaaccaccgactatttatcgcgcgctggatttcctgctggagcagggatttattcatcgggtagagtcaaataacagttatgtggtgtgccaccatttcgacgagccggcgcacacatcggtgatgctggtgtgcgacaactgtgccgccgtcagtgagaagcacgcgcacggcgtggaaaagatcattgccgggttggccgatcaggcaggttttaccttacgtcatagcgttattgaggcgcacggcctgtgtgaaaactgtgccgaagtggcggcctgcacgcagccgggtagctgtcagcacgatcatgaagtggaaagtaagaagaaggtgcgtaaagggtaa

SEQ ID NO: 18596 - DNA, 984 bp, Glycine max
  Peptide Sequence Number=SeqID_110281
atggcaaagcgaattcagttcaaccagcacggcggcccggaagtattgcactgggtcgatttcacactagccgatcccgccgactatgaagttcaggtggagaacaaggcgattggtattaactacatcgatacctacgtgcgcagcggattgtatccggtctcctcgctgccgtccggcctgggcactgaagcggcaggcatcgtgaaaaaagtgggcagcgcggtttcgcgtttcaagccgggcgatcgcgtggtgtattgccaggccgcgctcggtgcctacagcgagctgcacaatgtggcagaagatcggctggtgattctgccggacagcatcagctttgagcaggctgcggcctctttcctcaagggcctgacggtgcaatatctgctgcgtcagacgtacaaagtaaaagctgatgaaattttcctgtttcatgccgccgcaggcggcgtgggcctgattgcctgccagtgggcgaaagcgctgggcgcgcatttgattggcaccgtcgggtctgcggagaaagcgcagatcgccaaagatgccggcgcctgggccaccatcaattatcgcgaagaggatatcgcccagcgcgtcagcgaactgaccaacggtgaaaaagtggcggtagtgtacgactcagtgggtaaagatacctgggaaccctccctcgacagcctgcgccgccacggcctgatggtgagctttggtaatgcctccggcccggtgaccggcgttgacctcggcattctcaacaagaaaggctcgctgtttgtcacccgcccttccctgtttggctatatcaccaaccgtgaagagctcgatcgcgccagcggcgaactgttttcgctcatcgccagccgcgctattcagcttaacgtgccggagcagcagaaatttgccctgagcgatgcggtacgtgcacatcaggtgctggagagtcgtgccactcagggttccagcctgttgattccctga

SEQ ID NO: 18597 - DNA, 1245 bp, Glycine max
  Peptide Sequence Number=SeqID_110282
atgactcaggtagacgattacgaccttaagatactgacactactacaatctaacggccgccttaccaaccaggaactcagtgatttagtcggactttcggcgtcgcaatgttcacgccggcgcattaatctcgaacaggcaaatcttattctcggctatcacgcgcggctctcgccggacgcggtagggctgggcatggtcggcttgatcgaggtgcgactaaaaaatcacacgcccgattacgaagagagttttcaccgcatggtggagcaggaagcggcgattgtcgacgcgttcaaaaccaccggtgacgccgactatctgttaaaagtcgcggtggccgatttagcggcgctgagcgcgctgatcagtcagctcgtcgctggccatcaaagcgtggcccacgtgaaaacctcggtgatttgtgccgtttttcgcgcaaagcgcgcaccagaaaccgaatttgtgcatgaatcgattattttacagcagattgatgcacataaacctgcaataaagcgccttagttatcaattggataatcgctggcacccatcggcggcgacaggaagccgccgatgtggtgcgttttttgcaaatgaacgccatcatttgcaaagagatcgcaccatggataacgctgtacaaccttcccgcattccccacacccgtacagaagatgcgctggcgatcgtgcttggcacgctgatggtgtcgtttggcgtcattttgctgaaacaggcgggcgcgctgaccggcggtacggcgggcgtggcttttctcatcagctacctgtcgccgctctcgttcggcagcgccttctttctgattaacctgccgttttactggctggccattcgccgcatgggctgggaatttaccctgaaaaccttctgtgcggtggggctggtatcgctgttcacccatttgcacccgctgtttatccatttttctgcgctaaatccgttttatgcgacattgttcggtaacgtggtgatggggattgggtttatagtgttgtttcgtcacaaagccagcctcggtggtatcaatattctggcgctctggctgcaggatcgctctggtctgcgcgccggcaaactgcaaatggcgctggatacctgtgtggtactggcctcgctttttgtggtatcgctgccgatgctgctggcctccatcgccggcgcggtgatgctcaatctcatcatcgccatgaatcaccgtcccggccgctattttgtttga

SEQ ID NO: 18598 - DNA, 216 bp, Glycine max
  Peptide Sequence Number=SeqID_110283
atgcagatgctgggtggtcgtcagcagggcggcaatggcggtggcgcacccatgggcggccagggcggcggcaacaataacggctggggccagccgcagcagccgcagggtgggggcaaccagttcagcggcggcgcgcagcagcgtccacagcagcagagcgcaccggcgaacaacgaaccaccaatggatttcgacgacgatatcccgttctga

SEQ ID NO: 18599 - DNA, 258 bp, Glycine max
  Peptide Sequence Number=SeqID_110284
atgtcgctgcatgttctttatctttatgcgttttctggatttcccccagggatttcccgtctgctgtgtctctcgttacaatctttcaaagaaatgaacgggcaggatcatcttgagctaccttctggggtgaggaccaaatgtggacagcagaaaccaatcaaggaatggatgcaagtggggatggggtcacgaccgaccgatcgttgccccttctctgcgcgaaacaagcagagaacgtcgctgcaagacagcccc

SEQ ID NO: 18600 - DNA, 465 bp, Glycine max
  Peptide Sequence Number=SeqID_110285
atggagatttacgtcgtcttccgcgcagactacatctgtcaagcactaacccgtgaggttagggggcaggcggatataccccaagtgaggcaagcgagcccgttgacacgcggagatttacgtcgtcttcgcagactacctcttcaaccactaacccgtgaggttagggggcagggaaataccccaactgttatccaggcaagcgagcccattgacacgtggagatttacgtcgtcttccgcgcagactactcttcaagcactaacccgtgaggttagggggcaggcggatataccccaagtggttatccacgcaagcgagccattgaacgcggagatttacgtcgtcttcggcgcatactacctctgtcaaccgctaacccgtgagatttacgtcgtcctccgtgcagactacctttgtcaagcactaacccgtgaggttggggggcaggcggatataccccaa

SEQ ID NO: 18601 - DNA, 567 bp, Glycine max
  Peptide Sequence Number=SeqID_110286
atggtcattgaccagtcccttttccatgacttaaccaaattacccaatgacggtgtaccatttgaaggtacactgaatgacgactggaaatttgatttctctgcccatgatgcccgccagttggtttgcaccaacaatgcggatatgaccggacgtcttcttgccgggtcattggcttttgaaagccgcatccttcactatttaattgtgcgtattttgcttccacggtcttccaaccttgcccagagatcctttttaattggtgctgttgtgattgcttcttttggttaccgcaaagagcatgatggctcttgggtcaaaaagggtgctccacccgctgatgatgaaggcaaccaaccagttgaagataattcctctcttcttcgaaagcttttggaaaagttcgatggtcttcaaacttttgttggtgacaagtttgataatatggaattgcaagttgacatgcggtttgatgccatggaatcaaggatcaccaaagttgaagaagatgtctccttcatccgtacttgctttgatccaccaccaccgcctccatcatcctcttag

SEQ ID NO: 18602 - DNA, 354 bp, Glycine max
  Peptide Sequence Number=SeqID_110287
agggtacatctacttgggttgttgactgagaacaagagagggtacatctcttgtggatcagttctagtggagggtacatccactaggttgttcaaagagaacaagggagggttattccaagatcatgatgaaaaccaagtcaactggtgtctcatgacaaaatctgatgagaataacaaagaagattctgtaaggaagaagtggtacatagacagtggatgttccaagcacatgacggagatgtatccaaattcacaaccatttccccaagaaaagtggacacgtacatatgcgacacaacaaaggcaaattatggagtcggtaaataggtacgagttcttctactcccattga

SEQ ID NO: 18603 - DNA, 261 bp, Glycine max
  Peptide Sequence Number=SeqID_110288
aaagacgctcagccacaggcagcagatgatcgctctccttctcctcctcctcagagggatgactcttcatcctttatgcaaaacgttctagacaagttggatggtctcctcacctttgtcggtgagcgttttgactccttggacagccgcattgatgtcattgatgcacggtttgcaggaatggatacacgcatcactcagcttgaggaggatatgagtttcatttgccagtgcttcgaccttccaccaccgtcttcatag

SEQ ID NO: 18604 - DNA, 471 bp, Glycine max
  Peptide Sequence Number=SeqID_110289
atgactaggggcaatccaggtgatttacaaccctttgatcttgaaatagatagaacctttcatagattggttaggcatagtgtgcatcctggtcattctgtgcattttgagcatcctgatcattttgagcattctgttgctggtgattctgaatattctgattttgagcattcggctattaattttcatactgaaaatatggctcaacctccaccttgtgagaggactcttagggagatggatgcacctgatttcacttatgaaagcttgtgcattcaatatcctgatgagggtgttccatatgttctcaagactggactaatgcatttgttgcccaagtttcatggtcttgcaggtgaagatcctcataagcatcttaaggagttccatattgtttgctccaccataaatccccctgatgtccaagaagatcatatctttctaaagaattttcctcattctctggaggga

SEQ ID NO: 18605 - DNA, 406 bp, Glycine max
  Peptide Sequence Number=SeqID_110290
ctcccggagacggtcacagcttgtctgtaagcggatgccgtgagcagacaagcccgtcagggcgcgtcagcgggtgttggcggatgcgtaaggagaaaataccgcatcaggcgccattcgccattcaggatgcgcaactgttgggaagggcgatcggtgcgggccttttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 18606 - DNA, 1215 bp, Glycine max
  Peptide Sequence Number=SeqID_110291
ccaacaacgatgcggctggaaagacgaagggtatatcagtacagcagggagtacagctggcggcgatacttagcggccagcgcgtcgccggtgccgagcgcggccagaatgtccatcagggtcttgcgcgcgttgccgttggcggcggccagatctttcttcagatgccccatcagcagttccagcgcttcttcgttacgcccgacctgatgcagctgcagcgccagctgcaccgccagctcgacgttgcccggctgctgctgcacctgctgttgcagctgttggatttccggcgtgtccgccgcatgcttcaacagttcaatctgcgccaccaggccctgatagcgggtatcgcgatcctgcagtggaatggtcgccagcaccgcttcggcgtcttcgctgcggctgagcgcgatctgagtttcggccagggtcaggccgatatcgctgcgctgttggctgctctgccaggcgtctttcagcagcggcagcgcttcggcagcgttgccggcggccagcagttcctgcgcctgcgccagtttcagatcttcttccttcggcaggaaacgctgcagcaagtcgcggatcgcttcttccggctgcgggccctggaagccgtcgaccggctgaccgtctttgaacaggtagacggtcggaatggaacgcagcccgaattgggaggcgatcatctgttcggcgtcgcagtccaccttggccagaatgaactggccggcgtattccgccgccagtttgtcgagcaccggcgtgagctgcaggcagtgttggctgcgctcggaccagaagtagaacagcaccggaatggacatcgactgttccagcgtctggtgcagccatggggtgtagatgggggcgcgccgccattcttcaaccccggcgggcgaattaagcgttgctgcgcagcagccaatccagacagcggcccggcagaatgcggcgcagcacgctcatggcgtgcgccagcagggtcaccgggtagcgcagtttggcgcgcgggctttccagcgcgtggcgcagcttgggcagaatggcctccggcggcagcgtcaggcgcttggcgatgccggggttatgcaccgtgggtggaaatcggccccgcgccgcgcccggcgctggagaccaagcccatcaccgagctggtctggatatgcgcccttcgccgtgcggcaacatcgcagcagcacaactgggtcactg

SEQ ID NO: 18607 - DNA, 1087 bp, Glycine max
  Peptide Sequence Number=SeqID_110292
ttctgattttgacgtcgaaattgggcactttgcagctgacaaggatagtgttgatgacactgtatgcaaaatgtacggcattagcaaggagaaatggacccaattttgccagagccgtagagacccttcatgggagaatgttcgaaaaaaagcacaagctgtccaaaaacaaaacactgcccctcacgtgatgtctcgtgggggttatgaatatttagaaaaaaagttgatggatgagaagagaaagaaaaaactagaggaagcaactcaatccggaagcactgacaccgtcattgatcctccatctcccatcaaacgacacgtgaagtggaagctagcccgcaccaagaaaactggtgacatgacatctgaagcagcaaaggaaattgctgacaagattgatgcgcttgaggagcaggcctcacaggaacaccctggtcgtgtgcgtgctgtaggagccggtataaccatcaaacaatactttggatcagcttcaaggacctcctccattgctcccgaatacctgcaacagttgacgcaacaaatcaaggaccaactagaggattcaatcacagaaaaagtcactcgacggctaatgttatccctcagccaaatgcaatcacagggactcgcactgcctcatgaacctgatgttggtcctttagctgctcgtgtcagcacaaaggagagttgtgttgatccctcagggaacgatctagacaccggtgactcatacaaatgtgggttgtatattgaagaatatccttctcgcctggttgccctgggaagagtttatgagggatctacaacaattcacaacattcctttgctgcacgatcaagttaaggttggtgttgaggagattagagatgtagatgctcctattcttgtacccactaaagaggttaaggtcgtgggacaggctcttaacacattccttgcttggccgacacatctagtcaagcgtttatcagaacagggagctgtgagacccgcgaaacctgcagataggccggatgatgaggtcgatgatccgctatatctaatgacattgaccattccacagctttttctgaagccattgcag

SEQ ID NO: 18608 - DNA, 759 bp, Glycine max
  Peptide Sequence Number=SeqID_110293
atgggtctcgttcatagacacaaggaaagcccgatcgtcgcactattgatcttcggaggagtcctcttttcgaatgtggatgggttggtggacctagtagcgatcgacgcttttctcgcctatcataaccacaaggaaagcccggtcgtcgctatgttagccgacctatatgacaccttcgaccaaagatgtgaaaagagcagtacgaggattgtttgctgtactccaactctttatgtatggttggttttgcacctttttcgccaagaggtgaggcatgcttgcccgctagaaagccaccgttcatgcacagagaaaggaggggcaaattgggaccaactcttagcaaacaaagaaggagtgtctgtcaactggttccctcgatggaaagaaggaggaaccggagttcttatttcgtgcggaggatttccgaatgttcccttgatggggacgaggggttgcatcagttacaatcccattcttgctataagacaacttggctaccctataagaggggcaccactagaggaagagcttgcacctattattgcacgaggtttcaataacaccgacgtggaggcacttcagaaggtccgcaaggcatgggagatggtgcaaaagaaggacaaggaacttagaggcagtaacaacgggcccatcggtggctacctgtcataccctaatttcgtccggggacctttgcttgatgacatgcgacctttgtttggtccttgtaaggtgcttggcacccatcattag

SEQ ID NO: 18609 - DNA, 365 bp, Glycine max
  Peptide Sequence Number=SeqID_110294
ggataacaggctgatctccccaagagctcacatcgacgggaaggtttggcactcgatgtcggctcttcgccactggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 18610 - DNA, 948 bp, Glycine max
  Peptide Sequence Number=SeqID_110295
atgacggtgaaagcgcagggcggttcaccgcaggcgatactcgccatgatattcggctgcaacctggtggcggcgctgatcccgatgctgattagccgctgcatcacaccgctgcgaaaagtgctgaccccggtggtgaccggtacggtgatcaccctgattggtatcagcctgataaaagtcagtattaccgactgggcgggcgggcataacgccagcgattttggtgcgccgggtaatctggcgctgggggcgctgaccctgctggtgattatcgtgcttaaccgttcccactcgcgctgggcgcggctggtggcggtggtcgccggcattggtgcgggctgcatcgcggcggcgctgagcggtcatctgccgctgaagccgatggcggagacgcactggctggtgctgccttcgctgctgcattttggctttgattttagctggacgctgtttgtgccgattgcgctggtctcggtgatctgcgtgattgaggcggtgggcgacctgaccgccaactgtctgatttcacgccagccgctggaaggcgacgggtttcagcgtcggctgcagggcgggattctggccgatggcctcagctgcctgctggcggcactgttctcggcttttcccaataccacctttgcgcagaacaacggggtgattcagatgaccggcgtcgccagtcgctacgtggggatggtgattggcctgatgctgttgttgctgggcatcttcccgctggtcggtaacctgctacagcagattccgccgccggtgctgggcggggcaacgctggtgatgtttggcagtgtggttgccgccggtattcgcgtgatgacgcaggcaccactggggcggcgtgagatgctgattgtggcggtgtcgtttggcattggcctcggggtggaagcggttcctgacgtgctgaaacagttcccgccgctg

SEQ ID NO: 18611 - DNA, 170 bp, Glycine max
  Peptide Sequence Number=SeqID_110296
gccctaggatcttagactcaactccatgggagcttgtaggcctaggatcttcttcatcaatggattcctttgcttcttggaagataaatggcagcggaatggggaaggaagagagagaggagacgccacttcaaggagaagatgagtctagaagaagctcaccaccatag

SEQ ID NO: 18612 - DNA, 405 bp, Glycine max
  Peptide Sequence Number=SeqID_110297
atgaaattgaaggtgcgttgcggtggtcggcggcggcaaacgaggtacgcagaaggtggtggctgtgtcgcggacatggacgaagatgagtggatgtatgaaataatgtttgaacaagcggatatggattatgaaatgaagaagcatgtggtgtttgagtgtcgagaggatgttttgcggtgggctcgatccgttgctcatgaaaatggatttatggcggtgattttaaggtcggacacaaacacaggtagtagaggaaggactacgtttgtgttaattggctgtgaaaggagtggcaagtataggtgtaggaaaaaagaatttatcagaagagacactggtactaggaaatatgggtgtcccttcaagcttcgttgcaagccattggttggaggagaaggctag

SEQ ID NO: 18613 - DNA, 632 bp, Glycine max
  Peptide Sequence Number=SeqID_110298
cggtcgggctgaacggggggttcgtgcacacagcccagcttggagcgaacgactacaccgaactgagatactacagcgtgagctatgagaaagcgccacgcttcccgaagggagaaaggcggacagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccggcagcgcgattcgaagtagcgacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18614 - DNA, 992 bp, Glycine max
  Peptide Sequence Number=SeqID_110299
gggcacgaagcgtacacgccgcgtgctatttttcaaaccgccttgcctcagtatcctatacccctttgcttaaattcggtatatagggtctactgtttttctaacccgcattgtgtcttttgcacaggcattgcatatgggttccgtcttgatccaacggagggtccgtgtcgccttcttaaaaacgtgcgttggggcattttgctacccctagacgtcgtatctaagaaggggacagattccccggacccccgcattcctagattgcatctgtgtcatatgcattccatcatgcattcatccattccacccatgagatatcggagttttgatttgcaccagcttttatctcactttagtaagcatgggaacaaatcaaaccggcaagaggttctaccaagtcaaggtcaaaagcccagataccaccagcatcaaggaattaaggcggttgatggaacccctccgaatgcaagccttccgcaagacttacggaaagatctagagttgaccatagcagaggtgtccatagaagccattgcatcacttaccaatactacgaccagctttgagatgcttcacgttggagacttccaattggtaccgaccattgaagaatttgaggagattctaggatgtcctctcgggggaagaaaaccatatcttttctccgggtgtctcccctctttgagcagaattgcaaccgtggtcaaagattcaacaagaggtttggatcgcgtaaaacaaactcgaaacggcatagcgggcctaccacggaagtacctagaagacaaggcgagggatatggcaaatcaagaagattgggtcccgtttatggatgtgttagcattgctaatctttggggtcgtcctctttccaaacgtggatggtttggtggacctagccgccatcgacgctttccttgcataccaccatagcaaggaaagcccggtggtagctgtcttggcagatttatttgacatatttgaccgaag

SEQ ID NO: 18615 - DNA, 129 bp, Glycine max
  Peptide Sequence Number=SeqID_110300
atggggcctctagagtcgaccgcaggcgctaaacgtttccgtaacgttttccgtgaagaatttcgcaagggtttcaaccgttcttcgacgttcttcattcgttcttcatcgttcttcgatcttcaacgg

SEQ ID NO: 18616 - DNA, 285 bp, Glycine max
  Peptide Sequence Number=SeqID_110301
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcagcgactatccttagaaagccacaaatgggtaccgagctcgaattcgtaatcatggtcatagctgtttcctgtgtgaaattgttatccgctcacaattccacacaacatacgagccggaagcataaagtgtaa

SEQ ID NO: 18617 - DNA, 300 bp, Glycine max
  Peptide Sequence Number=SeqID_110302
atggtccattttggaacattcctcagccgcttggtccacctgggcccactagatgacttaggagggaagcaaccaactcgcctgggcgagcaagttgcttttggagcgtgggaggctaaggagaaagggttcagcacccttggcaagcatatttcactaaaaattagtgagaaaaaggagaaagaacaagaaaatcaaggccgaggtgcttccgtaatgcttctgcgatgtttccgtgatcaattccataaacgttcttcgtcgttctttgtctgttcttcatcgctcatcgttctttga

SEQ ID NO: 18618 - DNA, 219 bp, Glycine max
  Peptide Sequence Number=SeqID_110303
atgtatgtgtggaaatggctccgagaaagctttccgcaaagagatctacgaaggacgccgtggctgaagggaccagtgctgctcccgagtttgacagccatcgttttaggagcgttgagcaccagcagcgtttcgagaccatcaaaggatggtcattccaccgagagagacgcatctagctcagggacgatgagtacacagatttccaggaagagatag

SEQ ID NO: 18619 - DNA, 315 bp, Glycine max
  Peptide Sequence Number=SeqID_110304
atggccaagttcgacccagacatagtcctcgagttttatgccaatgcttgggtgaggggtcagtggatccctttcgatgcggatgccctcggccagttcctaggataccctttagtgctggaggagggccaggagtgcgagtatggccagaggaggaaccaggccgatgggtttgacgaggaggccattgcccagttgctgtgtataccggggcaagatttttcctggactgctactaggagacgggtatggcgccgactaggcaccctttggacccggataagtccaacagggccctgggatttcccgcattga

SEQ ID NO: 18620 - DNA, 1197 bp, Glycine max
  Peptide Sequence Number=SeqID_110305
atgagtcttcattcttcatctagtgttaatggtgagggttctactcctaaggaccccttgtataagatattagatgagttgagatcccttaagttgtggaaagaaaaacaagagataaaagaaaaaggtaaaaaaagagtggaacaaataagtcaagatgaaagagagaaaataagagaggaagaaagaagaaaaataatgaaagaaatgaaaagagaaaaacatgcctcctatagtagtcataactcttgcaagagcctaagtgaagaacttcgtgactattatgaaggaaggcataggtcacatcttagacctcactcccataggagagaaaatgaaagaaagcctcaagaggttaacattaaactcccatacttccatgtgaaggacaatgaagaggcttacttagattgggaaataagggtagagcaaaaacttaaaagaaagcctactttaaaatcttatggctatcattcttatccaaagaaagaccaaggtctaggcatcttagaggcagcaccttctaagcccaatgatgataaggggaagacaatagaaaagcaaccccctaaggctagtatgcaagaaaagactagctccataaagtgctttaaatgtcttggaagaggacacattacttctcaatgctccaccaagaaaaccatgattatgaggagccaagacatttatagtagccaagatgaggctactacttcaccttcctctagtgaaagtgaagaatctagtgaagaaatctacccccaagaagaaggaaaacctttaatggttaaggaggagtgtaaggaggtaagtgtctcctccaagaggttagctaaaaaggaaagacattttgaaataaagacaaatattaaagaaatttcccctcttaaacaacctccacattttctcctttgtaaaaagacacttgttcgcattgccacacctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgctttgggtggtgcaacactcatttgtaaaatcactcgtgcacccaacatcttcatgatttgtgtacatagggactcattaggaataatcaacatgaaaatacagaaaaag

SEQ ID NO: 18621 - DNA, 402 bp, Glycine max
  Peptide Sequence Number=SeqID_110306
atgatggtggcccgtgtgatattagggcacgactatgagcccgaaatgggcttgggaaagaataatgacggcatggccagtctagtggacatcaaggaaaaccacggaaagtttgggctaggctataagcccacgcggattgatgtgagaagaagcatcatagaaaggaggaacaggggcgtgggcccacaactaaagccacaagcaagggaggaccctccttgccatatcattaaaagcttcgtgagtgtgggcttgagacatgaagagcaagtcgctgtgatacacgacaaggcccctcaagaacattcagattgggtgcggccatgccttcctgattttcaattgggaaactggcaagtcgtggaacaacccgaagtttccatggcgagcacgatgtaa

SEQ ID NO: 18622 - DNA, 488 bp, Glycine max
  Peptide Sequence Number=SeqID_110307
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccactggtgtgctagcggaagaacttcctgtcccttgtatgactgtgtttgatgttagtgggaatgtcttatctggcccaattcctcaattctctgttggcaagtgtgcttcagttccttcctggagtggaaatctgtttgaaacagacgacagagcgcttccgtacaaatccttttttgcatctaagattcttggggggcccattttggcttcactaggagaagttggccgttccgttttggtaccgagctcgaattcgtaa

SEQ ID NO: 18623 - DNA, 228 bp, Glycine max
  Peptide Sequence Number=SeqID_110308
atgattatgaggggccaagacatttatagtagccaagatgaggctacacttcaccttcctctagtgaaagtgaagaagcaaaaggggaagaatctaacacttgctagcattgcaacacctcttgggtttgagtttattcctcaagtaaagaagttgttggatgagggtttggttcgcaagagcttaaatccttgtgcttttttggtgcccaaaaataggtattattag

SEQ ID NO: 18624 - DNA, 323 bp, Glycine max
  Peptide Sequence Number=SeqID_110309
atgcggaggaactcgcctgcctcctctagtgatacttctttcttgccacaaccatcccttttctccggaagaccttttactggaatattctcgttcgaagtggggatcatttcgtcatcctgtccttccgttatttttgccttccctttaacgtttacgggttgtgtcggcaggtcggggggtacaaacacgcgaccgctgcgggtcacgccgctcagccccgtgatagtggttaccttggctgacaacgagctgatgccggtggcctcttccttcctttcgcttggaggcgcatacctacacggaactatgtggctgtttcg

SEQ ID NO: 18625 - DNA, 268 bp, Glycine max
  Peptide Sequence Number=SeqID_110310
gtcgactctagaggatccccttgacgatactcaacaaagtaaatccaagcctcctgctaggtggattgttgttaaatgtaatagacaaaaaggaagcactgagtgtgggtattacgtcatgcattggatgttaactataatcttaggaaatttccagaataattgggaaatgtatttcactgatcctagatcattggaaccagaaagattgaaggcgcttcgtaaccagtgggcaaagtactatttgaaagtgaaaaatgaaacttag

SEQ ID NO: 18626 - DNA, 471 bp, Glycine max
  Peptide Sequence Number=SeqID_110311
atggattctctcatcaccagacttctccgtgtgcctcatttactgaaggatgagaatcctactgatggagtggagacgtcagccatggttgcatctagagggagaggaagcggccgcaatagtcgaggaggtcgcagtggaaggggtggacgtcctcattgcacctattgcaagaggataggtcacacccaagagacttgctattcattacatgggtttcccgacaaggtcgcacaggtttctaaatcagagaaagcagagtccagattctctgatgaggagtatcaggagtacttgaagctcaaatcagagaagcccagcaaccaagctcaaccctcgtctgtaccatgtttttcaacagcgtgtatctctcaatccattgagggtcacagcccttggatactcgactcaggtgcctctgatcatatttctggaacatgggacggggcgactgattggagaaggacatga

SEQ ID NO: 18627 - DNA, 120 bp, Glycine max
  Peptide Sequence Number=SeqID_110312
atggacatatttgagaaattaaagtggttcctacttgttgatggattatccatggtttccatggataagtggataaatataaccgacatggaatatgtgattgcatcaaggtatttctaa

SEQ ID NO: 18628 - DNA, 726 bp, Glycine max
  Peptide Sequence Number=SeqID_110313
ctggtcgcgccgtggggacgaagtggtaactcttatctggtggtgcccgccaactcaacggcgaaaagcattgccgacctcaaaggtaagcgcattgccttgcatagaggccgtccttgggagatcccatttgccaacctagtgcaaaaaaatggcctcaagctgaccgatttcaaaatcgttaatgtgaatccgcaagtgggtgctgcggcactggcgagcgggtcagtggatgcgttttactcgctgagtgatgcttataacctggtggataaaggtgtaggtaaaattatctggtcaaccaagaatgcgccaccagactggaaactcatgggcggtttgtgggcacgcaacgactttgtcaaagagcatcctgaactcactcaggccatcgtcacgtcgtttatcaaagcgaaccattgggccgcgcaagaggcgcacaaagagacctacctcaaagagtatgccagcctggtacagccagagagcgtggtcaggcgtgattatgaggacgatagtgtgagctggcgtgaccgttggtcgccactatacgaccaggcactggtggatcattacaagcgtgccgcttcttatgcacgcgaatccggcctgattcgcaacgatattaatattcagcagttgctcaacgcaagctttgtcgacaaagccttgaaagagctcaacctggaaactttctgggcgccatcccggattgcatcacaataa

SEQ ID NO: 18629 - DNA, 405 bp, Glycine max
  Peptide Sequence Number=SeqID_110314
atgacagagaggtacgcttggggagtggctgctttggtgcatatgtacgaccagctgaacgatgcatctatgagccacaaccgacagctcggcggttacatcacactgctgcagtgctggatttacgagtactttccgttggtcgcggactccattgctgatcaggagtacgacgaggattctctgcatgcgtgtaggtggattgtgaccaagaagaccgtgaagagcattcgtacgccggcgtacaggaagcgcctagaccgactccggattccggatgtcttttggatcccttatggggagcaccgagaggttcgggacttccacgtcagatcatgttattccgctctcttgcgctgggggcctgttgctgtttattaccgaccggagagggtcgtgcggtag

SEQ ID NO: 18630 - DNA, 556 bp, Glycine max
  Peptide Sequence Number=SeqID_110315
ggtcggaacaggagagcgcacgagggagcttccagggggaaacgctggggggcggagcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtactcttagcttagacatgatatcaaaattcccaacggtttggtgggctgcgggaaaaagaaagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18631 - DNA, 444 bp, Glycine max
  Peptide Sequence Number=SeqID_110316
gtcgactctagaggatcccccaacggcgaccgcttccaatacagctagggaagcggaatcgatgctacagcccgcaataaacttgggccgagacagaaacacaacagtgttcgacttcactcctcgtaccgctccagatgatttgagccaagcccctaccttcaaggggcaactccctccttatgccgactatcccttgcaagaagatgatgaaggagaggcccatctaggccctctccttcccctcaaggatccgaccccccatgaattgccccaaccaaacggtcgggaaacctgtcgtgccagctgcattaatgaatcggccaacgcgcggggagaggcggtttgcgtattgggcgctcttccgcttcctcgctcactgactcgctgcgctcggtcgttcggctgcgcgagcggtatcagctcactcaaaggcggtatacg

SEQ ID NO: 18632 - DNA, 105 bp, Glycine max
  Peptide Sequence Number=SeqID_110317
atgaagggaagaaggcataaatatgtgtttaacaacaataaacgtgagaagccagagaagtatttatattccatcacgcatccattgactactgattacatgtaa

SEQ ID NO: 18633 - DNA, 132 bp, Glycine max
  Peptide Sequence Number=SeqID_110318
atggatagtggaagcaagtctaggggaagtggcaagattaaacaagtaaataacacaagagaattgttaacccagttcggtgcaacctcacctacatctgggggctaccaagccagggaggaaatccactaa

SEQ ID NO: 18634 - DNA, 213 bp, Glycine max
  Peptide Sequence Number=SeqID_110319
atggaggctgacatggaggccatgaaagagcaaatggccgcaatgatggaggccatgatgagcgtgaagaagataatggaagccaatgcggttgcaattgccgctaccagcgttgttgctaagggaacccgacgtccccatccggcgtcatcaatgaatcatccaacctcaaatatggtaggcaaagatttgggagtacgggcagccccatga

SEQ ID NO: 18635 - DNA, 297 bp, Glycine max
  Peptide Sequence Number=SeqID_110320
atgcgtcctccccttgagagggctacacgccctcaccttcagtggactacacgtccaccccttgagagggctacacgccctcaccttcagaggactatatgtcctccccttgagaggactacacgtcctcgtcttcagagggatacatgcccttaccttcaaaggactacacatcctctctttcagagggctacacggctgcacgccctcgccttcagaggactacacgtcctcgccatcagagggctgcacaccctcaccttcagagggttacacgccctcacggggatcctctag

SEQ ID NO: 18636 - DNA, 147 bp, Glycine max
  Peptide Sequence Number=SeqID_110321
atgaggcgtctccaatcatctttcttccatcttcattctgctgccattgatcttcaaaaatcaaaggactccattgatgaagaagatccaaggcctacaagctctacatggagctacatcatgtggtatcagagcatcttcgtctag

SEQ ID NO: 18637 - DNA, 324 bp, Glycine max
  Peptide Sequence Number=SeqID_110322
atgactagaggcaatccatccgacttacaatcctttgattctgagatagataggacatttcatagattagttaggcatcattttgtgccttttcagcatcctgagcattctgttattggtgagtttgagcattctatggttggtaattttgaacatcctgattttgagcattatagttttgaacattctgattttgaacattctgagaacatggaacaacctccatcccgtgagaggactctaagggaaatggctgcacctgatttcacttatgaaagcttgggcatccaataccctaatgaggatgtcccatatgttctttaa

SEQ ID NO: 18638 - DNA, 309 bp, Glycine max
  Peptide Sequence Number=SeqID_110323
atgacggtgaaaacctctgacacatgcagctccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccagtcgttgtggaggaaaagtcacaataa

SEQ ID NO: 18639 - DNA, 305 bp, Glycine max
  Peptide Sequence Number=SeqID_110324
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccctaatgggtcaacttcaacggcaagccttccgcaaagcctatggtaagcatttgggacctagctag

SEQ ID NO: 18640 - DNA, 236 bp, Glycine max
  Peptide Sequence Number=SeqID_110325
gtggacgtgacgtacgagaactggaaggcgacccctactgctcagaaggacttaatttgggtggatattcaggcttctgacagtaggacgaaaaagaagttacttcagactgttggcaagagatggaggcagtttaaagcagacctcacgaggaaatgggcccttgcagccgatcaggacagtgtggatgacattgtctgtgagaaatacgacataagcaaggaaaaatgggccca

SEQ ID NO: 18641 - DNA, 219 bp, Glycine max
  Peptide Sequence Number=SeqID_110326
atggaaatctttattcagtcaattgatcccgatgcatggaatgctattgttaaaggaccttttataccaactaaagaagtgaacggtgaatggtacaaaagtgcaaaggaaatacagaaaatgcttgaagtcactcatgaaggcatcgtagatgtaagaagagcaagaaaacacactcttgtatctgaatataaagctttcctaatgaagaatggataa

SEQ ID NO: 18642 - DNA, 612 bp, Glycine max
  Peptide Sequence Number=SeqID_110327
atgggttctccacctgcctccactcctcctcctccttctcctcctcctcctccttcttcggacgcatcggcttcgccgtctgctgtgaagcggacatgtaaagccttacgtctacgatcgttgtccactagaccacttggtgctgagagaccagtggtgcatgttgatcctgctaccgggaaggccgacggtccccacaagaagaaattaagaacaaatttggggattgtggcgcgtgataaggtggacatcacctacgagaactggaaggatgtccctactgctcagaaggacctgatttgggaggaaattcaacaaggaaaagtgggcccagttttgccagactcgcagagacccttcttgggagattatttggagcagaagctcctagctgagaagaccaagaagaagctgcaggaagctgcacagtcaggaagcattgatggcgtcatcgaccctccatccccggtcagacgccacgtgaagtggaagatggcccgcacgaagaagacaggggagatgacaactgaggccacaaaggaaatcgctgagaagattgattcatttgaggagcaggccacgcagggatcgttcgtcccccatggacgttag

SEQ ID NO: 18643 - DNA, 883 bp, Glycine max
  Peptide Sequence Number=SeqID_110328
cttcgcaaaagcccggacacccttagcagccaaacctgttcctttcccgtaccaaaatagccacgcagtcccatggagatatacacctccgagggagaaggaagaagaagccactgacgtcagctcgttgtcagctaaagtaacaaatatcacgggactgagtggtgtgacccgtagtggtcgtgtgttcgcgcctccggacctaccagtccaacccgcgaacgtcaagggaaaaggaaaagtggtggaggaacaagatggcgaagcaccccacgcttcgaataaagatattccggcaaagggccccccggagaaaaagaatggtaaaaaggaggtgtcgctagaagaagccagcgagttcctccggataattcagcagagcgaattcaaggttactcccggagagggtccatcgaataagccccctttccgtcagcaagtggtatggaccctatatcgtgccaagctctgcaagtaccatgggggtgtcccggggcagtttaaccgtcgagggagagcggttaatgcagttgagtcccgaaataggccctacaggtctaaacctttaagggatgtggcaacccctaggaggtttatctttgaggccctacaaaaaggaggtgtgattccccatagtgggtgtaaggaggattcctgtctgctacactccggcgagatgcatgacatggagacgtgtttggaagtagaggaattattacagcggatgatagatcaaggtcgactggaagtcggcattgaaggaaaagaagagcagcatatatgcatgcaatctacggaggggagcggtgttgtgaagcccaaacccttggtgatatacttcactaaaagcgcaacttcgcaaaagcccggacaccctttatag

SEQ ID NO: 18644 - DNA, 615 bp, Glycine max
  Peptide Sequence Number=SeqID_110329
atggcaatgacttttagtctccagatattaggcaagcttcaaaaaatctttttgatccttcgacttgttgtgtattcctcttatagagaatttaactcattcactatagtagtgaatcttgtgagcatctcctctatggattcattctcaaattctcctattctgtcatattcaggtttacttgaggcacatgacaaaaagaactttgctctagagtttaggagaactcttgctttctcatttgagccttttccgccaaagccaggagacttgttggttgaagcacctttaggtatgaatactgttggaacttgtccaacaaccacttcttctaggatcttcctctcacaatatcagggacaacagagattaaagaggaagttatcatgcggagtattggatgagattttgagtgattgtgtggtttctagagcttcccagttatggagagctaaatcctcagttggttcttcctacggggtacttgatatgcatgctcaattagggtcattcaacattgagaaatgcttggctaggattacgctaaacatgcacgagacattgggatttagcagtccaggagacaacatagaatacaggaacgttgttaggtag

SEQ ID NO: 18645 - DNA, 762 bp, Glycine max
  Peptide Sequence Number=SeqID_110330
gatgaatattgatgcatctgtcttttatgagttaactcaattgtccaatcaaggtgtaccttttgagggcaccattgttgatgactggaaatttgatttttcaagtcatgatgcccgccgaatggtctgcaccggtcaggcggaaatgaccggaagattgcttgccggatcattgactctcgaatgtcacatcatgcattatctgattgtgcgtattcttcttctccattcatcaaatcttgctcaggtctctaaggaggacctgatagttatgtgggcattcttaaccagtcgtcagatcgactgggcacatctagtcagaaagatgcaccgccgtaggctacagatgagcgtacaccttctcctccatgatgtgattcttctatgcttctcaatgaacttctcactgagttacgaggattccgagcacatgttgatgacttcttggatgggggagattgtagaagcaaggcttcaagaagtttttgatgatgccaatagtcaagcatatccaagaccaactcaaggagatttagatttcaagaaagattcatcttcatggataattcaagtaaacatcaagcaatccaagatattcaaaacatttcttcttcctgtctttatgatcaaagggctaagagactacgagtctcttgttgtaaggcatctgagcacaaaggaagggatgtccttgtgtgtttcagaaggtgtaaaggattatgagatagtggaactcctaagcggattttttggggactggac

SEQ ID NO: 18646 - DNA, 317 bp, Glycine max
  Peptide Sequence Number=SeqID_110331
gaagacatatactgcctgagaggaaggtagaaatataccatattgagttggacgagtttaaggctgaattagagaggcataacttccataaacgcctcagcaatttagttgatagcagcatagatctagctttggtgaaggagttttatgccaacctttatagctctgaagggccttcaccaaagcaagttagggtcagaggccacttggtgaatattgatgcaaacagcctcaacacctttctggagacacccatggtactagctgagggccaccctgggaagattctcaggaaagatttaacaactcttgcttag

SEQ ID NO: 18647 - DNA, 495 bp, Glycine max
  Peptide Sequence Number=SeqID_110332
atggtctatgctgcctctggtcaacacgacttaaaagtggcatctgaggaaatgggccaacagacatgtggcccaactctttctgccacaaaagtttatgtgagaagaaaggaggtgttgaggagtaatagcaaagcccagcagtttaagaaatcaattgtggacttcaacccagcctctaaaactgaccctctgccttcgttacatgaggactctatagagctgcaatgtgcccttttgaaggaaatgggcttgacttatggggaagatgataacaaggctgctggtggcctattatgtttgtggaataactccatttttgaggtgaataggagggagcaaggtagaagttttttaatgcttgaagggacatgtattagtaataatcagaggatgatgattgtcaatgtctatgctccctgtgatctggttgggaagaaagctttatgggatgatttggcaggatttgctatacttctctacttggtgggctga

SEQ ID NO: 18648 - DNA, 279 bp, Glycine max
  Peptide Sequence Number=SeqID_110333
atgttctttctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatatttttcaggagaatgatagatctcatccagcgcaagttgttgcagcccagatacgcacactgctatataaacatgaaggttgcacgggttctgtaccaagtcagagggggatcctctag

SEQ ID NO: 18649 - DNA, 768 bp, Glycine max
  Peptide Sequence Number=SeqID_110334
atggcggcaaagacctgtattatacccgaaacaaacaacaaacaaaacattatgaagcgtattggtctatcagctgttcccgaagttctatctaaaatagaacagaactacgatgtatttactataactgataaatttcgtaatctgtctttgaaagatagcagtgctagttcaagacaaggggaattcttaataaaagatctccgagctcctgataccttagtgggtttaagaaagttaaaagatagcctaggcttatcgttaacaaaaggtagtcttaacagcaatccattacttaagttaaagggtatttctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcaccgctgtcacaggcatttgctcaagataggcccttcatggatatggatattgaaataccggattctaataaatctattattataggtgttagcttaggactagcagttgccatcttatttacatttgggattaacccatgctgcggagaagttatagtatga

SEQ ID NO: 18650 - DNA, 354 bp, Glycine max
  Peptide Sequence Number=SeqID_110335
atggttgtcattctgcctaaggaaaaccttgttgtctggttttgttccttgcataacaggccagacaactactttaagggaataattaacagtgctttgaaaggacttgatgatactccacagcctaaatccaaggctggtgctagggggattgttgttaagtgtaatagacaaaaaggaagcactgagtgtgactattacgtcatgcactggatgtccacgataatcttaggaactttcaggaataattgggaaacgtattttaacgatgttagaccattggaagcagaaagattgaaggcgcttcgcatccagtgggcacaattttatctcaaagttagaaatcaaagttag

SEQ ID NO: 18651 - DNA, 1254 bp, Glycine max
  Peptide Sequence Number=SeqID_110336
atggtgccgctggggcgcaggcaatgcgctggcagcactgctgatcaaatcggttctgccatcatcgacaacatgtccgtgctgttcgccatcggtgtggcttacggcatgtcaaaagataaagacggtgcagcggcattaaccggctttgtaggtttcctcgtggttactaccctgtgttcacccgccgcggtggccatgattcagaaaatgccggtggagcaggtgcctgccgccttcggtaaaatcaataaccagtttgtcggcatcctcgtgggcattctctcggcggaagtttataaccgcttcagccacgttgagctgcctaaggcgctgtcgttcttcagcggtcgccgtctggtgccgatcctggtctccttcctgatgattgtggtcgcctttatcctgatgtatgtctggccgatcattttcggcggtctggtgagctttggtgagcacatccagaaactgggctcggtcggcgcgggcgtgtacgccttctttaaccttttgctgattccggttggcctgcaccacgcgctgaactcggtgttctggttcgacgtggcgggcatcaacgacattccgaaattcctgggcggcgcgcagtctatcgccaacggtaccggcatcccgggtatcaccggtcgctatcaggcgggcttcttcccgatcatgatgttcggtctgccaggtgcggcgctggcaatctatcactgctcacgtccggaaaaccgcgctaaagtcggtggtatcatgctggcagcggcattcgccgccttcttcaccggcatcaccgagccactggaattctccttcatgttcgtggcaccggtgctgtatgtcatccacgccgtgctgaccggtatttcggtcttcatcgctgccagcatgcactggattgccggtttcggtttcagtgccggtctggtggacatggtgctgtcgacgcgtaacccgctggccgtgcactggtggatgctgatcccgcagggtctggtgttcttcgtcatttactacgtggtgttccgcttcaccattcagaaattcaacctgctgacgccgggccgcgagctggctgccggtgatgagacagacggctacgacgtcaacgttgatcacagcagcaacggtgagagcgaaaccgaatctctggcacgtcgctacatcggcgcggtgggcggttctgacaacctgaccaacatcgacgcctgcattacccgtctgcgtctgaatgtgaaagactcggcgcag

SEQ ID NO: 18652 - DNA, 213 bp, Glycine max
  Peptide Sequence Number=SeqID_110337
atggagaattggcggacagcgctatgcaataacttgcgcggctctagactcgaaggtggaggacacatgaacagcgctaggcaattacattcatgggtctccgaaaaaagtggagaatggagaattggcgaacagcgctacgcaataacttcgcggggctctaggctcgaaggtggaggacacatgaacagcgctaggcaattacattcatgg

SEQ ID NO: 18653 - DNA, 81 bp, Glycine max
  Peptide Sequence Number=SeqID_110338
atgcacgaatatgatgcaggaatgatatgcccattaggatgccatgaagagatgcaagacacaatcaaggaatatgccaga

SEQ ID NO: 18654 - DNA, 216 bp, Glycine max
  Peptide Sequence Number=SeqID_110339
agtttctctccgtggttccttgttgaaccaattatcagacttatcaaggtaatccttgtggcgtctacccagacttatcttccttcaccggaagtggcgtctaccctggacttatcttccttcaccggaagtggcgtctaccctgacttatcttccttcaccggaagtggcgtcatccaaaaacctccagcctgtatcaaacgatccgccccgtaa

SEQ ID NO: 18655 - DNA, 594 bp, Glycine max
  Peptide Sequence Number=SeqID_110340
atgactttgctgctcggcaacatccagcccagcgaccataattccgacctccccctgccgaagtgtcagctggtgtacgccatcctgacgcagatgagcattcacgtggctcagttaatcgctgatgccatctatctatttgcaggtatggcgcctaccaggcaccctctggacctggataagtccaacagggccctgggatttcccgccttgatcacaggactctgccagtcgttcggagtccccgtcgcacctagcaagagacaggcacagggggatgctccgcagcctgcagacgcgccgccacctcatcaggctggtccagcagaatcgtttgatacggagcagtatttgcggcatttggttcgccagcaggcggccaaccaccgggctcatcttgcagagccagcgttttacttcttttccgtgacctactccggaccagttcagggcagagtcgcatggcctggagattggcctgaggcccgggcaggagaggcgccagcagaggctcccgacgaggcagatgaggcccgcgaggacgaggagatgaccgatttacttgatttctttggagggagcggggccacatga

SEQ ID NO: 18656 - DNA, 150 bp, Glycine max
  Peptide Sequence Number=SeqID_110341
atgatatgcaagtatttacatcaagtactgatgcaatcctactctgcaagggcattggatagaaggcttcaagaagattgggccaaagatgcaagagaaggccttagggttctcatgagccttagggtagatttcgagcccatggactaa

SEQ ID NO: 18657 - DNA, 656 bp, Glycine max
  Peptide Sequence Number=SeqID_110342
taaacaccgagactttttcaagtctcacaagttatccagaactacgtaggtctgagttcctcattggaggatacgtaggagcaagagcctcgcttttgtcgaccacaccaccttttgttgccatgacccaagagctggccaatgtggtcatctgcgccctttccggagatgagcaagagccttgcttttgtcggccaccccacaagatctgtcatactgaccctgagtcatgtgacatgcggagacaaaatttggtcattccgcacccctttgccattcagacacggtcgtgtccgatggcacgcagagacaaaatttggtcattctgcacccttttcatccaggggccgatgactgcggagacaaaataccttggtttccgcacccctttgccattcagacacagtcgtgtccgatggcacgcagagaccaagtttggtcattttgcacccatgatacgcggagataccttatggttatccgcacccctttgtcatccagaggcggcgggcccgatgacaagcagagaccaagtttggtcattctgcacccatgatacgcggagataccttatggttattcgcacccttttgtcatccagaggcggcgggcccgatgacaagcagagaccaagtttggtcattctgcacccatga

SEQ ID NO: 18658 - DNA, 180 bp, Glycine max
  Peptide Sequence Number=SeqID_110343
atggaaaaacgccagcaacgcggccttttacggttcctggcctttgctggccttttgctcacatgttcttcctgcgttatccctgattctgtggataaccgtattaccgcctttgactggcacgacaggtttcccgactggaaagcgggcagtgagcgcaacgcaattaatgtgagttag

SEQ ID NO: 18659 - DNA, 222 bp, Glycine max
  Peptide Sequence Number=SeqID_110344
atgaaggaagaacaagaaaaagaaaaagaaaaagaagaagaaaaagaagagatagaaaaaaaaattagaaaaatgaaaaagaaaaatagaaggttgatgaggagaaaaagaagagcaagagtgaggtttcaagagagaaaaagagagagattacttcagctgaaggcaaggaagtaccatatccattggtaccttccaagaaggataaagagcgacacttag

SEQ ID NO: 18660 - DNA, 727 bp, Glycine max
  misc_feature (272)..(272): n is a, c, g, or t
  Peptide Sequence Number=SeqID_110345
atggcaccgaatccacgcacacgtgcagtagatccacaccgtgcgtggatggcgagccctcgggccatacacagaaaagcggccccgcaaagcggggccgccagggtgggccgggatgggggaggggatccggcccgcgttcagtgcccagacgaggagagaggggcaccgaacgctggaacgcttatgcagcggcggcttcagccgcttcgtgcgacggcagggccgccaacgcgccagcgatggcgtcttcacggtgctgcggcgagtangcgatgccttcggcacgaatggttcctggaagtcggccggcgaatcggtgtagatgccgccgcggctgctgaccacgatcacgcgcttgccgccggccaggccgatcgggccgttctcggtgtacttgaaggtgcgcccggccacggccacgcggtcgatccaggccttcagggtggacgggatgctgaagttgtacatcggcgcgccgatcaccacgatgtccgcggcaaggaactgctcgagcacctgttcagcgtcggtggcttcggccgcgtccgccttggccagcgagctgctgtgaagatgcggtactggattggcgtcaagatcgcgataatcgatctgcaggccttcgatctgctgcttgaagcgggccaccacggcggcggtcaggtggcgggagacggagttctcgccaagcacgctggcgttgagatgccgaaggctcaagcca

SEQ ID NO: 18661 - DNA, 231 bp, Glycine max
  Peptide Sequence Number=SeqID_110346
atggacatatcgttcctgcatttgtcacttattgtcgcaactgtcgcaacctacccttcggcgggagggcgacgcatgactcgcgggatgcgtgttccacaaaaggaatacgcgcggagtcgccaccaacgtttatttgaggaaaacgttggaaaaaccggaaaagacgcgatctacttttttttaagtgaaaggctcgggagttgtatttacgcacggggaaggtattag

SEQ ID NO: 18662 - DNA, 153 bp, Glycine max
  Peptide Sequence Number=SeqID_110347
atggacaagaagatcactgaccgaagaatgaagtcgttgagaggaaaggaaatcgcgttggtgaaggtgcagtggggaaccgatgagggtgattctacatgggagttggaggataggatgagagaattgtacccaagtttgttcatcgagtag

SEQ ID NO: 18663 - DNA, 994 bp, Glycine max
  Peptide Sequence Number=SeqID_110348
ggaacagttggcgctggccgagatcgggccgccagctggggatcagccggcagaccgcgcacggccatctgctgcgcgcccttgtcgcattgcagcaggtgccgggcgcatgagccaggagaccattgcacgcgaagctgcacgctggtggctggatgcgcacgacggtgaccgcgatgagaacgcgttcgagcaatggtgccgggccgatccacgccatgcggcgcagtacctgcacctgcaggagttgtggcaggccggtgcggcgacgcccagcctgcagcggcaacagcagcgcaggcaacgccgtcgcctgcgcgaagccggcattgcggttctgttgctgtgcgcgctgggtctctacagccgccatgcctcgccacccgtggcacaggtactgcgtacggccgctggcgagatccgcgaggaaactcttccggatggttcgcatgtcctgctgtcacctggcagcgaagtgaaggtgcgcatcgatgggcagcgccgccagctccagctgcagcgcggccaggcctggttccaggtcgccgccgatgccgaccggccattccaggtgcataccccacagggcaccgtcactgcactggggaccgcattcgatcttgccgtgcagggcaacagcagcgtggtcaccgttaccgagcatcgcgtgcgcgtggacagcggcaacgtcagcatgctggccgacgacggcgagcagctgcgcttcgatgggcaggcaacagcccatgcaacaacggctgcccccggaacattggcctggcgcgagcggcgcctgcactgggtctcggccccgctggccgacgtcacgcagggcctggaccgctggcatggcgggcatacgtgggtcgtcggcgagcagctgcgccagcagccggtcaccctgctcggcagtgccgacggtgcagccagcaatcgcgaccagctggccacgcaactgcaggtgcgcgtgctgcgcctcggcgcgggcatacag

SEQ ID NO: 18664 - DNA, 538 bp, Glycine max
  Peptide Sequence Number=SeqID_110349
gtggcttacgggtaaggctcatatgacggggatcaagggagccctgtatcggagatgtttggatgccctgagtgtgactgacgtgtgctggatgccctatgcgggttcttcgacagttgggctacctttagacagtccctccgccgccggggagctctgtgtagttcctagacaggtagcgccagactacatggagtggttttttcggatatcgcacccattcgtcacatggaccgaggagactgttgcgccgagacatccgcctccccctcatcatgaggagttcatcgagccacccatccccgaggtttcagtcgcgaccgatctccctacgaattcagtggttcactgtgaaggatgtcaagggatggcacaggatttaggagcgattgctaaggatttagagcgggtcatcaacctcaggatggtcactgagggcattgacttacatgacatcatgactcgttgtctgaggagagctagaggtaacgccgcagatgaaagtcttaggccgcgccagagacgccgcatagattag

SEQ ID NO: 18665 - DNA, 438 bp, Glycine max
  Peptide Sequence Number=SeqID_110350
atggatctagaaggaaagggtagaggaatttatttttggtgtagaatctattttggcaccaacatctattggctttggaagcttcttgccactcctcaaggtcttggatggtggcattcacattctattgaaacggaatgttgctggttgctattagcttcatcagattctccaaagaaggtccagaactatgttgcacatgttgtgcaggatacatcctttgtggtacaagtagagggtacatctacttgggttgttgtgactgagaacaagagaggatacatctcttgtggattagttctagtggaggatacatccactaggttgttcaaagagaataagggagggtacatcccttgtggatctttgcttgtaaaggactttacaagcttgaaaagaaatctcaaggaccgcaggttgcttggggtctggatgtag

SEQ ID NO: 18666 - DNA, 306 bp, Glycine max
  Peptide Sequence Number=SeqID_110351
atggctattgtcgcaacctacccttcggtgggagggcaacgcgggggctcacgggtgcgtcttccatgggaggaaaatgcgtggagtcgccaccaatgtttattcgaggaaaacgtcgaaaaaatcggaaagatgtggtctacgaacttcaagcgtgaaaggttcgggagttgtttttacgcatggggaagaagagaaatgttaaggcaatggaccattaacgatctcttggttttgaaaggagagaaacgtttaggcgttggaccattaacgatatcttggtttttgaaaggagagatacgttaa

SEQ ID NO: 18667 - DNA, 393 bp, Glycine max
  Peptide Sequence Number=SeqID_110352
atgaagcagcttaagaggaacggcggcggtagcccaataatccagttggccaagtcttcgaattctccaggggaggtgtcagtggtgactgtacggaggaagaaggatagtggaaggtggaagcttcatacggcggttgctgaaatgaaggaagagttccctcggtatcgaacaagcttagcaatcgtttgcgagtactctcaaaatcaatcccaagggattgagctgaatgtacaaaaggataaggggtgtgcagcaacgaagggtccaacacctccagaagaagaagagaagaagaagataaactcaagggagcaaacaccacaagcaggatttggtgttgattctactaattcgttcttccaattctgccccttagacgtaatcatcaag

SEQ ID NO: 18668 - DNA, 464 bp, Glycine max
  Peptide Sequence Number=SeqID_110353
gtatgccacctaccaggcaccctctagacccagataagtctaacagggccctgggtttttcggcattgatcacgggtctctgccagttgttcggggttcctgtcacacctagtaaggtgattcgaccgctgatcacccgggctttcatagagaagtattgcacgcccagacaggcacagggtggcgacccacaggccccagacgcaccgccgccacctcctcaggctgacccagctgggtcatttgacacggagcagtatttacggcatttgagccagggttttgcttcttttccatgccctactctggatcagttcagggcagaggtcgcatggcccggagattggcccgaggcccaggcaggggaggcgctcgcaggggctcctggcgatgcagatgaggctcgcatggacgaggagatgacatatttacttgatttcttgggagggagcggtgccgcatga

SEQ ID NO: 18669 - DNA, 129 bp, Glycine max
  Peptide Sequence Number=SeqID_110354
atggctggtacattcttccttttgaaaaagcaatatagtttagagattatgagcgggacgccacaaatggtggtatcagagcaaaagttggattctagtgaacctgttatggtcttgctgtgtgaatga

SEQ ID NO: 18670 - DNA, 324 bp, Glycine max
  Peptide Sequence Number=SeqID_110355
atgggttgttgcagcttgcacgtatctgctccacttggtgggctgtactcttttcgccaacaagagttcaacccatgtacatgtcgtgcacctgaaggctttcagggacctggcccaggcaaggggatttgcctggggagcgactacattagtccacattgctggatatacgagcactttcctatagtgcatacatccgtcgtccatgatgcttatgatgacgggagcccacgggcctgcaggtggcttacgggtaaaggctcatatgacggggatcaagggagttccgtatcggagacgtttggatgccctgaatgtgactga

SEQ ID NO: 18671 - DNA, 312 bp, Glycine max
  Peptide Sequence Number=SeqID_110356
atggcaccggaggatatggaaaagactaccttcatcaccctgtgggggacgttctgttataagactgctagaccccgattcattatgatagcgaagcctaatcttgatcaagcctcgtccgtagattcctctttacaacaacttagccccgtactatcaaggactttagaatcagaccagtttccactgttgaatgaccccaacaaagcatgcatctacgtgatcaaggatctcacaatcactcgcaaactcatctcaagctctcagaacggcttctgctttgagctctcatctctgcagatcttcacatag

SEQ ID NO: 18672 - DNA, 121 bp, Glycine max
  Peptide Sequence Number=SeqID_110357
ggcccctaaagcagtgatcaataggttaactgccattcaaagacaatttctttggggtggtaaccgagaagggaagaatattgcttgtgtagaagcaaagcttcatggtgaatcaaagtga

SEQ ID NO: 18673 - DNA, 519 bp, Glycine max
  Peptide Sequence Number=SeqID_110358
atggaaaaacgccagcaacgcggcctttttacggttctggccttttgctggctttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtacccgacagagtactattcaagactttttggtgcagcaagatcttgatcaaacgttagaagatgaaaggtcaacttctataaatgaaaccgagtggactaagatccaaaagagggttgtgagtgtgatttggttagccgttgctctcgagataaaacaaaatatgtggaaggagataacgcagaaggccttgtgggagaagcttgagaatatctatacgtcaaagttgctaacgaatcgtctttgtttgaggggatcctctagagtcgacctgcaggcatgcaagcttggcactggccgtcgttttacaacgtcgtga

SEQ ID NO: 18674 - DNA, 336 bp, Glycine max
  Peptide Sequence Number=SeqID_110359
atgacattaacctataaaaataggcgtatcacgaggcccttcgtctcgcgcgtttcggtgatgacggtgaaaacctctgacacatgcagctccgggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 18675 - DNA, 107 bp, Glycine max
  Peptide Sequence Number=SeqID_110360
gtgttgagagaagaagcccagagtttcaggaatctcaggatttcaggtcaaatccttttcaagggggagggaattatgcaattctaccccccaagggcattggatag

SEQ ID NO: 18676 - DNA, 555 bp, Glycine max
  Peptide Sequence Number=SeqID_110361
atggcgacagccgcgcgtgctgtggctgctgtgcgcgctgggggccttgcccggactggcgggatccgccgcctatgcgaccagcgcgctgcctgcgatgagcgccctgtgggagacgccgggcctggcggtggatctgttcaccgcgccgttgctgaccatgtcatacgccgccaccttcctgctggcgatgcgcacgcggccgggagcctggctggcgcgctgcctggcgccggcgggccgcatggcgctgaccaattacctgatgcaatcgttgctttgcgccttgatcttcaaggcgtgggggctgcgactgtcgggcagtgtttcgcccggggcgggggtgctgatcgcggtggccatcttcgtggcgcagttgccgctgtcggcatggtggctgcgccgccatgcctacggcccggtcgagtggttgctgcgcgcgctgaccatcggcgcctggcccgcctggcgccgcgtggcgggctagtgctgtgtcaggcgccgccgccagcgatggcggcgtcgatggcgcctgccaggcgctcggtcagttga

SEQ ID NO: 18677 - DNA, 195 bp, Glycine max
  Peptide Sequence Number=SeqID_110362
atggtgatggacgagattttgtcttccgttgatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18678 - DNA, 737 bp, Glycine max
  Peptide Sequence Number=SeqID_110363
gccggcctgccgctggtcggcgcgcatcgcagcaacacggcatggatggcggtggcacggccggccgccttcgcacagctgctgctgctcgccggcgcgttcgcggtgctgaccgccgcgttcgtgcagcaggacttctcggtgcgctacgtggccgagaactccaattcgctgctgccgatgatctaccgctactcggcggtgtggggggcccacgagggctcgctgctgatgtgggcgctggtgctggcgctgtggaccggcgcggtggcgctgttctcgcggcacctgccggcacacgtgcaggcgcgcgtactggcggtgatgggcgtggtcagcgtcggcttcctcgccttcctgatcttcacctccaatccgttcctgcgcctgaacccggcgccgctggaaggccgcgacctcaacccgctgctgcaggacccagggctgatcattcatccgccgatgctgtacatcggatacgtgggctttgccgttccgttcgcattcgcggtggcggccctgctggaggggcgcatcgatgcgcgctggctgcgctggacgcggccgtggaccaacgtcgcctggggcttcctgaccctgggcatcgcgctgggcagctggtgggcctactacgagctgggctggggcggctggtggttctgggacccggtggagaatgccagcttcatgccctggctggtcggtgcggcattgatccattcgcaggccgtcactga

SEQ ID NO: 18679 - DNA, 542 bp, Glycine max
  Peptide Sequence Number=SeqID_110364
atgacgccctatgaggattgtcaatctccaactaatcagcctgtaatcaacactgaaggatattctgatcttggtgatcaactcatccaatgtagccaatattctggaattcagagccatattgtttcaggtttaagtcacatgctcgatcaacacaattctcatgctaaaagttttagaatggccagggatagattggcaggtgatcaagccaataatatcaaattgcaactaatagctgctcgaggaaaagatggtcgtgtatataatatgcctaatgttccagaaattgctgcacttattgttggcgattttcatccaggctcaaaaagagatattattgttgaaactcaaaatggagaattacaaagaatccatgaacttcatgctagctatccaccactacagtactctctactctttccttatggagaagacgaatatagagctgacatacttcaccgttctacttcatccagcaaaaaaagaaagcgaaaccgtctgacaatgagagagtggtttgcttatagacttcagtccag

SEQ ID NO: 18680 - DNA, 285 bp, Glycine max
  Peptide Sequence Number=SeqID_110365
atgtataggctttcagaattgggcattgagatccattcagttttgacacgtcgttctcagtggagttcacagccttcaagttctcctcagttatcatcaaaggaaacattcattttgaagtcagaggcaaagaccatttctgagataaacaaccttggtgaagatggtgatctggatttaaatgtctccccaaaagcacttgataaactactgggtcatctgctcgccttcaaatcaaaatccaaccgcagtataaaattctgctgttttgaaatgttcaactga

SEQ ID NO: 18681 - DNA, 660 bp, Glycine max
  Peptide Sequence Number=SeqID_110366
agggctacacgccctcaccttcagagggcaacacgccctcaccttcagagggcaacacgccctcaccataaaagtcctacacgccctcgccttcagagggctacacgccctctcctttagaggactacacgtcctcatcttaagagtgctacacgcccttaccttcagaggactacacttccccggcttcagagggctacacgtcctcgccttcagagggctacacgtccttgccttcagagggctacacgccctcacctttagaggactacacgtcctcgcctttagagttctacaagtcctcgcctttagagggctacacgccttcaccttcagagggcaacacgccctcaactttaacggcccacacgccctcgccttcagagggctacacgccctcaccttcagaggactacaagtgctcgccttcggaggactacacggccttaccttcagagggctacatgccctcaccttaaaaggactacaggtcctcgcctttggaggggtacacaccctctcctttagaggtctacacgccttcgccttcagagggctacatgtcctcatcttcagatcactaacggtcctgaccttaagagggcaacacgccctcaccttaaaaggcctacatgccctcgccttcagagggctacacac

SEQ ID NO: 18682 - DNA, 369 bp, Glycine max
  Peptide Sequence Number=SeqID_110367
atggttgagtttagtccaacaagaggaatctacggacgatgcttgatcatgattaggctagactatcatgaggaatcagggtttagcatttcaggaaacaccatagcacacataagcattgttaaatggagaatatcctttaagcatcaggcacctactaggaagaccaacgtgtcaccttcttgtcctcacacatcattgctcacagtctatccttgcagtgttgaatttaagaagaacttattccatgacaaaatgatgcaatcctaccccgcaagggcattggatagaagactccaagaagattgggacagggatgtaagagaaggccctagggttctcatgagccttagggtagatattatatga

SEQ ID NO: 18683 - DNA, 557 bp, Glycine max
  Peptide Sequence Number=SeqID_110368
acttcatcgaatcccgcgaatacgagcaaccgctgaacgtctacggctactccaaattcctgttcgacgaatacgtgcgtcagattctgccagaagcgaactcccagattgtcggcttccgttacttcaacgtctacgggccgcgcgaagggcacaaaggcagcatggcgagcgtggcattccacctgaatacccagctgaataatggcgaaagcccgaaactgttcgaaggcagcgacggctttaagcgcgacttcgtctacgtgggcgatgtggctgcagtcaacctgtggttctgggaaaacggtgtgtccggcatcttcaacctggggactggccgcgcggaatccttccaggcagtggcagacgcgacgctggcgtaccacaaaaaaggcagtattgagtacattccgttcccggataagctgaaaggccgctaccaggcgttcacccaggcagacctgactaacctgcgtaaagctggctacgacaagccgttcaagaccgttgccgaaggcgtaacggaatatatggcctggctgaaccgcgacgcgtaa

SEQ ID NO: 18684 - DNA, 99 bp, Glycine max
  Peptide Sequence Number=SeqID_110369
atgtttcagaatatgtttggaatggggaaccagacagaaaactacacatcagacgagcaatcccgacgtatcaaggaattaatgaaacattgggcttaa

SEQ ID NO: 18685 - DNA, 385 bp, Glycine max
  Peptide Sequence Number=SeqID_110370
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatgtaacggcaactaaaggaaatgagtttgaggattattttctgaagcgtgagctgctcatgggaatatatgagaagggttttgaaaggccttctcccatccaagaagaaagcattccaattgctcttactggtagtgacattcttgctagggctaaaaatggaactggcaaaacagctgcattttgcattcctgcattggaaaaaattgatcaggacaataatgttattcaag

SEQ ID NO: 18686 - DNA, 752 bp, Glycine max
  Peptide Sequence Number=SeqID_110371
atttcctacatctaatatccagtcgtgtggatttgggatgaccgaccctctcgatgagtcgatctcttgctttctcataagggtgaacccttggaggactacacgtcctcgccttcagaggactacacgtcctcgcctccagatgacttcacgtcctcaccttcggaggactacacgtcctcgccttgagagggctacacgtcctcgccatcagtgggctgcacgcccaaaccttcagagggttgcacaccctcgccttcagagggttacatcccctcaccttcagaggacttcacgtcctcgccttcatagggctacatgccctcaccttcagaggactgcacgtcctcaccttcagaggactacacgtcctcaccttcggaggactacacgtcctcaccttaagagggttgcacaccctcgccttcagagggttacatcccctcaccttcagagggcttcacgtcctcgccttcatagggctacatgccctcaccatcagaggactgcacgtcctcaccttcggaggactacacgtcctcacctttggaggactacacgtcctcgccttgagagggctacacgtcctcgccatcagagggctgcacgccctaaccttcagagggttgcacacccttgccttcagagggttacatccccaaacttcagaggactacacgtcctcaccttcagagggccacacgtcctcaaacttcagaggactacacgtcctcaccttcagagtgctacac

SEQ ID NO: 18687 - DNA, 478 bp, Glycine max
  Peptide Sequence Number=SeqID_110372
atgtatgaataccttgaagaggaaagagtccctgatcttgagagtattttggcagacttcatgacataccaagagtcatgctggcaaccagattatgatgataaagcagaaggagttattaatctagatgacctgctaatgcaatttaaagatacagtagagtcaatgcaacaggcttttagaagaactgtaactcagattagtaagttggtggatgacatggctaacactgtggccaaagaagaggaagagcgtatagagattgaaacgaatcaagaaagcatttttcaagttaccaccatccatcatcagatgaccactgaagaggaaacgtctgtaatctccagtactccagaatactcttgctcggccgctgctggctatgttagaggaacagagaaaggtagattggaactcattgtagaggatcaaaaagtctcttttgacctctttgaggccatgaaacattcagatatgg

SEQ ID NO: 18688 - DNA, 910 bp, Glycine max
  Peptide Sequence Number=SeqID_110373
gctgcccacagattacagagagattgaggctgccttgtgcataccaggccgagggttcctcttgaacgctgagggccatcctgggaggattctcaggaaatatttgactatgttagcacaggtgtggagtgttctctcatactccaacttggcccccacatcacatacctctgatctgataatggacagagctaggttgatctttggcctagtctctcgcatggacatgaacataggagctcttattttttgccagatgacttctatagcccagtctaacacttctagacttgggtttcctgctctaatcactgccctatgtagagctagaagggttgtctctgacagccttacttttgagtgcctgagcccagtcattaacttggcctacatcaggaagaactgggctagaaaggagaggacgaggccagctgagcttccttccatatctgcagctcctactccagcatccacttcagcagctccttcagtcccagctcaggtggtggcacctccaggatccattccttccattgagcagtttttagaaagggtagcctggcctggggcccaaccttctcttcacagggaagacgaaggtcccacagcccaggatgaatcatccgaggccaccattctaaagccattcatggtagaagaggaggaaggtgagacacaggttagacaggaagctactgcttctcctgagaggtctcgagaggtcgcatcagatccacccacaccagtggtggacctatcctcacctcagcatgcagcagacccctccactcctatactagagataccagaggacccaaccactccagtcctgactctgaacacttctcctccagctactccagtacttcacctgacagatgaggaggatgttcagacacaagacacatag

SEQ ID NO: 18689 - DNA, 252 bp, Glycine max
  Peptide Sequence Number=SeqID_110374
atgtgtgttcaagaagatgaaaggcttgtaatggagatgggtgagagtgcattgttgacaactacttgtcggaagaacaaagcaactacgtctcaagctaatcaaaaggggaatggtaaaattccacctcaacttgatattaagaaggtggaaaagtgtttcttttgtaaaaagatgggagacgtgaagaagaattgccccaaattacaaacatgccttgagaagaaagaaaggaccttggggatcctctag

SEQ ID NO: 18690 - DNA, 387 bp, Glycine max
  Peptide Sequence Number=SeqID_110375
atgagtgatggattttgcggtactcatttgcagatcatggttaggactaaaggattaggtcgtgccttaggtcaggtcactggcagaggtgtgggcaaaggagatcgtgatgattctgatgatgctccgcagcgccgacggcctactacatccgcacggaggcagcgagtcgctgtgactgcggatcacgttgatgagtcagtcatccctgcgccagatgttcaggatgacccaatggaggcaccagctgctgtagaggacattcctgcagacacaggcgcagaggctgctgaggatgagcatgagggattttcgggtgatccgagcgacccatccgtgttgaccctatatgcggatcacgttgcttacagcgtatggacgggagag

SEQ ID NO: 18691 - DNA, 320 bp, Glycine max
  Peptide Sequence Number=SeqID_110376
ttcctgtttataatgttgaaaattatttggctaaatgtctcgactctttggttaatcaaagtctgcaggaaattgaaattatcgttgtggacgatggtagcagtgataattctggattgattgcacaggaatatggccagcgctttccggaaagactaaaagtctggaagaaagaaaatggaggtttaagcgatgcccggaattttgccatcgatcgggcgacgggagattatattggttttgtggatagtgatgattatgtcggaaaaaccatgtttgaagaaatgtttaaccttgcggaaaagcataatgccgaaatg

SEQ ID NO: 18692 - DNA, 739 bp, Glycine max
  Peptide Sequence Number=SeqID_110377
atgacggtgaaaacctctgacacatgcagctccggagacggtcacagcttgtctgtaagcggatgccgggagcagacaagcccgtcagggcgcgtcagcgggtgttggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccccatagagtgccgaggcagccgcatctttcagtaccgaaaaaccagcaatatcgtcaggttggagcctggccaaagctgttgtattggattccatcccgtcaatcaggatcaaggggtctttctttccggcaccaaaggtccccacaccgcggataaagaaagaggcattatcatttccgggctcgccacttcgctgataggcaatcagtccagctacccgaccggccagcatggtcgtcaggcgacaaccgtcacttcatccagatttgaacttgatgagggtaccgagctcgaattcgtaatcatggcggtttgcgtattgggcgctcttccgcttcctcgctcactgactcgctgcgctcggtcgttcggctgcggcgagcggtatcagctcactcaaggcggtaatacggttatccacagaatcaggggatacgcagaaagaacat

SEQ ID NO: 18693 - DNA, 507 bp, Glycine max
  Peptide Sequence Number=SeqID_110378
gcgttatcccgtgattctgtggataacgtattaccgcctttgagtgagctgataccgctcgcgcagccgaacgaccgagcgcagcgagtcagtgagcgaggaagcggaagagcgccccaatacgcaaaccgcctctccccgcgcgttggccgattcattaatgcagctggcacgacaggtttcccgactggaaagcgggcagtgagcgcaacgcaattaatagccactgagtctggtgagaggtgctataaaactctttcctccgtggctgagaagaaccactcgtttgactcggccatgaggttgatactcaagtttcaagaggtgagcccttggacaactttcggacacgtggcgtcgaacggcgccatcttggaggccttggaaggggagccaaagctccacatcatcgatctcagcaacacgctgtgcacccagtggccaacgctactcgaagcgttggccacgcgaaacgatgagacacctcatcttaaggggatcctctag

SEQ ID NO: 18694 - DNA, 358 bp, Glycine max
  Peptide Sequence Number=SeqID_110379
atggcatcttcatcatcatcttcatcacatattaacattaagtctggccccatggatgctgatgtattatggatgcaacctaagcatgtttcagaacatgtttggaatggggaacaagatcgaaaattacatataagacaagttgtccccacgtatcaaggggaagaacaaattccagagcaaatttttccttttcttcaacaatctggtttcggctggattatcaagatgggatacttaaaattaaatgcttcattaattagtgctctgatagaaagatggaggccggaaacacatacgtttcacatgagatgcggagagtgtactattactctccatgacgtctctgtattgtcag

SEQ ID NO: 18695 - DNA, 747 bp, Glycine max
  Peptide Sequence Number=SeqID_110380
atgtcattaatcagttcttggggcatccgttggtcctggaggaggggcaacgctacgagttcagtcagaggaggagccaggcctcgaggttcaatgaggaggccatcactcaacaacatcctccccagtgatcataattctgacctccccctgtcaaagtgccagctggtctatgccatcttgacccagatgagtgtttatgtggcccagttgatctcagatgccatatatcaatttgcaaggatcatgcctcctagacacccaatggacccagagaagtccaacagagcactaggatttccgactttgatcatgggcctctgccaattctatggggtgtcggtgactcccaccaagcctatctggcctcccattaacagggtcaggcacagcagcaacaggaggaggaccggcagtagccaaccgcagatgcaccgccatcgcctctacggcagccaccatctttggagtccatctctactcacctgcgaaggatggagctctagatgcatgcatatatgcagcatgtggccgaccaacagcttctaccggtacaccctgcaccagcagagccaggaccccaatcctttcccgtggcctacccccgagcagttcggggccacgattgcttggcctagagataggcccgattttcagacaggggcaggacccgtagggaccctcggagatgaaggaggagcacaggatgatgatgatatggctgatgtgatggactacttcctttga

SEQ ID NO: 18696 - DNA, 285 bp, Glycine max
  Peptide Sequence Number=SeqID_110381
atgaagaacctcaagatcatgcttaagcccaatactgcggaagctcctcaacactgcccactgcaacctctgcacttcttagtggggagactgcctccgatcaaggagaaaagggagaagttggatctcatcaaggagagattaagggtcgttgaagggtttggtgatttctcatttgttgacatggcagagttgtgtttggtgcctgacgttgtcatccctcgaatttcaaggtgccagatttcgataagtgcaaggggactacttgccccaagaaccacctga

SEQ ID NO: 18697 - DNA, 249 bp, Glycine max
  Peptide Sequence Number=SeqID_110382
atgttgtggctggccagtttgaacgtggactattggttggaggttgtcttccggcaagtttcaggaaaaggtagaagggtagtcttcaaattaaaggacttaagccagcaattgctatcttgcactttgtgggatgattattgcttgcagtttttgaagttcttagatgattatgaaggtgatgggccaattacagttctattaagccattgtaggatcaaggaagcgcaggatatatcctcatcttga

SEQ ID NO: 18698 - DNA, 216 bp, Glycine max
  Peptide Sequence Number=SeqID_110383
atgggcagttgttttggtgtctggagctgggcttgggatgttggagaaactccatacgcgcctccggagcttgaggatgacccgacactccccatcattgggtactatcctgctctgatcatcttgacagccgtcatgtcgtgggtgtgggttgtggttgcatgggtgggcatgaaatatttcaagcatgccaatatatcgggtgacgatacataa

SEQ ID NO: 18699 - DNA, 279 bp, Glycine max
  Peptide Sequence Number=SeqID_110384
atgcttagcgtgacaagggaatctagaaaagcacaatgtcgcaatctacccttttgcgggcgagcgaggcgaggctctcgggtacgttttccaaaggaggaaaaatgtgcggagacaccaccagcatttatttgtggaaaacatcggaaaaaccgaaggaaaccggtcataaagaatattccagattcgggagttgtatttacgtttgaggaaggtcgacaaaagcggggctcttgctcctacgtaccctccatcgaagaggaaatcagacctacgtag

SEQ ID NO: 18700 - DNA, 330 bp, Glycine max
  Peptide Sequence Number=SeqID_110385
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttggtgatgtgctagtaatgaagcttgggcagtatgattggaatccctccaagggggtaccgagctcgaattcgtaa

SEQ ID NO: 18701 - DNA, 407 bp, Glycine max
  Peptide Sequence Number=SeqID_110386
atgagtgaaatagaggaggtgcaagagcagatgaaggctgacctggaggccatgaaagagcaaatgaccgcaatgatggaagccatgatgagtatgagaagaatgatggaggtaaacatggctatagtcgttgccgcaagtaccgccactaaggtggacctaactcatccatttggcctcaatcaagtaaatcgtccagtctcggatatggtaggtcagggaggcgaagcattgggaagtatgggtggcctccattttgtgcaggtccagagcaagcattccttcccaccatatggcttgcctcctaactatacaccacccaatgttacacacgctcttaatgagaatgtcgatactctgttcccatacccattgagagctaacatccccactctggtcatgcacag

SEQ ID NO: 18702 - DNA, 492 bp, Glycine max
  Peptide Sequence Number=SeqID_110387
atggtttcctgcggtcatacagctggggggcttctctgtgtcaggaataacaataacttccaggttgatattaaaatagctgaaaggggtttcatcatgttggagggggtatggctggtagaaagtcagagggtagtggtggctaatatctatgcttcttgtgagctagaaagcaaaagacagttatggcagaggctatatttaatgaagaatcagtcccaggttcagtgctggtgccttgtaggggacttcaactgcattaaacacccagctgaaagaatgggaagcactctttgtaatgcagacactaatcttatagctgaatttaatgagtggctcgctgaaatggaggtagatgatattccttgcttgggcaagccctttacttgggttaggcctaatggttcttgtggtgagggactgctgggatcctctagagtcgacctgcaggcatgcaagcttggcactggccgtcgtttttacacgtcgtga

SEQ ID NO: 18703 - DNA, 513 bp, Glycine max
  Peptide Sequence Number=SeqID_110388
atggcacaacctccaccccgtgagaggactctaagggaaatggttgcacctgatttcacctacgaaagcttgtgcatccaataccctgatgaggatgtcccatatgttcttaaaactggactgattcatttgcttccaaagtttcatggccttgcagagggagtggcaaaggactggttgtattaccttgctccatggtcctttgctaaccaccatacagacctttgcccttccatgcaacaacctagagcaattgagcagcccgaagcttatgctgaaaatatttacaatagacctcctcaacctcagcagcaaaatcaaccacagcagaacaattatgacctctctagcaatagatacaaccctggatggaggaatcaccctaatctcagatggtctagccctcagcaacaacaacagcagcctactccttccttccaaaatgctgctggcccaagcagaccatacattcctccaccaatcccacaacagcaacagccccagaaacagcca

SEQ ID NO: 18704 - DNA, 312 bp, Glycine max
  Peptide Sequence Number=SeqID_110389
atggtcatctgccccttttgtcgaagacttagtgtctttcgtctgagactattacagtctcccgttgctatccaaagacaatcaagtctgatggcacgcagagacaaatatggtcatctgccccttttgtcgaagactcaatatctttcgaccgagactattgcagtctccatttgctattcagagacaatcgagtttgataatatgcagagacaaatatggtcatctaccccctttgtcgaagacttgatgtcttttgaccgagactattgcagtctctctttaccatcaagagacaagcaagtccgatag

SEQ ID NO: 18705 - DNA, 708 bp, Glycine max
  Peptide Sequence Number=SeqID_110390
atgacacgtagagaccaatatggtcatctgcttcctttgtcgaagactcaatgtctaacgaccgagactactttagtctcccttcgtcatctagagacggcaagtctgatgacacgtagagatcaatatggccatctgctccctttgtcaaaaacaggacgtctatcgaccgagactactttagtctctccttttcttcatccagagacaatcaagttcgatggcacgcagagacatttcatgattatccgcacctttgttatccagagacaatcaagtccgatagcacgtagagacaactcatggtcattcaccaccttcgacatccagaggctagcgagcacattgacacgtaaagaccaatatggtcaaatgcaccctttcgtcgaagattcaacgtctattgatagagactactttagtctcacctcatcatccagagacaatcaagtccgatggcacgcggagacaaatcatggtcatccacacccttttcctcatccagagacaatcaagtccgatggcacgtggagacatttcatggttatctgcacctttggtatccagagacaatcgagtccaataacacatggagacaactcatggtcattcgccaccttcgtcatccagaggcaagcgagcctgttgacatgcagttcaatatggtcatctacaccctttcgtcgaagattcaacgtctatcgatag

SEQ ID NO: 18706 - DNA, 270 bp, Glycine max
  Peptide Sequence Number=SeqID_110391
atgttccttgtattcaatagtgctttgaaaggacttgatgatactccacaacctaaatctaaggctgctgcaaggtggattgttgttaagtgtaatagacagaaaggaagcactgagtgtggctattacgtcatgcactggatgtccattataattttaggaagtttcaggaataattgggaaacgtattttaatgatgttagaccattggaagcagagagattgaaggcacttcgcatccagtgggcacagtattatctcaaagtttga

SEQ ID NO: 18707 - DNA, 635 bp, Glycine max
  Peptide Sequence Number=SeqID_110392
cccagcttggagcgaacgactacaccgaactgagatactacagcgtgagctatgagaaagcgccacgcttcccgaagggagaaaggcggacagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgacggataacaatttcacacaggaaacagctatgaccatgattacgaattcgagctcggtaccctgtttctgttatgaccatgttgccggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18708 - DNA, 162 bp, Glycine max
  Peptide Sequence Number=SeqID_110393
atgaagaacggtggaaaatcttcacgaaatcgcccacggaagcgttacggaagggaaaagagggaggtggttgccgcccagctcgcccaggcgagctgggttgcttccaccaaaaggcaccaacttctgttggaagatcctggaaggcccaagtggtcctga

SEQ ID NO: 18709 - DNA, 498 bp, Glycine max
  Peptide Sequence Number=SeqID_110394
atgttctttcgtgcgttatccctgattctgtggataaccgtattaccgcctttgagtgagctgataccgctcgccgcagccgaacgaccgagcgcagcgagaaacagctatgaccatgattacgaattcgagctcggtacccttgctgtcgcaaagggcgatgaagcacgtgtagatggaggcattggctttgtatgcgagttgctgggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 18710 - DNA, 733 bp, Glycine max
  Peptide Sequence Number=SeqID_110395
aaggaaggaagaatcaagattctatcttcatgcgaaggatgtccaaatgttcccttgatgggaacaaggggttgtattaattataatcccgttctcgccataagacagcttggctaccccatgagaggagcgccattagacgaaagcatcacgcctttcaccgcacggggttttagtgaccacaacgcgagggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagtccgagtagtcgaagagaagttcaagtccatagccatcaaagtcagcaatagtaagcttcaagctctcgaagagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgctagccaaggccaaagcaatggcggacacctactccgcccccaagaagatccacggacttctcagctatt

SEQ ID NO: 18711 - DNA, 255 bp, Glycine max
  Peptide Sequence Number=SeqID_110396
atgattatgaggggccaagacatttatagtagccaagatgaggctactatttcaccttcctctagtgaaagtgaagaagcaaaaggggaagaatctagtgaagaaatctacccccgagaaaaaggacaaccattagtggctaaagagaagtgtaaggagacacatgctagcattgccacacctcttgggcttgagtttattcctcaagtaaggaagtttttggatgagggtttggtttccaagtccctaaaatag

SEQ ID NO: 18712 - DNA, 777 bp, Glycine max
  Peptide Sequence Number=SeqID_110397
atggggacgaatcaaaacagcaaaaggttttatcaagtcaaggttaaaagtctagatgtcaccagcctcaaggaattgggacgattgatgggacctctccaaaagcaagccttccgcaaggtgtacggaaagattctagatttgaccgtggcggaggtatttacggaagctgtcgtatccctcgcccaatactatgaccagccgttgaggtgcttcacgtttggggacttccaaatgttaccgacttttgaagagtttgaggagatactaggatgccctcttggggggagaaaaccgtatcttttcttcgggtttcttccctccttgagcaagattgcagctgtagtcggggattcggcaagagaggatatggcgagccaagagaagtggggcccgtttgcagatatactagctttgttgatttttggggttgtcctctttccgaacgtggacagtttggtggacttagccgcgattgatgctttcctcgcatatcaccatagcaaggagagtccagtggtggctatcttggcggatttgtttgacacctttgaccggagcgcaatcaattggtttcctcgatggaaggaaggcaaggagggagttcttttctcgtgtgggaactaccctaatgttccgttgatagggactaggagttgtattaattataatcccgcactcgccataagacagctagggtaccccatgagggaagcgccaacggaagggagtctctcacctttccttgtgaaagatttagacgcgcaaggtctcaag

SEQ ID NO: 18713 - DNA, 174 bp, Glycine max
  Peptide Sequence Number=SeqID_110398
atgggatcttcgttagcgatgggatattcatttcggtttgatgtttgtgtttgttgtgagggtggcgtaaagggggatgaaggatggttttgttggtcaaaggaggtggtagttgtagttgtggacatgagggttgtggagataatggttgtggttgaggaatacggtcaataa

SEQ ID NO: 18714 - DNA, 198 bp, Glycine max
  Peptide Sequence Number=SeqID_110399
atgtctcgggcttcatcctcctcagcttttgttttaccgaggaacactcaggatttagagttcctaagtctactagttccgtctcttcttgataaggccccatctcttggtccttatggacgactatcttctccaactccgggggaagtcccacatcttcgtcgtcttcactctccgtctgatccgttttttgcttga

SEQ ID NO: 18715 - DNA, 114 bp, Glycine max
  Peptide Sequence Number=SeqID_110400
atggcttcctatggtgacctcaagaagcaaaggaatccattgatgaagaagattcaaggcctacaagctccacacgaagctacatcatgtggtatcaagagcatcttcatctag

SEQ ID NO: 18716 - DNA, 267 bp, Glycine max
  Peptide Sequence Number=SeqID_110401
tttgtggatgatgtgatgagggatctttatgaggaagggttcatgccaaattattattggtggacaaaccacagtgaagagttaccacaatttcctccaatagtgtttcaaggttcatactacgaaagtggtgggcaaaggaaagaattgaatccttacgagcaaatgatcatagatcatgttggaccatcaattggccaatacatagaacaagagtgtgtaattgagacaaaatgcatggaggaaaatcctaatcctgaagcttaa

SEQ ID NO: 18717 - DNA, 599 bp, Glycine max
  Peptide Sequence Number=SeqID_110402
atgacgtttggcacggcgcgcgagcagctgcgtgacgatctgcgcgcacagggtttcgacctgcagctgatcggccgggcgtcgaagaccaaaatcatgctcgaccaggattatgttgacgaagtgctgccggtcgccggccgcgacatgatctaccgccaggtggaaaacagctttactcagcccaacgcggccatgaacgtgcagatgctggaatgggcgctggcggtgaccgccggttccaaaggcgatttgctggagctgtattgcggcaacggcaacttctcgctggcgctggcgcgcaatttcgagcgcgtgctggcgaccgagattgccaaaccgtcggtggcggcggcgcagtacaacatcgccgccaaccatatcgacaacgtgcagatcattcgcatggcggcggaagacttcacccaggcgatgaacggggtgcgcgaattcaaccgattgaaaggcatcgatctgagcggctacaactgcgagacgattttcgtcgatccgccgcgcagcgggctggacgaggaaacggtgaagatggtgcaggcctacccgcgcattctctatatctcatgcaatccggaaacgct

SEQ ID NO: 18718 - DNA, 138 bp, Glycine max
  Peptide Sequence Number=SeqID_110403
atggagatgcagtggaagacaaaggaaaagaggaagggaccagtcactagaaccataagcaagagactccaagaagattgggctagagctgctgaagaaggccctagggttctcatgaacctcagggtagatttctga

SEQ ID NO: 18719 - DNA, 652 bp, Glycine max
  Peptide Sequence Number=SeqID_110404
atggcgagaatagccaaggtagtcaaaatcttagtgcaagaattggaccgagtaaagcaaaatagaaatggggtagttagaatactgaggaagcacttggaggagaaagcgaagactttggaggatcaaggtgaatgggcttcattctttgatgtcttggaactattagtatttggagtcttcctctttccaaatgtggatgggctggtggatctagtagcgatcgacgccttccttgcttatcaccatagcaaagaaagcatggtcattgctgttttggccgatgcctatgacacatttgaccgaaggtgcgagaagagtggtgcaaggattgtttgttgcatgcccgctctttatgtatggttggtatcacacctctttcggcatgaaagtagacccgtctgtcccctacaaggtcactgtgtgtgtgctgagagagggaaggcaaattgggagcaactcttggctagtatggtaggggcatccattaattggttccccagatggaaggaaggaagagctggggttttgtcctcatgtgaggggttctccaacgtccccttgatgggaacaaggggttgtatcaattataatcctgtccttgccataagacaacttggataccccatgagaggagcgccgtcagaagaaa

SEQ ID NO: 18720 - DNA, 539 bp, Glycine max
  Peptide Sequence Number=SeqID_110405
atggtagaatcatacaagaagcgaaaaggatcttcctccaccaccgctgctgctggccatcgccgccaaggaacctctagagacacaaccgcaccaattcctccatccatttcatctcctcgatcatctacattattttcttcagatgatcaacgtcaaaggtattattctcaattttgcaatagagtcattctagaccctaagtaccttgaccttgaattttttgatggcgaaacatttgattgttaccaagtgtttcaaaattctgctttgactgattttatgtctttggaactgccttactttcctgaattagttaaggtcttctataataacttgaaaattcaggatggtattatttactctgaggtgcataatattcccattattattgatcaatccttgttcttttccttgacaaaactgcccaatcaagttgttccttttgagggcacccttgttgatgactggaaatttgattattctagtcatgatgctcgccgcatggtctgcaatgaccaggctgatatgaccgacag

SEQ ID NO: 18721 - DNA, 504 bp, Glycine max
  Peptide Sequence Number=SeqID_110406
gtaactgcttcagcagagcgcagataccaaatactgtcttctagtgtagccgtagttaggccaccacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacggggatcctctag

SEQ ID NO: 18722 - DNA, 853 bp, Glycine max
  Peptide Sequence Number=SeqID_110407
atggagaggagtatgattgatgctcccagtggtggagctcttggtgatatgacccctgttgaggctaggaatttgattgagaagatggcttccaactcccaacaattcagtgcaagaaatgatggtattgtccttagaggagtccatgagcaatctggagtcaatgagcaacctgaagcttatgctgcaaacatttataatagaccccctcagcagcaaaaccaacaacagcagaataattatgatctttcaagcaacacatacaatccagcttggagaaatcatccaaatctgagatggacaagtcctccacaacaacaacagcatgttccttcttttcagaatgctattggtccaagcaagctgtatgttcctcctccaatacaacaacaacagtcacaacaaagacaacaagcaactgaggctcctcctcaaccttccatagaagagttaatgaaccaagctcagtcccaaaattctaaaaaattgccttcacaaactgtgcagaatccgaaaaatgtgagtgccatcagcttgaggtatggcaaccaaattcaagtgcctccaccagtatcagcacctgcaactgaacctgtcaagcttcattctacacctgaaaaagaggatgagatagttgcacaaaagggaaagcttcctaacaaaaattttcatgcaggtggaccttcttctagtaattctgacttatcgaaagtagaggggaacatacctctactagatgccatcaagcagattccaagatatgccaagtttctaaaggagctgtgcacccacaaaaggaagctcaaaggcaatgaaaggattagcatgggcaaaaatgtgtcagtattgatag

SEQ ID NO: 18723 - DNA, 354 bp, Glycine max
  Peptide Sequence Number=SeqID_110408
atggatttcattttgtctggatttttaacctttgtaacattctgtggctatttttgttgttgcattactaccaaggaacttgggactgttatgaggtcacttggtcaaaacccaactgaggcagaactgcaggatatgataaacgaggttgatgctgatggcaacggaaccatcgatttcccagagttcctcaacctgatggctcgcaagatgaaagacgccgactcagaggaggagcttaaggaggctttccgtgtgtttgacagggatcagaatggtttcatctctgcagctgagctccgccatgtcatgagcaaatcttggggagaagctgacggacgaggaggtggatga

SEQ ID NO: 18724 - DNA, 300 bp, Glycine max
  Peptide Sequence Number=SeqID_110409
atggaatttggagatggaacgtgtattgtactgagagataaaaggaatttgtgcaacaagggtgacagaggttggaaaaggtcagcattgaatgctgcagccacaatgttgtctacaagcttcaatgttaatgtcacatcagataatgtcaagaactgtatcaaattatggagattgtggtatggtattgtaagtgacatccttgatcagagtgggtttgattgggatggcactaagcacacgatcacaattgagaatgaaaatgcttggaatcaatattgcactgtaattattctttaa

SEQ ID NO: 18725 - DNA, 156 bp, Glycine max
  Peptide Sequence Number=SeqID_110410
atggacacctgtctccgtgtgattggtgatcccatgaatggagttcaatgggtaacaacgaaattgggtgggggtcataacccactctttgaggattcacctagtgagtgtggttgtgggaccgccactgtgagatatggactaatctctaagtga

SEQ ID NO: 18726 - DNA, 354 bp, Glycine max
  Peptide Sequence Number=SeqID_110411
atggtttggaaagctgatcctagtggtttttattccactaagtcagcatatagtctattgatgactttcaacagacctgttcctcagaggaggattttgcagactattgaagcatgcaatgcacacaaaaaattctctatagagactaaatggggcactatgatgggcagctatcctttttcagaagaacaaccaattccggttggatgggaggaaattctaatagaagttgctgcagagatcctagctgatccatcattttcacggcaagaaacttctctttctatgttatgttctataagggagaatgagaagctaataacatcttattatttgggttctgaatacaactaa

SEQ ID NO: 18727 - DNA, 267 bp, Glycine max
  Peptide Sequence Number=SeqID_110412
atggcaggatggtttttggttatgccttcccagcctatgaatgctataaagcagttgaaaagaataggccagaaattgaacaacttcgcttttggtgccagtactggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18728 - DNA, 414 bp, Glycine max
  Peptide Sequence Number=SeqID_110413
atggttgctggaaatagaacattagaaaagcctagggaagattggagtgaggaagaaagaagactagtacaatacaacttaaaagccaaaaacataattacatccgccctaggaatggatgaatactttaaggtatcaaactgtaaaagtgcaaaggatatgtgggataccctacaagaacacaaaatggaattgtcgcaacctacccttttgcgggcgagcgaggcgaggctcacgggtgcgtcttccaaaggaggaaaatgcgcggagtcgccaccaacgtttatttgtggaaaacgtcggaaaaaccgaaggaaaccggtcataaagaatattccagatttgggagttgtatttacatttgaggaaggtattagcacctctcacgtttgtcccaaaggacaacagccttaa

SEQ ID NO: 18729 - DNA, 362 bp, Glycine max
  Peptide Sequence Number=SeqID_110414
accatgtatgggggctgacgcctgcccagtgccggaaggtcaaggaagttggtgacctgatgacaggggagccgacgaccgaagccccggtgaacggcggccgtaactataacggtcctaagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaagttactctagggataacaggctga

SEQ ID NO: 18730 - DNA, 528 bp, Glycine max
  Peptide Sequence Number=SeqID_110415
atggcttccatgatggatgccatgctaggaatgaggcaactaatggagaaaaatgcggccaccgctgccgctgttagttcggctgtcgaagaagacccaactctcccagctattgcgcaccaccctatcccaaacgtggtaggacaggaaagaagcacactagggcacatcagcaacccccatctgggatacaaccaagtggcttacccttatggattgccacctaattacataccaccagtcatacgtgatgacgcagatcatgtccctccccccatccttgaaggggagcctcttcaacagtcggacgaggtccacgaggatcgtcgagagcatgctgtcgcaacgtgcccttttgcgggcgggcgacgcgtgactcgcgggaagcgtgttccacgaaaggaatacgcgcggagtcgccaccaacgtttatttgaggaaaacgtcggaaaaaccggaaaagatgtgatctacgaacttttaagtgaaaggctcgggagttgtatttacgcacggggaaggtattag

SEQ ID NO: 18731 - DNA, 324 bp, Glycine max
  Peptide Sequence Number=SeqID_110416
atgtgcatgatgaggttgtcagctttcaatgagtatgggagcggagttattgacatcttcattgggaatgtatgccacattgggtggtgtatagttgggaggccagatgggggcatcgggttcaccttagcaatagcgctggtagcggcaactgtaaccgcattggctttcattattttcttcatgctcatcatggcctccatcattgtggtcatttgctctttcatggcctccatgtcggccttcctctactcttgcacctcctctacttcacccattactctagttctagcacgagttcgtaagggcgtcgaagatgcatga

SEQ ID NO: 18732 - DNA, 659 bp, Glycine max
  Peptide Sequence Number=SeqID_110417
aatcgtttgaggagcaagccacacagggatcgttcgtcccccatggacgtcaaggatgtctcgccgctactattggacgtctagagcaccctggacgtgtccgtgctgttggagccggtgtcaccatcaagcaatactttggatcagctccacggacgtcccgcagcgcttcctccctacctcttgacgaattacagcagctgacccagcagatcagggaccagctagaggagtccatcacagagaaagtgatgaggcaggtcatggcatccttcaaccagcttcagtcacagatgcaatctcagggacttgcagtgcctcctgagcctctggttggtccctccggtcctcgagtgagcacaaaggggagttgtgttgatccctcaagaaatgatcctgagacgggtgactctgacaagtgcggcttgtacatagaagcagatcctgtccgcctggttgccatgggcagagtttatgagggatccactgttgttcatgacactcctttattgcctggccaagtaaagatgagtgtggaggaggttacagatgcagatgctccagttcatgtacccactgatgaggtttccttagtggggcagacacttcacaccttccttgcttcgctgacacatctggtcaagtctttatcacaacag

SEQ ID NO: 18733 - DNA, 336 bp, Glycine max
  Peptide Sequence Number=SeqID_110418
atgatgtttgtctttacctttgctggtattaagctagacaaatcaattaatgaaactagaggacctcctacaattagaattcagggtcaaccatgtcatcgaataggcagcttattaccaatgcctggaaaacaaccgaaatttgcacaattatatatctttgatatgcagaatgaagttgaaaatagaattaatacgacgagccaacatgctgcaattcaaccacacattgtttcaactttaagtcaaatgatggatgaccacaatttccatgcaaaaagttttagaatggccagggacagattgacagatagtcaactagataatgtaaattga

SEQ ID NO: 18734 - DNA, 150 bp, Glycine max
  Peptide Sequence Number=SeqID_110419
atgagaaagcgcacgcttcccgaagggagaaaggcggacagtatccggggggcggagcctatggaaaaacgccagcaacgcggcctttttacggttcctggccttttgctggccttttgctcacatgttctttcctgcgttatcccctga

SEQ ID NO: 18735 - DNA, 405 bp, Glycine max
  Peptide Sequence Number=SeqID_110420
ggaattgctcttaaagctttatctttaatccaagaagaaagtgataaggaaggcttaattgatttggatgaagatgatgatcttagcctttttgtaaaaaggttcaacaagttcctaagaattagaggaaatcaaaggagaccaaattttaaacctaaaagaaggacagaagattcatcctttgctccaaaatgctatgaatgcaatcaacctggacatctgagggttgattgcccgatcatcaagaaaagaatggaaaaatttgaaaagaaaaattttagtgaaaagaaggtgaagaaggcctacatcacatgggattacaatgatatggaatcatttgaggattcagaaaatgaagagataaacctgtgtctaatggctaaaagttatgaaagtgatgaagag

SEQ ID NO: 18736 - DNA, 237 bp, Glycine max
  Peptide Sequence Number=SeqID_110421
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggtgatggacatggaagaagactctgaaatgccccttattttgggaagaaccttcatgaacacgaccaagattttggttaacgtgtatgatgataagtaa

SEQ ID NO: 18737 - DNA, 318 bp, Glycine max
  Peptide Sequence Number=SeqID_110422
atggcatcttcatcgtcatcttcatcaagtatacaaattaagtctgatccaatagatggagatgttttatggatggaatctaaacatgtttcagaacatgtttggaatgaggaactagacagaaaatttgcacatccaacgagctgtcccgatttatcaaggtcaagaagaaataccagaggaaattattcctctgcttcgacaatcaggatggaggcccgaaacccatacatttcacatgagatgcagagagagtgtacgattactcttcaagacgtctccgtattattaggtctgcgtgttgatgggcaccattaa

SEQ ID NO: 18738 - DNA, 1797 bp, Glycine max
  Peptide Sequence Number=SeqID_110423
atggagactaataatgcatgtactatgcattctcattgcatagagatgtccatggaagtgcaccaagttgtgccaccacctcacaagagcacccttcagaaactcaagggtaggctcaaggaaactttcttccctgatgatcctctgcgccaattcaagggacaacctcttaagagaaaactgatccttggagctcaatatgtgttccctattctccaatggggtcctaagtataatctcaaactcttcaaatctgaccttgtttctggcctcactattgctagcttggccatcccgcagggaattagttatgctaagcttgcaagtcttcctccaattgttggactttattctagttttgttccaccacttgtctatgctgttcttggaagctcaaaggaccttgcagttggacctgtttctattgcttctcttgtgatgggatccatgttgcatcaggaagtgtctcccacaacagatccaattctgtttcttcagctagctttcacttcaacattatttgccggtctctttcaagctttgcttggaatcctaaggctaggcttcataattgattttctatctaaggccattcttattgggttcatggctggagctgctattattgtctcactgcaacagctcaagagcctgcttggaatcacacatttcactaatcagatgggtctgattcctgttatgacttctgtttttcacaatatacatgaggaaggtattgcagtaggaaggacatttgcagctctcaaaaactacaaagtggatggaaataaggaaatgatggcaattgggtttatgaatgttgttggctccttcacttcctgctatgttacaacaggtgctttctctcggtcagcagttaacaacaatgcaggcgcaaaaacagctgtgtcaaatgtagtgatgtctgtgacagtcatggtgacactcctttttctcatgccattgtttcaatacacgcctaatgtcgtgctgggcgcaatcatagtcacagcagtaattggcctcatcgatctccccgctgcttgtaacatttggaagatcgacaaattcgattttgttgtgatgatgactgctttcttaggtgttcttttcatctctgtccaaggaggccttgctcttgctggactgagtaccaagagatttagctcagttggtatttggttaagcagggatggcaatgctattgatcaggttggattatcaactttgaagatactcttgcaaattacgagaccgaaaacagtgatgttggggaagataccaggaacagacatatatagaaatcttgatcaatacaaggaagctgtgagaatacctggatttcttattttaagcattgaggctcccatcaattttgccaacatcacatatctcaacgagagaacgttaagatggattgaagaagaagaagacaacataaaggaacaattaagccttcgattcttagtattggaaatgtcagctgtgagtgctgttgacacaagtggaatctcacttttcaaggagttgaaagcaacactggaaaagaaaggtgttgaggcaagaaagctaaactctgacatacttttactttacacatcttggtatcttgtgttggtcaatcctcttgctgaggtcatagaaaagcttaaaaaagcagatgaagctaatgatttcataagagcagataaccttttcttgacagttggagaggctgtagcttcactttcttcagcaatgaaaggccaatcatcaaccattacagaaggggcacacacaattgtgtcacataattga

SEQ ID NO: 18739 - DNA, 603 bp, Glycine max
  Peptide Sequence Number=SeqID_110424
atggaggcaactctatcccatggctttgagactgatgatcctgtccctattgaaccagaagttagttacatgtgtgacacagaagcgtggataacaactttccaccaggtcgtgatgccaacattgagtgttcgcccgggactagtcaaagggctagtgcccagccagcttacgttgcactggggctgcagagcgttgtgggatattaggatccacttggaagggaggttacttttcaactcactaaatatcaaagcttctcaagttggcatcagagcgggttctgccgtccgccgccaccgcccgccgctgtcgccgccgtcatcttctccggcgagaccagggttaggatcaccggaaaagcgcgaccaaaaccctgcaaaacgcgccgtcatcggagcttccacgcgcctccacgcgcggttacaacttcgtgtctcttccggcgcgtgtagttcacgcgccgccgtgccgtcatcggaatcttgttcgagttgctccagcagcctcgtcggcacctcgtggctgcattccaagtggtggttttctgttttgacaagcttgtgtggtagcttgtgcttagttctaccctttttccgttag

SEQ ID NO: 18740 - DNA, 399 bp, Glycine max
  Peptide Sequence Number=SeqID_110425
atgagcattccgttacgcttatatgctaactatttgagcttcactagcttgactttcagtaccagccttgactggactaatattggccgcttgcattgtttattgccatggtgggaagacgctacggttgattttatgactagtggtggttataatgttgcctcccagatagaaaaggtaaagcagaaaactctcatcatttggggagagaatgatcgcataatcagcaataagcttgcagtgcgactgcattgtgaattagctgatgccattatacgccaaatacccgattgtggtcaccttcctcatgttgaaagaccagattctgttgtcaaattcattgttgaatttgttcagagcaaaaccaacacagaaaaggaatgtgtttcacccgtatga

SEQ ID NO: 18741 - DNA, 312 bp, Glycine max
  Peptide Sequence Number=SeqID_110426
atggacattggtatcaaccttgggctcaatgttcctcaagatgagcctattacacaacatgatgatttctcaattatttcatggaatattaagggagctattggatgcaccaccaagtgtcatttctggaagtctccagattactcacctatgttcattcaaaaagctataggccactctagaggaatatgggtcctctctaacaggaatgacatcactttcacacttgttgattccatgcctcaatgtatctcattttctgccaataagcttaattcgcagtgggttgctcgaccatctatgtctttctaa

SEQ ID NO: 18742 - DNA, 1791 bp, Glycine max
  Peptide Sequence Number=SeqID_110427
atgagaagctcgtggttgaagaaacagtccttcgtcatcggccataagccgccactgaactggttgatcctgttcctgataagcctcctcgctctgattgcagttttgagttcttcttcttcgcctttgtcgtcgtcgaagaagaattcatcgcgtcgcaccaccgtggaatcgctaatctacacgagctacaggaggatagaggagcaggccgcggtggattacttggagctgagggctgtatcgagcgccggcggcgcgcggcagaaggaggtgggactctgccgcaaggagagggagaatttcgtgccgtgccacaacgtgtctgcgaatttggttgcggggtttaaagacggtgaggagtttgatcggcattgtgaggtgtataagggaacagagaagtgtttggttcggcctccgaaggaatacaaggctcccttacagtggccggctgggagagacgttatatggagtggaaacgtgaagatcaccaaagatcagtttctttcgtctggaagtatgaccaaaaggttgatgctactagaagagaatcagattgcctttcacgcggaggatggtacgatcttcaacagcgtgaaagattatactcgccaacttgcagagatgatagggttaggaagtgacactgagcttcctcaagctggtattcgaaatatactagatattaattgtggatttggtagctttggagctcatttattgtcgctgaaaataatggcggtttgtattgcggcatatgaagcaactggcagccaagttcaactatctctggagagaggtcttcctgctatgattggcaactttatctcaagacagcttccatatccatcattatcttatgacatggttcactgtgctcagtgcggcattatgtgggatgaaaaaaatggaatgttccttgtagaagttgatcgtgttcttaaacctggaggatattttgttttaacctcacctacaagcaggccacagggttcatcacgggagaaaaagagaatcatggcaaacccaatagaagggctgacccagcaactctgctggactcttctagctcagcaagatgaaactttcatctggcagaagactgctgatattgattgttatgcatctcgtaagctgcctactatacaagtatgtaaagcagatgatactcagtcatactatcggcctcttttgccatgtataagagttcagcctgaagaattttatgaagacttccaatattggagatcagctgttaacaattattggtcattacttacaccactaattttctctgaccatccaaagagacctggagatgaagatccattgcctccatataacatgatccggaatgttatggacatgagtgctaattttgggggtttgaatgctgcgctgctggaggagaaaaaaacagtgtgggtcatgaatgttgttcctgcaagggcttctaatgcacttcctcttatactagatagaggttttgctggtgtcacacatgactggtgtgaacctttccctacctaccccagaacatatgatatgcttcatgcatacggacttatctcacatctctcctcggagaggtgtagtatggtagacttattcctggaaatggatagaatactgcgtccagagggatgggtcattctttctgatacaataggagctatagagatggctcgcatgcttgcagcacaagtacgttgggatgcaaggataattgatcttcagaatggcagtgaccagcgactacttgtttgccagaaaccatttgtgaaaaaataa

SEQ ID NO: 18743 - DNA, 210 bp, Glycine max
  Peptide Sequence Number=SeqID_110428
atggaatcacaatttatcaccacaagtatagcacagatggattatcaatacgtgttacacggtcatggttacttgtcacatcgtgggacttcaacgcacctctctttacctaagaatgatcaccgtcaaagttttccaacacactctctcatactcaaagcatatcctacttggagcccaacaaacacaagagacccactaataatctaa

SEQ ID NO: 18744 - DNA, 262 bp, Glycine max
  Peptide Sequence Number=SeqID_110429
atggttattcaaaaggaaagaaggtgttgaaggagttcaaagtgcaaggttcaaagctaggctagtagctcgtgtgtttactcaaaaggaagggataaaagatcttggacatggtaagaagatcattggtatagaaatacctaggaataggaaggaaaaagtgttgtacctatctcaggtagatttacctcagaaaggtcttggaaagattcaatttaaagggagcaaagccagttaccacttccctagcacaacactttaa

SEQ ID NO: 18745 - DNA, 891 bp, Glycine max
  Peptide Sequence Number=SeqID_110430
atgtctcgcaaggaaaacataatctttgagttgcataccaagaaagggacttggaagatagtagtacgaatcaatgatatgtggcatgttaacaagcacaatggtagaaaagcaatagaaatggtgttcatggaccaaatgggtgcaaagattggtgctactttttcacgggaactgtttgttgaatttgagtcaaggttgcattgtggttctgcatatgtcattcagaacattaaggttgttgagaatcattctgaatacaaagaggccgagcatcctgagattcttcctggtgtctatgttattacttcatttactgatattattgttgagggggcaccacgtgacactttagttgtcattaagtgtaaaacaattaatcctacatacaaagttacagtcaagttgagggataacagctatgacagttgtgccaactgtactaccacatttgatccattgaaattaggttccacttgccgttcgtgccacaaccaagtcacttacacggttccaagtggtgatgaggtcaaggttttccctccttgtgttgatgaattattgagaaagacttgggcgctcaggttcaagtactctgtacaaattcgtcaatcatttgtcttggatgttactgaagacgaagatattattcacactatcaggtcaacaattagtctacaggatgaaccaagtatagagaagggtaaagatgttgttgctgaaacatcatcattggatttccatcctacgctcggcatgatgcaagcttcattggagcttgtaggcctaggatcttcttcatcaatggattcctttgcttcttggaagatgaattgcagcggaatgaagaaaggaagagagagaggagacgccacttcaaggagaagatga

SEQ ID NO: 18746 - DNA, 333 bp, Glycine max
  Peptide Sequence Number=SeqID_110431
atgaatttccggaagtacttcttccggaagttgatgattcaaattccggaagaagtggttccggaagtgtcttccgaaaccacttcttccggaattgcacatactaacttccggaagaacttcttccggaatggtactttggttgattgtccgtccgaacaccagttcgctgagtcacttcagaagtttcaaattgcttgttcgccttggccgatgttcgttgactatgttaaggacacatggattatccctcacaaggaaaaatttattacagcatggacgaataagggttatatcagctcattgggctctaaaaagagtactacaaaatag

SEQ ID NO: 18747 - DNA, 816 bp, Glycine max
  Peptide Sequence Number=SeqID_110432
atgagtgatggattttgcggtactcatttgcagatcatggttgggaccagaagattaggtcgtgccttaggtcaggtcactcgcagaggtgtgggcagaggagatcatgatgattccgatgatgctccacagcgtcgacgacctactgcatccgcacggaggcagcgagtcgctgcgactgcggatcacgtcgatgacctagtcatccctgacctagatgttcaggatgacccgatggaggcaccagctgctgtggaggacattcctgcggacgcaggcgcactgaggatcagcctcagggatttccgggtggagcgtcctgaattgaagttatcctcgcatgggaggaaggtccatagtttaggcaggcctacccctgccattgagggacttatcgctggtacaggactaagtcctctgatcgcgtgttcggtagacaccggcgatcagggacttttgtccgcgtttgtggagcggtggcaccgggagacatctagtttccatctcccggtgcgtgagctcaccatcacattggacgacgtctcctctcttctccatcttcccgttataggcgactttcacgcatttgagcccttgcacgtggatgatgcggttcagatgctggtggacttgttgatgatgtctccagagtctactagggctgagacatatatcagcgctgatgccaagcaggtcattggacagctgcggctcgtgcatatcttcttcacctgctgggttgcactctgtttgctaacaagagtgcaaccaatgtccatgttgtctacttggaggcccttcgtgacctcagtatga

SEQ ID NO: 18748 - DNA, 1365 bp, Glycine max
  Peptide Sequence Number=SeqID_110433
atgtggcatgttaacaagcacaatggtagacaagccattgacatggtgttgatggaccatacggtaatttccatgttcttcagtttcagtggttttgggtgcaaagattggcgcaactctatggaggttgacagacctgagattcctcctaatgtccatgtcattactgcatttgctgatatcatttctggcgtggcaccccgtgatacgttagttgatgttgtcggtgttgtcgctgaagttattgaacgtaaaacagttaatcctgcatacagagtgactatgaagttgagagataacagtgatgctgagatcatcatgactgtgtgggaggaatatgttgttcaacttgatgatgctatcgagaaaaaccattttgttcggaagccattggtccttatgttaacttttgctaagatcaaagaacccaaagacaagtatcccctcagtgtacaaaatatcaagcatgggtccaagttgtatgtcaacactgacatggcagaaatccaacaattccgtgataggttacgtgtgccattttatgctggcggagtaacagatgaaggaaccatttctcagtcccaatctaaccaacattcccaacgaaactcagcagaaaagtttttgcataatgcccaaatggtgagctttggtgaaataagcagattgagacaggactgttactgtttgaccgttgctactgtggatgaagtgatgattgatacaccatggagtcatgatagttgtccctactgtactacaacatttgatccattgaaaataggtgcagcctgttgttcgtgccagaaccaagttactcacactgttccaagatataagttagttgtcaagatggaacagaatggggagaaggctaacttccatttatgggatgcgacgtgtatcaagatctttagtaaaacggtggatgaatgtcgtcaagagttgattgcaagttgtgatgagatcaaggtgttccctgcgtgtgttgatgaattgttgggtaagacctgggctgtgagattcaagtaccgttttcagatgtgccaatcatttgtgttggatgttagcgaagaggaacatcatatccaggcattgacatctacacttggtctgcaggatgaactaagtataggcaagtcaccagctgttggtgctacaacttcatcacaggattaccatcctacgataggcgatgaaataatgactttaattcttctattgttagctgattacgatcctggaaagactgcctttgtcactcctgtgaaaagaatgtgtgatcagcaaggtagtagtgaatttgagtctgacgaatacgcaccatatgaactatccaccaacaagcatatcaaagctgagtaa

SEQ ID NO: 18749 - DNA, 711 bp, Glycine max
  Peptide Sequence Number=SeqID_110434
atggtaagaaacaacatcgtattcatgatgttgctcgtcatcatatccacaaggtggaagttcatgaagatggaatccaaaaagaagcgcactgctccttctcgccctttagaggcctatgactcctctcattttgtttttgaggaggcatgggaccgctatcaaaccaatgtcagtctccggaacgtcttaccagagaggaatgttgagctagcccaatcgcactatgacgagttcctgcatgggctcgagcgtcgccaatggcattgtcatctcacccaggagatggagaaccccatagatatggcgctgaccccaatggttctcaaggtgggggagcactacgctgaatactcccgttattgccacacatatcctgatcaccaagccatagcatctaagctatatgtttctggaggagtatttgttctgaatgctaagggacccctggaagatcctaaggaaggatctgaccaccctgactcaaacctagagtgtcctattgccattgtcgtcttctttctcctccgctccaccatactagatcgtccccatgttggaaagcttgcatcaggggtggcctggcccgaagtccagccttcccttgttggggaggggggtgatgcttttgatgctccagacccagatgcagaggctgatgctagtgccgaaattgattctaattacgtagctgatgtcaccttcgcatag

SEQ ID NO: 18750 - DNA, 447 bp, Glycine max
  Peptide Sequence Number=SeqID_110435
ggctacacgccctcaccttgggtactagttaccctcaccgttgagaggactacacgtcctcgccttgagaggactacacgtcctcaccatcagagggctgcatgcccttacctccagaggactacatgtcctcgccttgagagggctacacgtcctcaccttgggactacacgtcctcaccatcagagggctgcatgccctcacctccagaggactacatgtcctcgccttgagagggctacacgccctcaccttggaggactacacgtcctcaccatcagagggctgcacgcccttacctccagaggactacatgtcctcgccttgagagggctacacgtcctcaccttgggtaccagttaccctcaccgtcagagggctacacgccctcaccttgagaggactacacgtcctcaccatcagagggctgcacgccctcacctctag

SEQ ID NO: 18751 - DNA, 438 bp, Glycine max
  Peptide Sequence Number=SeqID_110436
atggcaagcagaaatgaaaacgtccctgtcatagtctactacaatgcctatgtagttgattgtgacgagggcgttgagtttaagggtggaaacaatatacttatttcaatgaggagaggcatgaccttcaatgtcttgaaaacaaaaatccaacgtaagatgagcctaaaccaagctgttaccatcagtgacgatgaggatattgatggcatgttcgatgtctataaccgacatcaatgcttaagtggctttcagttgctcatacaatacgaacaacaacctttttctaccgctaatgtcgaaacaaccattcaatcaccacaaattcatgaaacaccatacactaactactatactcaaacctgccatgaaggtccatcctcttacaccccaatcccatacacaaccacaaatgattattacgtccctcatttttaa

SEQ ID NO: 18752 - DNA, 345 bp, Glycine max
  Peptide Sequence Number=SeqID_110437
atggagaaagaaaggggggaagaaggagttggaagtgggagaatggcggtggaaaatgaaagatttcaactcagctcagctcatcggaacctaccaattcacatggatcgggtctcgcttttaccttaccgggttagcgggtcttcatcatctatcttatacaaacaaggccttgacgatgctgacatggacgtgctagtgcctacatgtcgcgatgtcgtgcgtcctaattcccacccaaaaatgtcattgtcatactgcatttattactttttgtcgtttgcgtactgtacacttcagttatcgatgcatgtatgtttccaaggacatttattgcgccactga

SEQ ID NO: 18753 - DNA, 177 bp, Glycine max
  Peptide Sequence Number=SeqID_110438
atgttatcagttcttgctcttcctagggtttcatcttttgaatttcatctacattggagtgcacgctataccttcctctcttctggtttggagctcttacacaatgaagtgccaagaatagtcttgtccatgatgattgacacatttcgggcactcaaaacacttcacatgttttag

SEQ ID NO: 18754 - DNA, 294 bp, Glycine max
  Peptide Sequence Number=SeqID_110439
atggcgcaagacttggcattggatttggaggagcttcgccgcctccacagcatcgccaaaagacctcgaaccctctctcttctctcctccgaaattcgtaacctcgaaaagttatcgtcagaggaagcttctgcgcagattccggcgccgatttcgaccggaactaaagtggcgccttcacctgcgctgaagtatgcggcactcgcgtcgttcagttgggaccaggatagtgacaaagttaagcgccgcaataaggcaatttgtgaaggtaggcctgctatggcagtgccatag

SEQ ID NO: 18755 - DNA, 459 bp, Glycine max
  Peptide Sequence Number=SeqID_110440
atgcttgatgaagttataaactatgttcagtcattgcaacgccaagttgagtttctgtgtatgaagttggcttttgttaacaacaggctggattttagtgttgagagtctaatgtcaaaagatatattgcaatcaattaattctttggcacacccaatattcccgatagattcctcagcaccaccctttaatgggcaacaccctcacccaaacccaacagtccacaataacattcctaatggaactatgacccacaactcagtggacccattagataaaggtttgtgccaaaaccttggcatgcatttaccacacctaaatggttttaatgaagggggttctcaggacaaagctcagagatatttctttcttcatgctggtcttcaagctggaaccagatattattacaaatgtgggaatagttctattctagccttgagccaagagcatttgttttag

SEQ ID NO: 18756 - DNA, 405 bp, Glycine max
  Peptide Sequence Number=SeqID_110441
atggattccaagatcgactccattctcgagggtctcgcacacctcaccctccctcctcccatttcacccaaatcctcaccaccttcgtctccacttcctcgctcgtacatgaagttggatgttccccaatttgacggtcaagatcccctggggtggatttttaaaatcatccagttcttcgactaccaatgtatacctgataatgagcgtttgacaatagtatccttctacatggaaggcctaactctgtgctggccctcaaagctcgatttgctccgtccttctatgatgacccccacgacgccttattcaagctccaacagaagggcaccatcaacgattacctttttgaatttgagcgattggctaatcggacggtcgggtttgcttacccctttcttctga

SEQ ID NO: 18757 - DNA, 606 bp, Glycine max
  Peptide Sequence Number=SeqID_110442
atggcgttaaggcttatttgggagacaactgaaggcgccgcaggtggaggcggcgtttgcatctgtgaccaggggaccacttgtcatcacagtggtaacataacccttggtcacggcggagggcaagctggggaactggagtggagcggaaactgcaacgacggtcaagcagtttgtcctcctgaaggcgggcaagctccaccgcttggggcagagaaactggtcgcagggcctgaacctcgcggcggagttcgggggtcagaccagaaacgaaacaactcaacaaactttaagccccctgaggatcatcataaaacgaaggcgcaaatcgcgactcaagtgcttgcagcatcgccgtccaagatggaaaaaaatccattgcggtacatccactggtaccatgacaaagcagcgccgtccatggatggtggtggttggccgggagagatggtggagggtgagggagctgtgatagtggctagccgatcgaaaagggactcgatctgggaccctcctccaacctatccgtggttacctgtcgtgtgtgatgctccggcatcggaaaaagaaggcaggtcggaccagttgatagagaactgcaaatga

SEQ ID NO: 18758 - DNA, 198 bp, Glycine max
  Peptide Sequence Number=SeqID_110443
atgaagagagaaaaagatgcaaggtggtgcaatcacgcagggaggcgtggctcacaggggaagaggcgcgacgtagggaggcatgactcgtgggggatgattgcccgatggcttgttggcaaagcaaaatgcacaacttcactcacctcaccttcaactgaagcggatacagataagtccgtggactttgtggattaa

SEQ ID NO: 18759 - DNA, 231 bp, Glycine max
  Peptide Sequence Number=SeqID_110444
atgtcacgtaagcaaacgtgccgccgtggccgaggcgcgttgaggaggagttggtggcgttgcggaggacggagaaggagaggcggtggccggagaaggggggtagtttgggtttgtggtggaggaaggggtctttggaaaaggacgagaagaggaagaaaagagggtgaggaagaaggagaggaggaagacgagaaaggagaaccaagagaattaggcgtcgttgactag

SEQ ID NO: 18760 - DNA, 510 bp, Glycine max
  Peptide Sequence Number=SeqID_110445
atggcttgcagacagttgtgggcttcaagagctgcttcctacctcaggatctccgtgtttcacagaagcttctctaacgctgtgtctggtgatctctcaggttatgttgcaactgatcaagttttgaatgatctgaagtatgctgattctcatgagtgggtgaaggttgatggaaattctgcaactgttggcataactgatcatgcccaagatcatttgggtgaggttgtgtatgttgaattgcctgaagtgggagccaccgtgacacaaggagaaggttttggtgcagctgaaagtgtgaaggcaactagtgatattaactctcctgtttcaggaaaagtggtcgaagttaatgaaaaacttaccagttctcctgctttggtcaacacaagcccttacaaagatggatggataattaaagtggagatgagtgacagtggtgaactaaacaacctgatggattcagaaaagtactccaagttctgtgaagaagaagattccaaccattga

SEQ ID NO: 18761 - DNA, 267 bp, Glycine max
  Peptide Sequence Number=SeqID_110446
atgatgcctgaacttgagactaagttcatgtataaaacgatagggtttatcaatgaaaaactgattttcataggagttgaatgtgaaccatctatgctatatgttctcactggcattcagtttggaaatatactctatatttccagtagagaagctctcaaaagagtttatggcttgtatccaaacaggcccaatggtatatggctctgtgaacatcgggatcatcctaccccacgaagaattgttgtcacacttaatgaaatatga

SEQ ID NO: 18762 - DNA, 381 bp, Glycine max
  Peptide Sequence Number=SeqID_110447
atgtcatctagtagtagtagacgtgctgatgaatggtttgaaaaatgccctaatttgataaccagtttgataaagggctgtcgttgggatccaaatgacccaacaattggatttctgttagatggaatggatcatttatgttgcttggtacgcaaatacattgcagcaattcgaggttactcattgtcatatctttcatcctgtgctggaagaatccgttttttactaggaacccctggaatggtggctcttgatattgaggctagcttgaaaggacttcttcagcagattgttcaccaccttgaaaacttgccaaaaccacagggtgaaaatatatctgctatcacttgcgatatgtcggtatgtgggacatcagagtag

SEQ ID NO: 18763 - DNA, 1911 bp, Glycine max
  Peptide Sequence Number=SeqID_110448
atggctcgcacaaacgacatcgcaaacaagatcgttgtgcgacgattttggtttacgacatccatcagtaacgcaaaaccgccgccttttcgttggaaccaaacggtggcatttggggttcgcaaaacgccacgttttgtggtgtgtgctggccctaagaagatattatttggcaaagagtgcagagaagccttacaagctgggattgataaacttgccgatgctgtttctctcaccgttggacccaaaggacgaaatgttattctttctgaatctggaaaccttaaagtgattaatgatggcgttacaattgctcgatccattgagctttcggatgcaattgagaatgcaggtgccatcctaattcaagaggttgcaagcaaaatgaatgagttggctggtgatggtactagcactgcaattattttggctcgggccatgattaagtctggactactagcagttgcttttggggctaatcctatttctttgaagaaggggatggaaaagactgtaaaggagctggtcaagttcttgaaggagagaagtgttcctgttgaaggaagggagcatattaaagctgtagcctcgatttctgctggaaacgacgagtatgttggtaacttgattgctgaagctatggacaagattggttcagatggggtgatatctattgagtcttcctcatcatctgaaacctctgtgataattgaagaagggatgaagttcaataagggttacatgtctcctcacttcattacaaaccaggagaagtccattgtagagtttgactgggttaaagttttggtaactgatcaaaagatttcaaatgtcaaagaaatagttcctttgctggaaaaggctatgcagttgaatgccccactcttaattattgcagaggatatcacaaagcaagtgttggagaccttagtggtgaacaaaatgcaaggattactaagagttgcagttgtaaaatgtccaggatttggaggtgcaaagaaagctttgttacaagacattgcacttatgactggagctgattttctttctggagacttgggtctcacacttgattgtgccacatcagaccagcttggcactgcactgaaagtgagaataacctgtaatgagacaactatcattgctgatcctagtttgaaggctgaaattcaagctagaatttcacagataaagaaggatcttagtgaaacagataatgcaaacctgtcaagaaagctctcagagagaattgcaaaactctctggtggtgtagctgttataaagggtttaagtaacatgggtcactgtgagaagtccatcattaagggcgattttgcatccaacaataatgagaaccctaatgcaactgactattcaagttctcttgttaatatgatatcagagcctatcttagatgtattggtaggtgcacatactgagctagaactcgaagataggaaacttagaattgaggatgcaaagaatgcaacatttgctgccataagcgagggaattgttcctggagggggtgccacatatgtccatctattggacttgataccaacaataaggaactccatggaagatctagatgagcaaattggtgctgatattgtagcaaaggcactccttgaacctgcaaaatcaattgcaactaatgccggagttgatggagacattgttgtccggaagactagaacacatgattggagaactggatataatgcaatgacaggcacgtatgaagatcttttgaatgctggagtagcggatcctagtcgtgttgcaagatgtgctcttcaaagtgcagtttctgttgctggtgtcattctaactactcaagctattttggtggataaaataaagaaaccgaagccacctgtacccttggtccctggcataactccctga

SEQ ID NO: 18764 - DNA, 348 bp, Glycine max
  Peptide Sequence Number=SeqID_110449
atggatccttcagatgttcgacgctggaaaggcagttatggagaagcattggctaagcatgaggaaaggttcaagttcaaccataacatggagaagttgcaacaatggaagatgggtctgtatcaagtagctaacttgtctggctatcatttcaaagatggagctggatacgaatatgagtttattgggaagattgttgagagggtttccagcaagattaatcatgctactttatatgttgcagatcacccggttggactggagtcacaagtgctagaagtaaggaagcttttggatgataggtctgatgatggtgtccagatgatagggatccatagaatgggtggg

SEQ ID NO: 18765 - DNA, 618 bp, Glycine max
  Peptide Sequence Number=SeqID_110450
atggcggaggtcaaggacttcaagatccagctgcagggtgcggcggaggggaggaaggggaggctggcggtcacggcggagggccggaagttttcttcttattacataggaacaaacgaaatgaaaattgcttccttgatttctggttgcaatgactacactcacctcctctctattaaggagcatgtgatgagggaagagaagccaattcctactacaaggaagagtgaagtgaagtttctcaagagcttgactcgtcttgtggctgcttttctagtcttatctccaatttgcagcattccagtttcaagtgctcaaaccgtagatattcagagaggaaccacgttgtttcgtcaagcttgtattggatgccatgatgcaggggcaactctatttacaaaggatttacagagaaatgaagttgatacagaagaagcaatctatcgtgtcacatactatggcaaagcacgaatgccaggctttggtaaagagtgcatgccacggggtcagtgcacatttggagctcgtttggaagatgaagatatcaagacattggccgagtttgtcaagttacaggctgatcaagggtggccaagtatagagactaaagaagaatga

SEQ ID NO: 18766 - DNA, 1239 bp, Glycine max
  Peptide Sequence Number=SeqID_110451
atgggggcttcacaatcacaggaagagctacaatcacaacgacagtttcaacaacaccaacacccaaatgaactcaccagaagggaatcattgttgttgtctcctgcagctagtaacaacacaaaacaattcagcaacagcacaaaggtagtagataatgtcacagctgccaacagcaccaacaccaactgtttcatgttgaatgcgagagcactctcaatcacctgggcagaaaatccagactattggacatgggtacaggataaagatgaaagtggcacgatgatagagttacctaatctgaaaatggtttgctggctagaagtgcatgggaaatttgacactagaaaactttcactaggaattctatatcaagtgtcatttattgtaatgttgaaagattcagctcaagggtgggaagttccaataaatgttagacttgtccttcctggaggaaagaaacaacaacacaaggaaaatttaaacgagaaattaagggagtgttggatagagattccagtgggagagtttgtggcatctgaaaaagatgttggcaacatagagatatctatgtatgaatatgaaggtggcaagtggaagacagggcttataatccaaggcattgccatcaaaccaaagaatgagactaatcaatcacaacaccaccaacaaccacatgaactcactagaagggaatcatggttgatgtctcctgcaggtaactcaaaatacttcaagaatagcacaaaggcaatagataatgtcacaagtgccaacaacaccaattctttcatggtgtatgcaagatcactctcaatcacttgggcagaaaatccaaactattggaaatgggtacaacataaagaagcaagtggcacgatgacagagttagctaaacttaaaatggtttgctggctagaagtgcatgggaaatttgacgctagaaagcttttaccaggaattccatatcaagtgttgtttattgtaatgttgaaagattcagctcaaggatgggaagttccaataaattttagacttgtccttcctggaggaaaaaaacaagaacacaaggagaatttaaacaagttaagggagagttggatacatattccagtgggagagtttgtggcatctgaaaaagatgttggcaacatagagatctctatgtatgaatatgaaggtggcatgtggaagacagggcttataatccaaggcattgtcatcaaaccaaagaactaa

SEQ ID NO: 18767 - DNA, 2379 bp, Glycine max
  Peptide Sequence Number=SeqID_110452
atggagagtagcgaggaagaagatgatttcccttccattgagagcatcattccccagtccaaggttgactctctctatcagtctcacaccgaaaaggggatcaggaagctttgctgtgagctcctagatttaaaggattctgtggagaacttgtgcggcaatatgcactccaagttcttggctttcttgaggaatttatcttggaagatgagaaacaagctgaaaaagctcaagctgttaaaatattgcccagctgtggaagtaaagcatgaattgattgagctgcaaaagcatatctcagcacaaggtattcttgttcaggatttaatgactggtgtctgccgtgaattggaagagtggaatcaatcaagcaacgatgttgctgaaattcagcaagaacctgaactacctgaactccttgagcctttaccaaatgagagaaatgaccagaaaatattattcttggaaaccatcgatgtacttttggctgagcataagtttgaagaagcattagaagcattagatgctgaagaaataaattctgcagagttgaagggctcagggaataactcttcagatgatgtttccttgtacaagtcttccttgttggaaaggaaggcaatgcttgaagaccagctggttggaattgctgaacaaccttctgttagtttccctgagctgaaaacagctttaaatggtttaataaaacttggaaaaggtcctctagcacatcaactaatgctgaagttttatcagtctcacctccagaagagaattgaggctttgcttccctcaagttctctctgtcctgaaacatttccttctacattatccaagattgtgttttctgtaatatcactgacaataaaggaatctgctttgatttttggagataatcctgtttataccaacagagttgttcagtgggcagagtgggaaattgaatattttgtacgagtggtgaaagagaatgcacccttatctgagactgtttctgccttacgtgctgctagcatcagcattcaggctagtctgaactactgctcaatcttggaatcacaaggattgaaattgtctaaattactgttggtgcttctgcgcccttctgttgaagaagttttagaatcaaattttagacgtgctagaagagtagtgcttgacatggctgaatgttgcccgttgtcaccacagtttgcatcttcactttctgcaattgctagttcatctagtagcatgcttgttgagagtggaatgcgatttatgcacatagttgaagagatattggaacagctaacgccaacggttagtttgcatttcggaggaaatgtactgaacagaatcttacaactatttgataaatacatggatgctcttaccagagcactaccaggtccttctgatgatgacaatcttccagaactgaaagaggtcgcgcttttcagagctgagactgactcagaacaacttgcaatattgggaatagcatttacgatattggatgaactgttaccaaatgctgtgttatcaaggtggatgctgcaaagtgaaagcaaggccaaggaaccaaatagtggagcaacagagaatgtaaccttcaatacaaatgctagtgtagaattgaaggagtggaggaaacatcttcagcattcttttgacaaacttcgggatcacttctgtctgcaatatattgttactttcatctattcaagagagggaaaaacacggttgaatgcacatatttacttgagtgataacagagaggatctttactgggattctgacccactgccttcgctgccatttcaggcattatttgcaaagctgcaacaattagcaactgtggctggagatgtattacttgggaaagagaaaatacagaaaatgttgctagctaggttaacagagactcttgtcatgtggttgtctgatgagcaagagttctggggtgcattagaggataattcagctcctctaaagccacttggtttgcagcagttaattcttgatatgcactttactgttgaaattgctcgctttgcggggtatccatctcgacacatccatcagatagcatcagctatcactgcgcgtgccatccggaccttctctgctaggggcattgatccacaaagtgcacttcctgaggatgaatggtttgtggaaactgcaaagtcagcaataaacaagctcttgcttggggcatcagggtctgaggcatccgacaccgatgaagatcacatcattgttcatcatgacgaagttgtctcagactctgatactgtttcatccctgtcttctacggaatcaaccgagtcttttgcatctgctagcatggccgaacttgacagcccctctaacttgtctgatccagataattga

SEQ ID NO: 18768 - DNA, 330 bp, Glycine max
  Peptide Sequence Number=SeqID_110453
atgaggacaaaacagggagatgccaactggaacgacatgcaaagggcggagagaacttctggtaaggtgaacgaggacgacaaaggcaaaagtagcgttgaaggtgcagtgagacaaaagtttcaacaaaatgaaagagataacctcgtatgcgacaatgctgatgaccgaaagcagaaaaacgggacgaggaagaaataccccaaacctgagctcaacaggaggaacaatctcttgttcatcagtaccattgaacatacctgtggaagagaagacatggctaagcaacacatgggagggaagaccgaagaatcttgcgatgttcaatag

SEQ ID NO: 18769 - DNA, 804 bp, Glycine max
  Peptide Sequence Number=SeqID_110454
atgggggcttctgaatcacatgaaaaactgcaatctcaacagcctcagccacagtcacaacatgtacagcaccaacagccacagccacagctacatgaacccaccagaagaagggaatcatcgttgctgcctcctgatcaagggaacacaaaagcttccaaggatagaacaaaggcagtagtagataataatgccactatgatgccagtgaaatctttgaaaggactaccgatcccacacaactatgaacatatactgaaaagtaatgcagattcaccagttgataaatctctgttggataagctatatgctgggaaatattgggtagagaagaagtccaacggcaactgtttcatgctgtacgcaagagcactctcaatcacctgggcagaaaatccaaactattggaaatgggtacagcacaaagaagaaagtggctcaatgatagagttggctaaactgaaaatggtatgctggctagaagtgaatggaaaatttggcactggaatgctttcacctggaattctatatcaagtgtcatttattgtaatgttgaaagattcggctcaggggtgggaacttccaataaatgttagacttgtccttcctggaggaaagaaacaacaacacaaggaaaatttaatggagaagtctagggagagctggatagagattctagtaggtgagtttgtggcatctgagaaagatgttggtgagatggagatatctatgtatgaacatgaaggtggcatgtggaagacagggcttgtcattgaaggtgttgccatcaaaccaaagaactag

SEQ ID NO: 18770 - DNA, 1047 bp, Glycine max
  Peptide Sequence Number=SeqID_110455
atggggaattggagtgaagcaactgatgcaagaaacaaagtcttgaaaatgttgcagagcatgacagggttggatactttatatgactatacaaggaaaacaccctatgaggatgatttggttgaacaattcttgagcattgctgaggtgaagaaggccttggggatcaatgaatcatttgcgtatgagtcatgcagtgatgttgttggggatgtattacatgctgatgtgatgaaaagtgtgaaatatatggtggaatacttgttgagtatgagcaaggtgttgttatatcaaggtcagcatgatttgagggatggtgtggttcaaacagaggtttgggtgaagacagtgaaatgggaagggattgtggagtttctaaattctgaaagaaaaatatggaaggttaatggagagcatgcacggattgaaacaatttttgaagcagagaaagagcatgaagtagccactctctctttactattttcccctttgtccaacccaagaaaatccatcaaccacccttcaaccaagcaagctcaaagttccaaaccaagccttatccctcacagacctttctctctccaccaccactcctcctccttcaaatccaccatctccgccaatcccctccacgcccctctctcccttgctccccaccgcccccgtgacccttccaatgccaccgcccccgtgacccttccaatgccaccgccctctgtcacgccgccctcgtctggtttcgcaacgacctccgcctcctcgataatgagtgcctcatcgccaccaacgactccttctctgtcttccctgtctactgctttgacccctctgactacggcaagtcggcatccggcttcgacaagaccggcccctaccgggtcgccttcctcattgactctgtctcaaacctctaccgcagcctctaggcgtgcggctccgatctcgtcgtgcgcatcgggaagcccaagattgtgcgagcggagctcgccaaggcgttgcatcctaagtcttgcaagagagagaagagggagaaactgttggaaatga

SEQ ID NO: 18771 - DNA, 2397 bp, Glycine max
  Peptide Sequence Number=SeqID_110456
atgtctggaaaagaaaatcttatatctgaattgcatccaaggaaaggatcatggaagatagcagtgcgtataactgatatgtgggatgttaagaaacacaatgggagacaagcgattgaaatggtcttcatagaccaaatgggtgtaaagattagggcaacgctatggcaagagttgttccctgaatttcaaccgaagttatctttaggttgttcctatttgatccaaaacatcaaagttgtggacaatcaatctgaatacaaagaagttgaaagacctgaaattcttgctaatgtacacgtcataactaaaattgctgatattatttctggcattgcactgcgacatactttagttgatgtcgtgggtgttatcgctgaagttattgaacgaaaaacagtgaatcctgcatacagggttacggtgaagttgagagacaatagtgatgctgagatcctcatgacactatgggaggattatgctcttcagctagatgatgttattgaaaaaaaccattttaaaagggagccgttggtgcttatgttaacattggctaagatcaaagatgccacagacaagtatcccctcagtgtccaaaatataaaaaatggttccaagttgtatgtaaactctgatgatattgccgagataaggaaattccgtgatagtttatgtgttccattttatgttggtggactaacagaagaaggcagtggttcgcaatctcagtataccagtaattcacaaagaggtgatcgtgataagttcttgcataatgctcagatggtcaggttaggtgacataagcagactgagagaggattgtttctgtttgaccgttgctacggtggatgaagtcttgattgatacaccatggagttatgatagctgtccaaattgcaccacaacgtttgatccattaaaaatagtgggtgtctgccgttcctgccagaaccaagttagtcatacggttcccaagtataaattagttgtgaaaatggaacacaatggagagaaagctaacttttatttttgggatgcaacgtgtatcaaaatgttcgataagacagccgaggaatgtagacaggaattgattgcaggtggtgatgagatcaaagtgttccctgagtgtgtggatgatttggttggtaagacattggcggtcaggttcaagtttcgtgtaaacatgcgccagtcatctgtgatggatgttagcgaagaagaacatcatatccagacattgactttcaaacttggtctacaggatgtgcaaactatagggaaatcacccgcatcgtgtgctgagacttcatcagggtattaccatccgacgccttcattgtcccagtcagctgactatgaccctgggaacactgccttcatcacccttgccaaaagattgagcggtgaacaagccacaaatgaatttgattctgaggatactactgcgtacattgtaattgttgttctgtacacgtgcgtaattagtgaggttgacaagccaggatcagcttctggacctatgacggctttagtggacaagccattatatgattctggacttatgaccccttatgatggtaacgtatacacttatacaaaatcactgtcatataaagtgttggaattggtgccaaagcagaaacatctacgggctccaatgtttttgatcattcatcttggtgattgtcatcatcttggtgattgtcatcatattctagaaaaagggggcccacctaaattcttgggatgcacagttatatatcaatttcagactgcattccatgttgatagaaactacattgaggtaccctcaaaatatcatcagcaatgggctcctgattacccacctaatgttctctttgattacaatggccacaagcagattatacaaattagaaaagataataacagatactattttgctgataggcttaaacaatttagaagagagttgaatatatatgaaggtgtcatggtttactttatggcacccaacaataatacaacttttcatctccattttactccaccactggaaagacagacatgtggaaggcctcacagttccaccaaaaattatgtgttcaccatagacattacccaacctatgatctcaaatgctaccccattgttgctgccccccgaggctctcaatttggttgggccatcatcactatatatgactattcagcgtagtagtgggcgtcgtttaatatggagcatgtctatggataatggcattcgatgtatggctgcaccttggtaccgatttttaatggacaataacgtaatggctggagatgaggtcgccttctatttcaggcccaaccagcatgtatgggaacttatcttgaggaagcaactcatatgggaagatgaaggccagtcacattga

SEQ ID NO: 18772 - DNA, 378 bp, Glycine max
  Peptide Sequence Number=SeqID_110457
atgactacaccacctagctctcctcctcctcctccttctgatgcagcatcacaatctccttttaccttgaagcgaacaagaaaagccacatacctgagatcattggctactagagtagttggggtagagagacccctagtccatgtggatcctgagaccgagaatgccgatggtccccacaaaaagaagttaagaacatatttggggatcgtcgctcgtgataatgtggatgtgacatacgagaatttaaaacaagtccctactgcccagaaggatttgatatcggaggatattcaagctgaatttgatattcctaaagcatctaatttgaggaagaaaaagaaaatacttcagaccgtgagggagcgatggagatag

SEQ ID NO: 18773 - DNA, 1179 bp, Glycine max
  Peptide Sequence Number=SeqID_110458
atgggtggtggtggtggcactgtgaaatcattgacttgcaaatttgtgtttcttcttgttactcttttgattcttagagctctgttggttcctccttcccctggctttggtggggttgttgaatggagcaattttgtgtatattaggaaccattctccatcatttggtattggggttagacaagacaagtttttggaggttcctcagattgtgtggggattgaacaaccagaagattgcatttgcaagggcttgcctcactgctagaaggatgaatcgaattctattgatgcctagtcttagtgcctccttgttttacaaagaaattaacctcttgcaaccaatttcctttgacaaggtgttccaatttgacaagtttaatcaactttgcagtggatttgtgcagctaggtcagtattcggatctctcgaaccaaactcgagtgcttgagatgcagaaagggagtggtaggaagtggacattggagagggatttggatcaattgagagagcatagcaaaggggaatttgatgagcatgaggtgattaggatagtggggaaaaaccctttcttgtggcatgatcattggcctgtgaaggactatgcaaaggtttttgagtgcttagttttgatagatgagattggtcaagaagcagatagagttgtgtcaaggattagagcagttggaagagaaacacaaagcaatagtgaatcaatggaattggataataatgatagttcttcttttcagcctcttccttatgttgctgtccacatgagggtggaaattgattggatgattcattgcaaaaaattggagcagagattgaacacaaaccaaatttgtagtagcaagaaagagataatggaaagagtaagcaacatcaaagggttgaagactccatctgttgtttatcttgcagtggctgataaactccttcaaaattcttcagtacttgaaggttgggaagaaggctttctaccttacgagaagaataaacttggtgttgatggaatttacaagaagtatccatatctgattcaatcagcaattgactatgaagtgtgcttgagggctgatatctttgtagggaacagtttctccacattttcaacacttatagttcttgaaagaacacaaaaaatgatcacaatgggtatcaacatgtgtggaaaagat

SEQ ID NO: 18774 - DNA, 309 bp, Glycine max
  Peptide Sequence Number=SeqID_110459
atggcagctgtgaccatgccttacttcacaatagagcccacacacctgcaaagagaagtctcttggagcttacatcgcaggatgccttgttggcgcagaacaattcaacctgcttcttcgatagtcatgcaagtaggggggtgtagtatatgtggaggaactcaggagtctggtgcttgcatgactcatgatgacatctccaaggaagttaattatatggctagccctaacagacaagttttccatctaggtggttattcaggataccagcaagggggcaacttctctcataatcagggccaaggctag

SEQ ID NO: 18775 - DNA, 186 bp, Glycine max
  Peptide Sequence Number=SeqID_110460
atggacattgaagaggacgttgaaatcctactgattttaggtcgtcccttcatgttaacaaccaattgtgttgttgatatggggaaagcaaagcactcaattgaccgcagtgtttgttctaagatgaatgagattgagaatgagatagctcagattgtcaaagctaagaaattacaggacccttag

SEQ ID NO: 18776 - DNA, 759 bp, Glycine max
  Peptide Sequence Number=SeqID_110461
atgcattataatgtggaagtgaaggccaaggctcctccgccgaagaacaatcgccctcccaagaagatttcgaaacaatcgcccttcaatccacagagtataagtatgcattatagcgtggtgcctttgccagaggaaacatttactgtggacgtgtccaaaggagaggacgaaagacctgtttcgtatctggtccctctgacattggtgagcaggctcgagcttcggaagttgagggattacctcagtggaagcgatttggtggtgaaggagaatcctttgaagcagtgtgtttcgttgaggcggtgcttcttccccatgaaccctcctttgaggaagaaagatcttaaccatggcataatggcgattggagggtttcagcagagtttaagtctacttctcagggattgtccttgtgcctggactattcggttttgtcctttcggaagaagctgcaggagacaagttgagcatgtacttattgggttgaaggttaatgttaaacaccggaagacaaagcagaagtacactattactaggttgacacccaaggacattcctgccttggattttggaggcaacaagactaattttgtgcctatggagttgtgtgagttggttgagggacagagatatcccaaagagaatttggacaaatatgctgccaaggacttaaaaggcatgtcagtggctcctccaagggtgaggcaaagtacaatacaagcaatggtaaactcagaggacggaccgtgcgggtaa

SEQ ID NO: 18777 - DNA, 318 bp, Glycine max
  Peptide Sequence Number=SeqID_110462
atgaggtgttggcggtcattgttgacggtggttttccttgagaatttgggcttccattttagtggaagtcgtcatcacttggtttatgaacgaggggaggtgtggaaggtttgttactttctgcacgtgtggatcacgatagttgtagggagatggaacgtcaatatttttgcaagtgttggactccacgagatagaagaagaagaatggggttgggatgtggatattatgtcctatattgacttcaagaagctgattaactctgttaggtacaaacattccagtgcttatgctatagggatcccaaaaaagcactaa

SEQ ID NO: 18778 - DNA, 663 bp, Glycine max
  Peptide Sequence Number=SeqID_110463
atgaataaaggatacgatagagttaccgctatcatggtacatgatgacaatggaacagttccccatgcaaacactctgaatgatgaaatcaaagaatatctggattgcagatatatttctccatgtgaatctacttggaggatctttggttttccaatacatggaagaaaaccttttgtagagaggctacagttccatcttctaggccaacatagcattctctaccaagaccatgatgatattgatgatctgctctctaacccaagcatttatgaatcaaaatttatagcttggatgaatacaaaccaggcttttgttgaagaggaccaatctcatttgaagatatcagaacagttgatggtgttgaatattctacatatagagaagcaagttttgctatgggtttttttacaggatgatagagaattcattgctgcaatccaggaagcaaaagactggggcttagcaccttatctaaggaatctttttgcattattacttttgacagaattacatattgatgactccaatctgatgaatttggtattgcttgaagttgaaaagctgttacaagccaatcaaagatcacttaaagactatccttccatgccatatcctgagaacgcaaatttactaatacatgcagacaacgacctcatttag

SEQ ID NO: 18779 - DNA, 315 bp, Glycine max
  Peptide Sequence Number=SeqID_110464
atggatttgaaagaaggttgtacttatgtgatgcacaattttagagtcagtaagaatgatgaatggtatagggtttgtgatcatccatataaattgacatttattggagttacggttgtcagacagtgtgaattggatgaccttccatttaaaaaaacatcattggtgtcgttgacgaggttgtctttcgtcatatttcacccagaacagtccatttctataacagcagaccatgatgcacttattggacttcccttgacaccaacaaaacgacagccatttaatgaatgtgatgatgaagcaagaagctcctag

SEQ ID NO: 18780 - DNA, 198 bp, Glycine max
  Peptide Sequence Number=SeqID_110465
atgccgagacggctgtcaaacagcagcaaaggtgtgcagtactacacacacgtttttgaagagaaggagggtaaccttagaagggcagagaaaggtccatgggggacaaccacacctcatgctatttataatatggaaaagggaatcggtattgattacaagatcaatcagttactgattaataaggaaactaaataa

SEQ ID NO: 18781 - DNA, 180 bp, Glycine max
  Peptide Sequence Number=SeqID_110466
atggagagatgccagattcagagggatgtccctaattacttcagaattgttatagaaattctaattgaggttgatcatctacaagatgtccctggcccatacattcagataaagggtgctaataaagatgcagtagcagcagcaggttctggatcaaataagtatttcatggatgtctag

SEQ ID NO: 18782 - DNA, 147 bp, Glycine max
  Peptide Sequence Number=SeqID_110467
atggagacatatgcgaaatatgaggatacatttagcaaaagtggcacagaaaggaagaaaaaagaagaaattctgaagcaggcccaatccaataggggcgctaagcgcgcatcaggcgctaagcgagcaactaactgcaggcgctga

SEQ ID NO: 18783 - DNA, 411 bp, Glycine max
  Peptide Sequence Number=SeqID_110468
atggtatatcacgcaactgaaggcaattacctccatttcgggtatggagtaagttgttacaagcttgggaataatgggaaggttcagttggcctataattcttcagagaacagtggcaaggctgctgaaatgttgtttttattgacctctggtgaagaatatctgcatcatgggaaacttaatgcatatgaagttgctcttggtggaagattcaataacatcaatattggggacctgaagctttttgaaaggatgaatatgggtaagaaggtgggacctcaatcatactatgaccatccttatactccaacttcaccaatcgtcgaactaaattggctttattacgaggtgttttcttttgaatcatggactcaagctttgtccataattcataagcatttgtgtaagtag

SEQ ID NO: 18784 - DNA, 162 bp, Glycine max
  Peptide Sequence Number=SeqID_110469
atggctccacctaaagaaatttcgaccatcatttaccacaatggtcacattgcagatgacccagttcgtggatcggtagccgcgatggaaacaattctccagaatccacaattgaattctgccgaattctatgttgttactgaccttattcctcaaccataa

SEQ ID NO: 18785 - DNA, 231 bp, Glycine max
  Peptide Sequence Number=SeqID_110470
atggcgagtttggtctcggtgagcaactcgctcatgctgctggcaatacgtgcatgcagtcctaaaatcgccattaaaactggcgatatgcagaaagcctacgtcgcaggcgctttttcagtgcaggctaggttgcaagtgcttttttcagagaaaggggagttgcaattgccattggcaagttgcctgcaagttgcaactcccattggcgatttagggcagaaaaaatag

SEQ ID NO: 18786 - DNA, 261 bp, Glycine max
  Peptide Sequence Number=SeqID_110471
atgcggattgggaatctgcataatccatacagattgattgtcaattcatatgagcttaacatattaaaaattaaaatttatggggaggtatgggtactcatgccgacggtgaagacgacaccaccaacaagaatggtgaagatgaacggaggtatgaatagagcggagaaacttagggcagcacaacaggaaggacgaaaattgaaatgccaagtaggaaatgggtgtagggaggggatgttgtatttcaattttaaatga

SEQ ID NO: 18787 - DNA, 1677 bp, Glycine max
  Peptide Sequence Number=SeqID_110472
atggcatttcttgacgtacggaaaaaaataatgggtagggtttggacttggacgatggcactgatgctttgcctgatggcagcatcggttaggagcgaggacccttatatttactacacatggaaagtgacatatggtaccattgcccctatgggtgttccccagcagggtatcctgatcaatggccagttccccggccctgaaatcaactccaccagcaacaacaatgttgtcatcaatgtcttcaacaacctcgacgagcccctcttgttcacatggcatggtgtccaacacaggaagaactcctggcaagatggtacattgggtgtccagtgccccattgccccaggaaccaattatacctatcactttcaggtggttaaggatcaaattggaacttatttctactacccgaccaccggcttgcaacgcgcaatcggtggattcgggggtttgaggatcttcagtcgtctgttgattccagtgccctatgccgatcccgccgatgagtattgggtgctcatcggcgactggttcggcaagagccacactgccttgaaacagaagttggatagcgggcgcagcatcggcaggcccgttggggtccacattaacggcaagaatggtgggcttgagcccctttacaccatggagcccgggaagacttacaagtacagaatctgcaatgttgggctcaaagactccctcaacttcaggatccaaggccaccccttgaagctcgttgagaccgaagggtcccacgtggttcaaaacaactacgactccctcgacgtccacgtcggacagtgctacactgtcctcgtgaccgccgaccaggagcccaaggactacttcatggtcgcctccacgcgcttcacgaagaaggttctcaccgccacgcgcgtgattcgttactcgaatggcgtggggcccgcatccggcgggcttccacccgcaccccaaggctgggcttggtctattaaccaattccgctccttccgttggaacctaaccgctagtgctgccaggcccaaccctcagggctcataccactacggtcaaattaacatcacccgcaccatcaagttggtcaacaccgttagcagggccaacggcaagctccgttatggactcaatggcgtctcccacgtcgacacccaaacacctctcaagcttgccgagtactatggcgtcgccgataaggtcttcaagtacaatctcatctccgactcccccgacaccgccttccctgacctcaccgtcgctcccaacgtcatcaacgccaccttccgtgacttcatcgaagtcatcttcgagaaccctggcaaggtcattcagtcctacaaccttgacggctattctttcttcgctctcgcggttgagccagggaagtggaccccagagaagaggaagaactacaaccttcttgatgctataagcaggcacaccattcaagtgttccctaactcttgggcagcaatcatgttaacctttgacaacgctggaatgtggaacttgaggtcggagatggcagagaatcgttacctgggacaacagttgtacgtgagtgtcttgtctccaaacaggtctctaagggatgagtacaacctcccagagacccagcttctatgcggaattgtcaaggatatgcctaagccaccaccttactccagttaa

SEQ ID NO: 18788 - DNA, 945 bp, Glycine max
  Peptide Sequence Number=SeqID_110473
atggctgattggttgttggtgactggaagggaggcaggaaaactaagtgatcggaggcttgggaataaatgtgttggtgtacctgtggaagaacctgttctagatatgtttactacaaaaacaaatacgggtgaattacacaggtggagacttgtggaaattgatgctgacttgtcagacttggtgttcgaaactagtcatgttatgtccctcataaatcctgccaacacctacatggacctgaatattggaattgctttatggcttgctgctggtggtgatggatgggtatctgatgcaaatacatatgataatgatggcaatcatgtacgaattaaatataagtcaaatgcgaagattctccttgttggttctggtgccgatgagcagtgtgctgggtatgggagacatagaacaagttatagacgtggaagttggctggggttacatgaggaaatgagactcgacatgcaaagaatttggagaagaaatttagggagagatgatagatgtattgctgataatgggaaggaggctagatttccattcttggatgaggatgttataaggcttttgctcaatattccattgtgggaggtagccaacctcgatcaacctagtggcattggtgataaaaggattttaagagaggttgctgaattgcttggtttatatgaagcagcagttctgccaaaacgagcaatccagaatacagttgttccattcgttcaacagtttaagttttatactctgctggttcacctgtgtaccggaaccatattgccttttcctttcatgttagatgtcaatagagttttgttattgctgggatgcattgaagaactaaaattttggttcaagaattgcaagggaatcaaatcggaagaattttggaagcaatcgagcagcaaatcaggcatcggctggcagcgtaacgattcatag

SEQ ID NO: 18789 - DNA, 513 bp, Glycine max
  Peptide Sequence Number=SeqID_110474
atgacaaaggaaaatcattttgcaacaaaaggtgatataaaaaaagcactccttcttaaacaatctttctaccttctcctaccaagggaaacatcccttagcactgccatacctcttgagcttgaggttattcctcaagtaaaggagttgttggataagtgtttggttcgtaagagcttaactccttgtgctttgttggtgccaaaaataagtattatgaggcaccgtatccctatgataggtggtatgatgaatgtgttgagtggtacaactctcttttataaaattacccatgcatccaacaccttcatgattgacatacatagggactcattaggtagtgatcaagtggttcccacgaaccctaagagaataaagttcattcctgaatggcccactctaccaagtgttgagggaagatgcctagagtttcaagaacctctggatttgaggtcaaatccttttcaagggggagggaatgatgcaatcctaccccccaagtgtattagatag

SEQ ID NO: 18790 - DNA, 249 bp, Glycine max
  Peptide Sequence Number=SeqID_110475
atgcccttttgcgggcatgcgagggcgaggctcacgggtgcgctttccaaaggaggaaagatgcgcggagtcgccaccaacgtttatttgtggaaaacgtcggaaaaaccgaaggaaaccgggttatgggaattttacggaagcattacgggtgtactggaaaccctgaaatcctatttttcaacaaaacggggggtgtggtggccacctagctcgcccaggcgagctcagctcgacaaggcgagttag

SEQ ID NO: 18791 - DNA, 149 bp, Glycine max
  Peptide Sequence Number=SeqID_110476
gtgttgaggaaaaaagcccagagtttcaagaatctcgggatttgaggtcaaatccttttcaagggagagggaatgatgcaatcctacccgcaagagcattggatagaagactccaagaagattgggccaagatcaagagaaggccctag

SEQ ID NO: 18792 - DNA, 334 bp, Glycine max
  Peptide Sequence Number=SeqID_110477
ggaggatgagtatacggacttccaggaggagatagctcgcagacgttggatgccactggtgactcccatggctaagtttgaccctgagatagtcctagagttctatgctaatgcttggcccacagaaagggagtgcgagacatgcgctcgtgggaaggccaacagtatgagtttagccagaggaggaacagggccaacaggttcgatgaggaggccattgcccagctgttatgcacaccggggtaggatttcgcccggactgcagcaggaaggcgggtgcggatcatgcgcaccaaacgtggatgacacagctgctcagcaatatcttgcctag

SEQ ID NO: 18793 - DNA, 318 bp, Glycine max
  Peptide Sequence Number=SeqID_110478
atgtcacctgacttcacgggtcaagacgccataatggtgcagaagatgatgctagtcttccgcggcgttaacgggctcgtttcccctggtaaccccgcatgcaccagacttcacgggtcaggacgacaaaaggtgcagaggacgatgttagtctccgcgcgtcaacgggctcgtttgccccttggtttgacgaaaggtgcgggtaaccataatggtaacccggcatatcacttgacttcactggtcaggacgacaaaaggtgcagaagacgatgttagtcgcctcgactcgtcaacaggctcgtttgcccctggttga

SEQ ID NO: 18794 - DNA, 987 bp, Glycine max
  Peptide Sequence Number=SeqID_110479
atggctcatggttgccaggaaacgcgacttcgcttccgcggcctgttcggcgtcggccttggccgcagtcagggcctcggcctgcgcacgcgcctcgctgacatccacccagtaaccactccaggtcaccgcacctgcttcggccgcatagggatgggcctggctgcgcacccagcgcgcgccggcaccttcaggtcgcagccggaattccagaatgagcggtgcgaactggcgcgccgcctgctcgaccgcatgcaggatgtgctcgcggtcgtcttcctcgatgcgctccagcaggcacgttgcatcctgttcggcctgctgccggctgattccgaacaacgcctgcaggtcaccggcaatgaacgggaagctgagggttccgtctgccgcacggcgcgcctgatagaccacggcgggcaggttgtcggtgacttcggccaggcgctgttccagatgacgtcgcccggccacctcgcggcgcagccgccaatgcccgatggcgtgcaccagcagcgcagtgagcagcaccagcagcagcggcacgccccagcgcgccacgcgggtccagtcgagcccgttgcgatattcgacggccagccagtcgccgcgcagggcctcgcgctggcgtggggtcatctgcagcagcaggcggtcgaaagtagtggccagggcggcatggcggcgctcgacagccagcaccagctgatcgttgaagccagccggtgcggccacctgcaggcgccccgggaagcggctgcgcagcagatggtcaaccacggccagattgcctacataggcatcggcgtcgccattgatcaggcgctgcagggcctgttccgcgctgcgcgccgcgatgatccgggcctgcggtgcctgctgcagcacatagccacgcacacgctccggatcggacagcagcacccgcctgccctgcaggtcggacaggcccagcagcgccgggctgtcacgctggggatcctctag

SEQ ID NO: 18795 - DNA, 666 bp, Glycine max
  Peptide Sequence Number=SeqID_110480
atggaggagggcgtgcgtgacatgaggtcctgggtgaggggtcagtggatcccgtttgatgcagatgctatcggccagctcctgagatattcgttggtgctggaagagggccaggagtgtgagtatggccagaggaggaaccggtctgatgggttcgatgaggaggccatcgcccagttactatgtataccggggcaggattttgcccggactgctgcagggaggcgagtgcgaattatgcgcaccaacatgaccaccctgcctcagatatggatgactttgctgctcagcaacatcctgcccaccgaccataattccgacctccccttgccgaagtgtcagctggtgtacgccatcctgacgcggatgagcatccatgtggctcagttaatcgctgatgccatctatatttttgcaggtatggcgcctatcaggcaccctttggatccagataagtccaacagggccctgggatttcccgcgctgatcacaggactctgccagtcgttcggagtccccgtggcacctaccaaggtgattcggccgcccatcacccgggcttttattgagaagtactgcacccagagacaggctcaggggggatgctccacaggccgcgggcgcgccaccaccacctcatcaggctggcccggctgggtcatttga

SEQ ID NO: 18796 - DNA, 351 bp, Glycine max
  Peptide Sequence Number=SeqID_110481
atggaggttaaacagaattttgcacaagtgcagaaaaatgcttgtgtgtggttggctgtggaaagtctagtgcagaatgagttctggatgtttgctagtatatcccaacggtcaaaatgcaggcttatacactatagacttccacttgagaggattgatggggacccggtgttgagagaaacgaggatatgggctacgtgggagtacgtgagctcagttggaggtgggcaacaggggatggtgggtttatgcgcgcattgtggatgtggaagcttgttgtgcaccatcgcccgaccgcttcctagtaccacatgtgatggggtaccccataattctacaggcttgagatga

SEQ ID NO: 18797 - DNA, 982 bp, Glycine max
  Peptide Sequence Number=SeqID_110482
gtcgactctagaggatcccccgaaggacgctgccgacacccaatttgccgttgaccaactggccaaggggctcgaccgtctcgccgatggtgatatcgcgtatcgcatcgagacaccgtttgttgcccatctcgatactctgcgcaacaacttcaatggctcggtcgcgaatctgaatgacgcgttgcgcgccgtcggcgagaacgctcgcggcatcgatgccggtgccaacgaaattcgctctgccgccgacgacctgtccaagcgcactgagcagcaggctgcctcagtcgaagaaacagccgccgctctggaggaaatcaccacgaccgtgaaggacagcagcaaccgcgccgaagaagtcggccatctggtcgcgagggcccgtgatggtgcggaaaagtccggagcagtcgtacgtcaggccgttaccgccatgaacgaaatcgaacgttcatccggtgaaattaccaacatcatcagcgttattgatgaaattgccttccagaccaatcttctggctttgaatgcaggcgttgaggccgcccgcgccggcgaggccggcaagggctttgcggtcgtcgcacaggaagtccgcgaacttgcccagcggtctgcaaaggctgcgaaagagatcaaggcattgatcacgacatccggtgaacacgttcgctccggcgtgacactggtgggtgaaaccggcagggcactcgaagtgatcgtcacggaagtgcaagagattaaccgtcacatcgccgcgattgtcgaatcctcgcgcgaacagtcggttggccttcaggaaatcaacacggccgtcaacaccatggaccagggcacacagcagaatgccgccatggtcgaacagtcgacagccgcaagccacagcctcgccaaggaggcggcatccctcaaccagctgctatcgcgtttcaatctagccgatggcacaagcacaagtcgttcgtctgtagcccctgcggcc

SEQ ID NO: 18798 - DNA, 366 bp, Glycine max
  Peptide Sequence Number=SeqID_110483
atgggacgagctgatccagtcagctgccaatgcaaaattacgcgaacgaatcttacactggacagaccgctccgcttacccaccccaaccatatacacatttactaaaatcaaaggaaggtttaagttctttgaaaaagtgtttgcagaagatggtgaccttaggagatattatgataacaatcacaaggaaggagatttttattgtttggtttgtgggggtattgggaacaaggtatggaagaggtttaaggattgtattggactaattcagcactccactgccatactaaggacaagaaggaagcgagctcacagggcctatgcacaagtcatctacaaagttgtaggttgggatatcgattaa

SEQ ID NO: 18799 - DNA, 357 bp, Glycine max
  Peptide Sequence Number=SeqID_110484
atgaaggaaggcataggtcacatcttagacctcactcccataggagagaaaatgaaagaaagcctcaagaggaagtctacttcaaaatcttatggctctcactcttatccaaagaaagaccaaggtcaaggaatcttaggggtgagaccttctaagcccaaagatgataaggggaagacaatagaaaagcaatcccttaaggctagtatgcaagagaagactaactccatgaagtgctttaaatgtcttggaagaggacacattacttctcaatgccccaccaagaaaaccatgattatgagggccaagacatttatagtagccaagatgaggctactacttcacttctctagtaaa

SEQ ID NO: 18800 - DNA, 662 bp, Glycine max
  Peptide Sequence Number=SeqID_110485
atgcctcgcttatcgttcattctgaccgtcgccatgctgagcgccttcgggctgatcgcgtcggacgtctatctgcccgccatgccaagcatggccagggaattcggcgtcgccgactggcagatgccgcagaccatctcgttctacctgctggctctggcaattgcccaattgacctacgggccgctgtcggatcgcaatggccgcaggcccgtgctgctagccggcatcggcctctacatcgtcgggtcggtgggctgtgccctttccgacagctacaacgggttcctggcttggcgcatgctggaagcggtcggcgcggctgcgggccttgtcgttggccgcgcgctgatcgctgacacctgcgacaagcgcgcctgcgccaaggtctatgcggtcatctaccctctggtgtcgctgtcgcctgcgctggcgccggccctaggcgggcacctggccgcggctttcggctggcgggctgatttccttttcgtcgtcgcgttcggtgtcgtcgcattgctgatggtgatgacgctgctaccggaaacgctccccgtcgccgcccgcacccggacctccccctttgcgggcttcagccatgttttgcgcgaccgcacttttcgccgctataccttggtggtctgcgcgatctattgcgcctg

SEQ ID NO: 18801 - DNA, 96 bp, Glycine max
  Peptide Sequence Number=SeqID_110486
atggagccaacaacttggtcgagcccagcaagtgcaccggatcgcgtatgtaaactaacaattaaaaaggaaaatcatgtgagtaatgatgtgtaa

SEQ ID NO: 18802 - DNA, 260 bp, Glycine max
  Peptide Sequence Number=SeqID_110487
atgaggctaagtcatgaagtgctaaaagtgacagttgagcttagctcatcattgtcttcagccaggctcagcgcacaactggcgctaagctcaaatccacttactcgcgctaagcgcgagggtagcgctaagcgcgagggtagcgctaagcacaatggtacaatgcccaaggcacaaaattccacggcacaccatagtgcctatttcgggaaaagagctctggagccagcaagaggagcagcttttggagagatacctag

SEQ ID NO: 18803 - DNA, 216 bp, Glycine max
  Peptide Sequence Number=SeqID_110488
atgcctcagcaacctatgctattctgtgaggtgtttgatgtttggggtttggagtacctaaagcaattgttagtgatcaaggaacccatttttgcaacaggacaatgcatgccctgcttaaaaagtacggggtggtgcacagggtatccacaccataccacccccagaccaatggacaggcagaaatttctaaccgggaaatcaagcgaattttag

SEQ ID NO: 18804 - DNA, 661 bp, Glycine max
  Peptide Sequence Number=SeqID_110489
cctcaatgcctttctagaaacacctgtggtgcttgctgagggtgaatctttgctcgcctactcaagatactgtaggatgcctactgacattagggaaattgaggctgcactgtgcatacccggccgagggtttattctaaatgctgaaggtcacccggggaggatcctcagaaaagatctaaccacccttgctcaggtctggagtgttctatcctactccaacctggctccgacctcccacacatcggatctgactgtggatcaagctaggcagattacttctatggcccagtctaactcctcaagactcgggtttcttgctcttatcacagctttatgcaggaccaaaggagttgcctccgacagtcttgtctttgaacgtctgaacccggtcattaatttgacctacataaggaagaattgttggaaccctgatgatccaacaattattattaggggggccagaagaccaagggcaaggccagctgaggctccttctacattagcagctcctcatctagcttctacatcagtagctcctccttcagctcgtattgcaatagctccttctaccctagctcctgcaaattttcaacgtttcgaagccatgcttcgaagcatacatcagggccagattattttgctgcagagtctccagctg

SEQ ID NO: 18805 - DNA, 501 bp, Glycine max
  Peptide Sequence Number=SeqID_110490
atgcagtctcagattcagtcgcagatgcaatctcagggacttgcactgcctctcgagcctcttgttggtccctccggaaacgatcatgagacgggtgactcagataggtgcagcttgtacatcaaagtagatcctgcccgcttggttgccctagggagagtttatgagggatccactgttgttcataacactcctttgttgcctgaccaagtaaaggcacttcacaccttccttgcttggccgacacatctggtcaagtctttatcacaacaggtagctgtgtctccggcaaaaccacctccaaagcccgatccggaggtcgatgatccgctttatctgatgacattgaccatcccaaagcttttcttgaggccttatcaggttacatgggatgccaccatgctcggggtctttaatccaaatttcccactctacataaagcatgaagacctctccgaaatcgcacacggtggtcaatgtcttagcatatcagtgttatag

SEQ ID NO: 18806 - DNA, 642 bp, Glycine max
  Peptide Sequence Number=SeqID_110491
atgtcccacaaagcccaaaattcatcatttttcattctctttcatctccaccaattaaaacttccaaaaacacctccaaatggcataaccattgaagaagtgaaaggggcttgcgacttcacccgcagtcactggaactcgaagccacggaacacccaaagcgcagacatctcaaattcctccctccatattatctcctatgttgttttcctcggaagaacaacgtatccgtttatctccatgaaacttcctttttaccctgaattggttaaatccttttattctaacttggaaattcaagaagataccttgattttcaaagtttatgggataaagatggtcatagaccagtcccttctctttgaactcactcaattatccaatgacagtgtaccatttgagggtacacttgatgatgagtggaagtttgatttttctgtgtctgatgcccgctggatggtttgcaccaaccaagtggatatgaccagaaggcttcttgccagttcattggcattcgaatgccgcatcatgcactacttgattgtgcacatcctactccctagatcttccaaccttgcacaggtttctgaggaagatttgataatcatgtgggttttcttaaccggtcgtcaaattgactag

SEQ ID NO: 18807 - DNA, 303 bp, Glycine max
  Peptide Sequence Number=SeqID_110492
atggggtccaagtggaccctgagaaaatcaaggccatctaagaatggcccactccaaaaagtgtgggagatattaggagcttccatggagcaagcctttgctttgctacaaaaaaagcttactaaggcacctgatctagctcttcctaacgtttctaaaacttttgagctagaatgtgatgcctctggagtgggaattggagtttattgttacaaggtgggcaccctattgcttattttagtgaaaaacttcatagtgccaccctcaactaccccacctatgataaagagctttatgccttaa

SEQ ID NO: 18808 - DNA, 693 bp, Glycine max
  Peptide Sequence Number=SeqID_110493
atggacaagaaaatccgcagtattgtgagtagcattttgaaagacgcctctgttcctgatgctgagaaagatgttccaacatcttccaccctgaatgtttctgtgcctgatgttgagaaagatgttccaacatcttccgctccaaatgctgaagtcctcccttcacccagtgaagaggaatcatcagaggaagaagatcaagccacagaggagacccctgcaccaagggcaccagaacctgcaccaagggcaccagaacctgctccaggtgacctcattgatctagaagaggtagaatctgatgaggaacccattgccaacaggttggcacctggcattgctgaaaggttacaaagcagaaagggaaaaactcccattaagaggtctggacgaatcaagactatggcccagaagaaaagcactccaatcactcctacctcatccagacgaagcaaagtcacaattccttccaagaagaggaaagaaatttcctcatctgattctgatgatgatgtcgaactagatgtctcgacatcaaagaaggccaagaaatctgggaaaaaggtgcctggaaatgttcctgatgcaccattggacaacatctctttccactccattggaaatgttgaaaagtggaaatatgtgtatcaacgcagacttgcggttgaaagagaactgggaagagatgcctga

SEQ ID NO: 18809 - DNA, 465 bp, Glycine max
  Peptide Sequence Number=SeqID_110494
atggctacctcaccaaaagaaacttcagctcctggttcaccctctgtaccatcatctccgcaccaggaacaaccagaattcaacatccaacccatacaaataattcctggtcaagcttctgtccctgagaaactggttcccagaagacaacagggagtgaagattgctgaacaccctagccttgcaacaagtcctagggaagtagacacggagatggacaagaaaatccgcagtattgtgagtagcattttgaaagacgcctctgttcctgatgctgagaaagatgttccaacatcctccaccccagatgttgctgtccctgaagctgatgaagatgtcccaacatcttccaccccaaatgtttctgtgcctgatgctgagaaagatgttccgacatcttccgctccaaatgctgaagcccttccttcacccagtgaagaggaatcaacagaagaagaagattaa

SEQ ID NO: 18810 - DNA, 579 bp, Glycine max
  Peptide Sequence Number=SeqID_110495
atgtcctcaccttcagaggactacacgtcctcgccatcagaggactccacgtccttgccttcagaggactacacatcctcaccttcagagggctacgcgccctcaccttcagagggctacatgtcctcgccatcaaaggactttatatcctcaccttcaaaggactacacatcctcgccgtcagaggattacaagtcctcaccatcagaggacttcacgtcctcaccttcaaaggactactcgtcctcgccgtcagaggactacacatcctcaccttcagagggctacgcaccctcgccttcagagggctgcatgtcctcaccattagaggattacaagtcctcaccatcagaggactttacgtcctcaccttcagaggactacacgtcctcgccgtcagaggattacaaaggactactcgtcctcgccattagaggactacacgtcctcaccttcagaaggctacacgcccttgcctttagagggcgacacgtcctcgcctttggagggctacacactccctcgcctttagagggctacgcgccctcgcttttagagggctccacatctgcaccttaa

SEQ ID NO: 18811 - DNA, 213 bp, Glycine max
  Peptide Sequence Number=SeqID_110496
atggttaggatcagagaagaagcttgtcgcaacctgcccttcggcaagagggcgatgcgtgactcacgggtgcgtgttccaagaaaggaatacgcgcggagtcgccaccaacgtttatttgaggaaagtgtcggaaaaaccggaaaagacgtgatctacgaattctttgtgaaagggtgtttccctttgctcctacgtattcctcaattgtga

SEQ ID NO: 18812 - DNA, 239 bp, Glycine max
  Peptide Sequence Number=SeqID_110497
atgctggcggcggcagctgtggctgcattactctctatcaatctttttatacctagtgtcgcaacctacctttcggcgggagggcgacgcgagactcacgggatgcgtgttccacgaaaggaatacgcgcgaagtcgccaccaacgtttatttgaggaaaacgtcggaaaaaccggaaaagacgcgatctacgaacttttaagtgaaaggttcgggagttgtatttacgcacggggaag

SEQ ID NO: 18813 - DNA, 129 bp, Glycine max
  Peptide Sequence Number=SeqID_110498
atgaagatgctcttgataccacatgatgtaagctccattggagcttcggaatccagaaggaagagagagaggagacgccacttcaaggagatgagtctagaagaagctcaccaccataggaggccatga

SEQ ID NO: 18814 - DNA, 498 bp, Glycine max
  Peptide Sequence Number=SeqID_110499
atggaaaaacgccagcaacgcggcctttttacggttctggccttttgctggccttttgctcacatgttctttctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccattcctaaaacaatcctctgagttaatgttcaccggagagcatgttgttggagaggtcgttgccggcgaggtagttgccggagagggcgaggtactggaggtgttgcctggtgcggcactcaggagggatctggccgaagaagaagttgtcgtcgaggtgaaggtgacagaggaggaacatggcagcgacagagagaggaatttccaaattcaatcccataaagatagaatttga

SEQ ID NO: 18815 - DNA, 737 bp, Glycine max
  Peptide Sequence Number=SeqID_110500
ccgaactgtaatcattgtgatcaaaaggaaagaatgcgttttacggtgcccttaccaaacacgtgccaaagctagagtgatgagtgaaatagaggaggtgcaagagcagatgaaggccgacatggaggccatgaaagagcaaatgaccacaatgatggaagccgtgatgagtatgagaaaaatgatggaggtcaacacggctacagtcgttgttgcaagtactaccactgggttggacccgactcacccatctagcatcaagcaagcaagtcatccagtcccggatatgaacaagcattccttcccaccatatggcttgtctcccaactatacaccacccaatgttgtacacactcataacttcgctcccatacccattgagagccaacaaccccaatttggtcaggcacatgtctctcaacccatggaggagacacatgaagcaccccgagaccataatctagtcaacttcgagcctcacctcggatatgccgctgaggggcaggcgttttgcagcgtacccttgacaaacactttagggggccctcagtatcgcccacaaccacaaaccttgcattttgaggtgggaagagccccttctgctatggtggaaagggagagatttgatcatatagaggagaggctgagggctattgaaggaggcggagattatgcctttgctgacatggcagaactatgcctagtgcccgacgtcgttatcctctccgaagttcaag

SEQ ID NO: 18816 - DNA, 560 bp, Glycine max
  Peptide Sequence Number=SeqID_110501
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctaccgattacaaaataaaatcaatcggaggcatgtgcatcttaatccaaatgtgggcatgggaacgatgcacgactttggctccaaagaggactcctcccgtgatccaaaataagccactcggacacaggtggttgcaacgtggaaatcagcatattgagaatgatgatctgattgtatttcgtcgcaagttggatatcatgaaaagacatgagtttctgtgggagccttacacagcaactgttatgtcgtcgttgcctccgatatgtttggttggtagcgtagc

SEQ ID NO: 18817 - DNA, 657 bp, Glycine max
  Peptide Sequence Number=SeqID_110502
atgggagagctcacgagcacgctggacgacgtctcctcgattctacatctgcccgtggttggtgacttgcacgtctttcagcccttgcacgtggatgatgcggttcagatgctggtggacttattgatggtctctgcagagactgccagggctaagacagggcagtgtcatggaccgtacgtccttcgtgacctcagtcagaccgggaggtatgcttggggagtgactactttggtgcatatgtacgaccagctgaacgatgcctctatcagcagcagtcgacaacttgacggttacatcacactgctgcagtgctggatttacgagcactctccctcagtcgcggagtccactgctgatcaggactacgacgaggattccccgcgtgcatgtaggtattgcaacgaagaagaccgtgaagagcatacgtatagtgtcgtacagggagcgcctggatcgactccggattccggatgtctgttggatcctatatggggagcactgaccggtccgggacttgcatttgatttcatgctattctggtctcctgccctggggtcctgttgttgtttattaccgaccagagagggtcgtgcggtagtttggatacacacagaccattcctgctccgcctgtcgattcatgggtgtcatatga

SEQ ID NO: 18818 - DNA, 165 bp, Glycine max
  Peptide Sequence Number=SeqID_110503
atggagatggcgggacaggtgagagcggtaccgccaacagtggttgcgggacagggggagagagagtgtgtgggtaccgccaacagtggttgcgggacagggggagagagaggcttgtacgtttttctgaaaagcctgcacacctatgttcacgtgaatgaatga

SEQ ID NO: 18819 - DNA, 670 bp, Glycine max
  Peptide Sequence Number=SeqID_110504
ggcctcggcattgttgacgttcaactgcaccggcagcgactgcgagaactcgccgtgtttttcgtggcgaaagcgccagctcgagccgttgcgcgcatacatgtattgcagcgcggatgcgcaccgagcacaggcgccgcgccagcagtgtcgagtcgaccaggttggagatgcgcagcgccaggtcgaagcgttcggacaccaggtgcgtgacgccgaacgacatgggcgcggccaggcggatcttgccgcgcaggctggtggacttttccgtgacctcggcctcgaccgcttcgccttcttcgaggatgcgggcggcgcgctccagcgcggcgtagccggattcggtcagggacatgctgcgcgaggtgcggtgaaacagcatggtcttcatcttggtttccagccgcgtgatggtcttggaccgtggcctgggacaaggacaatcgcccagccttccagatccggcagtttgttcatgatgattctcgcaaagaaagtggcgtggatgatagcggctggttatgtgacgaacaagaacgcccggggaaggccgggccggaaacaaccgggtcatggggatcatgcaaaaaatggaaaggatgcaattccccgttgcggattgtcaggcgaagggcggatccataatatgcccataccgacagacgac

SEQ ID NO: 18820 - DNA, 1141 bp, Glycine max
  Peptide Sequence Number=SeqID_110505
ccgacatcctcggagccgcgtacgccgcggccgtgctgtccgcgctgcgtgtctgggccgagcggggcgccgggcgggggacgccggagacggtgctgcaggaagcgctgggtctgatccacgatctgccctgggctggatccattggacgacctgctggacgcatcggcaccgccgcgtgccacgatccaggccgccgatacgcgtgcgatgctcgccgaggccaaggccgtagcgcggccccgggcgagggtctcgcgagcggcggtgttgagcggatcgctcggtctcctgctcggctggacaaccccgatcgcagctacacctacacgtcgccgacatgggggcagtgcgagatccgctacagcggctgggacacgcacaatccactcacgcagccgcaggtcgaccggatcatcgacgactggttcgcgaacacggatgtggaggcggccgcggcgccgtacgtggcggaacacctcgctgcgatcgagtccgatcaggccgcatcggacgagccgactgcggatccgcgcacgcccgacctgaatgcgtggttcgcgcatgatcaggccctctccgaagcgctccacgaggaactcaaggcgaacggcatcgacaccggacgcgggtggcacgccgtgagccgacgctcggaggatgctgcgctcatcgctgccgtcgaggcgagcgcgaccgatctgctcgcgtacctctcgcgtcgggtcggcccggacgacgccgcagatctcctcggcgagacgatggtcatcgcctggcgacgtgtgcgacggctccctggcgaccccgagggcgcgcggatgtggttgttcggtgtcgcgcgtggaaccttgctcaaccacgcgcgtggagaacggcggcgctgggcgctcgctgaccgcatccgctcccgctcggcggaggggctgacatccgctcccgccgacgcaggagcggaggtcagggatgccatcgcgcgcctcgatcccgttctcgccgagctcgtacggttggtgcactgggatggcttctccctgacggatgcagcacggctgctgggcattccggcctcgaccgcgcgggggcggtatcagaaagcgaagccgagctcgcgctgcgctgagcatggaggctcgctcgc

SEQ ID NO: 18821 - DNA, 315 bp, Glycine max
  Peptide Sequence Number=SeqID_110506
atgcctaagaaaaagggcaagtatggggaaggaatgaatgaaaaagtgaaggttattctatggatgaatgctctcctagaacctaagcttttgaatcctagaaaaaccattaattgttggcagcctaaccccattacaagcctagaaagtccttcggatttttcatttttaaccatttccataggatttgatgataaaatctatccatcagaaaaagaggctaagccaaatttgtcccaaatttgggggaggtattatcaaggtatgaaagctaagtgcttaagaaaaagggcagtttggaggaggaatgaatga

SEQ ID NO: 18822 - DNA, 720 bp, Glycine max
  Peptide Sequence Number=SeqID_110507
ggaagcggaaccgtgctacaacccgcaataaacttgggccgagacagaaacacgacgggtttcaatcgaaggtatagtcctcaagcctacccttatggtttgcctccagacttcattccccgtaccggtctagacgatttgagccaagtccctaccttcgaggggcagctccctcctcatgccgactatcctctgcaggaagatgatgaaggagatgcccatttaggccctctacttcccctcaaggaaccggccccccatgagttgccccaaccaaacatagtccgccacgtcccgtctccatccacacccgttaaagaactcattcccattgcaaaagacaagggaaagattgatctacttgaagagaggctgagagcggtagaaggcctcggcaactattcgttctcggatttagcggatctgtgtctggtggagagacctacagcccaagtcgtcccacctaagactgaaagggaaatgatcacgattatggtagatacgttgcctacgttctactacgagaagctgataggatatatgccggctaactttgcagacctcgtcttcaccggagaaagaatcgagtccggactgcggaaaggcaagtttgaatatgcctccaacgctgcccaaacaacaatagaagagcctcagtggtgggcacacggaaaaaggaaggagatacccacgcggtcaccaccgccccaacatggatga

SEQ ID NO: 18823 - DNA, 351 bp, Glycine max
  Peptide Sequence Number=SeqID_110508
atgtgtttgtgctattgccaccacttatttgccaaagcaattatcaattctttatatgttttgggtattcctttaattaggtatgcagcagaagatagatgtggagtggttgttaaaggagcaaatcagagtggaaatatagcaggaacatgcccattgaaggacaacgacattcttttgacaacaagagctttggatgattccaatgaagtaagaaacacaattgctgttgtgaatgagttgtccaaggaaatgagacaaattttgctttctcatcctgcgaatcctaaatgtgctccaggaggaaagaacatagcaagtgtagtccttttaggagactctggcatttga

SEQ ID NO: 18824 - DNA, 204 bp, Glycine max
  Peptide Sequence Number=SeqID_110509
atgcagctccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 18825 - DNA, 65 bp, Glycine max
  Peptide Sequence Number=SeqID_110510
atataaaaactggaggtgtaacaagcaaaaaggctagaaaaattgaagaaaagaagaaaatctga

SEQ ID NO: 18826 - DNA, 419 bp, Glycine max
  Peptide Sequence Number=SeqID_110511
atgtcattgcctagcgctgttcatgtgttctccattatcaagtgtgaagcttctgatgactgggaagcacgttattctgttgttttccagatcggttccttcgccaagtataagaaaaaagaagaagtagagatgacagtcgtcatcgcgaaaagggcaggacggacgaaatcagtgtcctatctttgctttcctcttatctccgatgagagtcccgagatgtctcagaaatctaaaggaagcaggcttgcacgatccgtgaaattccgtaatgtggcggaagtcgaaaagaggggggtgcaaatagcaaccaggcccacttgggccctccagaagattcctccagaaggttgttgcttctggaggaagcaaccttggtcgcctgggcgagctgggcggcaagcttctccgctattttg

SEQ ID NO: 18827 - DNA, 114 bp, Glycine max
  Peptide Sequence Number=SeqID_110512
atgaattggcagaataatgagtataagggttgtggtggtggaggaggtgaagaggaaaacctagtaccgaattacacaacctatgagaattcatttgctgaggagtatccttaa

SEQ ID NO: 18828 - DNA, 332 bp, Glycine max
  Peptide Sequence Number=SeqID_110513
gaggaggcaacccagctcgcctgggagagctgagcgacaacctcctccccccttttcctataaataggcaaagggaggctgttccaaatggttttccaccgttcttcaccgttcttcatccgttctttgttcgttcttcgtttttcaaccgtagtttccttttatcagctcctgggctagcccctgatcctggaggagggccatctatgcgagagcaaccagaggaggaggctattgcacaactactatgcataccgggacaagatttcacccgtgccgcagcaaagagacgagtgcagatcatgcacaccaacatgatcactcttacatag

SEQ ID NO: 18829 - DNA, 99 bp, Glycine max
  Peptide Sequence Number=SeqID_110514
gtgaaaagatgaagaataagaaggttgcagtagctagtgtctcgctcaacgaggtatatgcgcttagcgagcaacatccactaagcaaggcattggctc

SEQ ID NO: 18830 - DNA, 405 bp, Glycine max
  Peptide Sequence Number=SeqID_110515
atggatgatcccacaatcacttttccagggacccctccaccaccatcagcatcagttccagcaccctccggcacctccgctcaaagctcagagctcacagtgccaatgttgcagagcctccaccatggcttatgcctggtgatgcagagtattcataatctggctcagcatcggcccattatcagcatggaggactttacagctcaggtggcctggctaggagtccagccttctcctttggggggaagtgaggcttccgcagctcaagagcctcagccacagccggaggccactccagagactactccacggttcaccagtcactacaccggtcttggaggtctcagaggaggaggatggcgctgcagacacagattatgcagcagacatggcagcagcacatag

SEQ ID NO: 18831 - DNA, 180 bp, Glycine max
  Peptide Sequence Number=SeqID_110516
atgaggctactacttcaccttcctctagtgaaagtgaagacgcaaaaggggaagaatatagtgaagaaatctacccacaagaagaaggacaacctgaaatggttaaggaggagtgtaagaaggagaattataagcaattgggcttggatccggaattgggctgaaccggcttggacttga

SEQ ID NO: 18832 - DNA, 738 bp, Glycine max
  Peptide Sequence Number=SeqID_110517
atgacacccgtgcgtaaatacaactcccgaacctttcacttaaaagttcgtagatcgcgtcttttccggtttttccgacgttttcctcaaataaacgttggtggcaactccgcgcgtattcctttcgtggaacacgcctcccgcgagtctcgcgtcgccctcccgccgaaggggttaatggacctagcagtgattgatgctttcctttcctttcaccatggcaaggaaagcccagtcgtcggcattttgaccgacatgtatgatacgttcgaccagagatgtgaaaagagtggcgcaagaattatttgttgtacatcgactctctatgtgtggctggtttcacacctttttcgccacgaaggtaggcctgtctgttcgctacaaggttattgctcgtgcgccgagaaaggaaaggcgaattgggaccaactcctggctagcatggagggggcgtccgttaattggttccctcgctggaaggaaggaagaaccgagaatctgtcttcgtgcgaaggatttcaaaatcttggctaccccatgagaggagcaccatcggaggaaagcattgtgcctttcatcgcatggggtttcaatgaccccaacgcaagggtacttcaaggagttcgcaaggcatgggatgcggtgccaaggatggacaaagagcttaggggaaatagtaatgggatcatcggcggctatcgtaagtggctgagagtccacacacgaggcttggattag

SEQ ID NO: 18833 - DNA, 207 bp, Glycine max
  Peptide Sequence Number=SeqID_110518
atgttctgtttgttccagcatatcacaagatgtttctactctacagtagttggaggattgagatgctatgagaatccaaagaataagattactgcaatacgtgctgaggaagagaaaatctggggttcattcttcaaggtaatcttagagcttaagaagttagacttgaatatccattacgtaactaggattgccagttgcaactaa

SEQ ID NO: 18834 - DNA, 189 bp, Glycine max
  Peptide Sequence Number=SeqID_110519
gttgttaggagaagtgcatggaacgtctgcaaactcttgacatcttcggcatctcttggtaaagttgagggtgtctatcctaagtgttggctagtagtggccaaggagcgtcctctgcttgtcatcaaggatggcatagtaattggccttacatttgaggtgttgggcttcgtcctcatttggcgatag

SEQ ID NO: 18835 - DNA, 225 bp, Glycine max
  Peptide Sequence Number=SeqID_110520
atgaatagcatgaaaaatggtattaagggtgctactggcactaatactaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18836 - DNA, 81 bp, Glycine max
  Peptide Sequence Number=SeqID_110521
ggtagagaatggagaattgcactaagcaatcactacgcatggctccaaactcgtgggtggaggatgcatgaacgggaaaac

SEQ ID NO: 18837 - DNA, 447 bp, Glycine max
  Peptide Sequence Number=SeqID_110522
gtcgactctagaggatccccgggaagcagtaatgggatcatcagcggctatcataagtggctgagagtccgaacacaaggattggattggctcccaaatctaaatactgtgagagacgatgaggttaaagcttcggaagaaagtgatgaggtacaagccctaaaggcagtgcttgaaagagcccgggtagtcgaagagaagttcaagtccatagccatcaaagccatcatcgataagtgcaaagagaagctaaatctagcggcgactcacgagcaaaggctagaggatgagtacgccaagatatcagcagaaagggaagagtcaagaacttccccgatttctagccaaggccaaagcaatggcggacacctactccgcccccaaggagatccacggacttctctgctattgtcagcatatgatagacttaatggaccatatgattag

SEQ ID NO: 18838 - DNA, 306 bp, Glycine max
  Peptide Sequence Number=SeqID_110523
atggctacacagtcaaactctcctccgcctcctcctccttctactggtgtagcatcgcattcgtcgtcaccaccattgaagcggactagaaaggcctcacgcctaagattattggcgactagaccagttggggcagagagaccccttgtccatgtggatcctgttactggcaaaacagacggtccccacagcaagaaatttagaacatatttagggatcgttgctcgtgataaggtggatgtcacatacgaaaattggaagcatgtccctattactcagaaggatttgatatgggaggatattcag

SEQ ID NO: 18839 - DNA, 510 bp, Glycine max
  Peptide Sequence Number=SeqID_110524
atggaaaaaggtaatgttggaggaaacagaggtggtccaattagaagttatagttcctcaagaactgtaacatgggatctaggaaacaaaggcaccacggcaaaaacaagagagacgaattcgagctcggaatcaaatagtgtgaagtccactggggcatacagaggtaggccttttagtaggctttcaaatgcggagttccaggagagggtagaaaaaggactttgttaccgttgtgatgggaaatttggccttggtcatatatgccccaataaccaattccaagaccttattttgggagaaggacaagatggagaagacgaaaaagaagaaggggcaagaaatgagaaacaactgcagatagtgaaacaacagcaaataccaatcacacctactaaaccgtatactgtggaagtaggggatggacgaaaaatcagtgtgaaggagtctgcaagaattttaaattgcagatccaaggcatggaaatccagcagacttatttgtctttga

SEQ ID NO: 18840 - DNA, 345 bp, Glycine max
  Peptide Sequence Number=SeqID_110525
atgaccaaaatacaaggcctaaaagaagaaaaaatctattctaatatttacaaagaagagaggactcaaccttggtccacgggctcagaaatctaccctgggattcatgagaaccccaaggccttctttagaagctctagcccaatcctcttggagtcttctatccaatacccttgcggggtaggattgcatcataacttttcactcggatgtccgattctggcacatcacatatcgagaatctcgaaattgaacaacggaagctctcgagaaattcaaatgatcataacttttaactcggatgtccgattcaggcgcatcccatatcgagacgctcgaaattga

SEQ ID NO: 18841 - DNA, 420 bp, Glycine max
  Peptide Sequence Number=SeqID_110526
atggcgcagcccaaaccaagtgctggcctaagggaaaacctcaccaacatgctctcactcatcatgccttcttgtatttcaataaacaaaagcttgagccccctaatcctaagtcatgttttggcatttaacctagttcttgcaagctgtccgcatccaaaaaatggcaaaaataccattaaggcatttcaccgagcacttggtgggcgcacttttgggtaccaacaacaagagaatgggggcaatgtggcttgccccatcatcttagaacacaacctaggcctaaggccatcccctacaacccctcaattcaaaaaagcaaagcataaatttgccccaaattgtctcacagaattggtcaaattatgtaccattcaaagcataaaaggcatcaatggaaagctagaaaccaaagggtag

SEQ ID NO: 18842 - DNA, 654 bp, Glycine max
  Peptide Sequence Number=SeqID_110527
atgtgtttgatgcatgccacattggaagaacaaacgagacagggtacctttgtcccctatggtcgtgaagacatactgagcactgccatcaggcgaccggatcatggaggccgtgctcgggcagcggggtctggggtcacaataagtcaatactttggaagggcagcacgtggctccagctgctcatcagggttgatcagccaagtacaattggatgaaataattggaggcttacaggaacagtggaaaaatgaaatactggtattgaaagatgagttgaaggaacaaatcatacttgagatgtcgcagaggggatcgttgatcccaacacatattcagctagatacacatgtgttaggagcacgagtgagcacaaaagggagcaatgcggagattgttgtcaacccatgtctgcctaatgatgttgctcctgtcaaaccccctatggggttgtatgtgcagcgccaagattcaattgagttggtggccttgggaaaaacatatgacagaggctcgaccatacacaatgtggcttatgcagacgatgtcataagggttagtgttgagcaagttattgacggtgacgctgaggtcccattcccgacattagagattaagtgtgtcaggcaggcccttcacacattcattgcatga

SEQ ID NO: 18843 - DNA, 354 bp, Glycine max
  Peptide Sequence Number=SeqID_110528
atgcaaccatatattgcagcactgaaattttgtcacttgactgggaatgtaaatcagaccgcttgtgtattggacataaagtgcagtcctgtggaacctatttttgtgtctgcagcagcatctggaggggctggttctaactatattgacaacctgggttttgcttcacttactgtgtggaacatgaagacatggaaagccatgacagtccttcctcttggagaagatccaccagcaattacttctctatgctttaatcacaatggaaagattttggcagcttctgccgttgatggaatgattcacatgtttggtatccttaattttgttcatttgattgtttccttggtttga

SEQ ID NO: 18844 - DNA, 576 bp, Glycine max
  Peptide Sequence Number=SeqID_110529
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgggagggcaacacgagactcacgggagcatcttccaaggaaggggtaccgagctcgaattcgtaatcatggtcatagctgtttcctgtgtgaaattgttatccgctcacaattccacacaacatacgagccggaagcataaagtgtaa

SEQ ID NO: 18845 - DNA, 274 bp, Glycine max
  Peptide Sequence Number=SeqID_110530
atgaacgaagatcaatgggcatattacagtgcgatgtccgaagaagttgatatggattttcaagatgaagaagattgtggtgtgaatgaagcacatgttgattgttcagatgcttttaattcttctcaggtctttgcaacccgagaagatgttttgaagtgggctcgaacagttgcccatgaaaacggttttgttgcagtaattatgaggtctgatacatatactggtaacagaggaagaactttatttgtgttaattgggtgtgaaaggagcg

SEQ ID NO: 18846 - DNA, 243 bp, Glycine max
  Peptide Sequence Number=SeqID_110531
atggtcgatacgctcgccactttagcgtccatgttccagctgacaccgcacggagacctaccatacattgagttcaggtgtcacggcaggcccacatattgttgtttggtaaaggaggagcaaaatgggcccttcgtggtaaaaaaggctttctccggagaggcccttgtgctcactaacatggatgacgaggaactaccttcacccgtaaatgccaatgtcgtcaagcgatactacgcttga

SEQ ID NO: 18847 - DNA, 129 bp, Glycine max
  Peptide Sequence Number=SeqID_110532
atgccctcctttcgcgatttggagcagaaatgggcaccaaaggttgaagctttgttgggcaacaatggtggaggaagaaaagagaaagctactttctctgcgtccgtcggggccagttttcgaaagtaa

SEQ ID NO: 18848 - DNA, 645 bp, Glycine max
  Peptide Sequence Number=SeqID_110533
atgttccaagaggacggtccaaacgtaaagacaaaccctcttgctattcatgggggaccagcagttaatgcggtggaggagtgtggacctcggaggccgaagcaaatgaaagtggtaacctctaggaggtttatattgaagacgttgtgtgaggtgggcatcatttgctttgacgggggcaagggggatacttgcttcatacagtcgggggcagcgcacgaagtagagacatgccctgtggcagaggatttactgcaagggataatggatcaaggtcgatttgaagttggtggcacaagcaagggggagcaacatgtgtgcatgcaatcggttgacaaaagcccgagtaagcccaaaccattggtgattcacttcactagagatgctgccacccaaaagcctcaaggcttccaacctatcccgggtaagaagcctatccatttcccttacaagagtgacaaggcggtcccatggaggtatgcccctcaaaagcccgacggaaggaaggacgaatccattggagatgacctatcctctaccaaggttaccaacatctctggcatgagcagtatgacccgtagtgggcaaatcttcgtggcacccgacccgttggtgcagtctaaggacacaaagggaaaggcgaag

SEQ ID NO: 18849 - DNA, 523 bp, Glycine max
  Peptide Sequence Number=SeqID_110534
gggggcggagctatggaaaaacgccagcaacgcggcctttttacggttctggccttttgctggcttttgctcacatgttctttctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtacccctttgtgacaaagacaaggggctgtggtgggtggagggagatactctcaaaacaggaagccaacaaatgggatctgtaacaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18850 - DNA, 612 bp, Glycine max
  Peptide Sequence Number=SeqID_110535
atgaaatcatccataaacacctctatgcaattttctaaaaaatcactaaaaatactgatcatgcacctctggaaggtaccaggggcattgcacggtataggcaaaagtgccaaaggggcaggtgaatgtggtcttttcctgatcctcaggagcaatagtgattttcatataaccagaaaaaccatcaaggaaacaatagtgagatttacctgccaggcgttcaagcatatggtcaatgaatggcaagggaaaatggtcctttttggtaacctagttcagcctcctataatcgatgcagactctctaactgttctgcacccgagtaggaatcaactcctccttctcattttttatgaaggtaaggccggttttcttcgggactaccgggacgagactcacccattggctatcggagatacgataaatgattccaacttgcagaagcttggttacctccttcttcactacatcaagaatcaccgggctgttggatctgttttcctctttccctgcatggctatttatagaaaaagccatttagtgcaaggaaaactcgctcaagcaagctgcttgcttagggctgaagcttgcccaggcgaatggcttgcttag

SEQ ID NO: 18851 - DNA, 748 bp, Glycine max
  Peptide Sequence Number=SeqID_110536
atggaggagacacatggaatgccccaccgcaatctagccgacttcgagccttgcctcggatatgccactgaagggcaagcagttggtggtatacccctgcaaaacactttggagggccctcagtgtcacccacaaccacagccctcacattccacagtggttaaaaaccccccatgctatggcaaaaatgggaaagaggaaaggctcagggccattgaaggaggtaaagattatgcctttgctaacctagaagagttgttcctagtacccaatatcatcacccctcccaagttcaaggtgctggactttgacaagtacaaggggactacttgccccaagaaccatccaaagattatcggtactattctgatatggttccggataggatgcaactacagaacatgtgcaaaaagggagacgataatcgtgatggtagacacattatcagtattctactatggaaaatggtgggctacgcaccttcaaagctttgaggatttggtcttcgccagtgaaaggatcgatgtgggtccgaaaagaggcaaatttgatcatcctactaggacgactgagaaaactggggcaaataaagagggtgagaaagagggagaaacccatgctgtgactgccattcctatacagccaagtttcccaccaacccaacaatgtcattactcagccaataaccacccttctccttacccaccacccagttatccacaatggccatccctaaatcaaccacaag

SEQ ID NO: 18852 - DNA, 90 bp, Glycine max
  Peptide Sequence Number=SeqID_110537
gagaccataaatttacatggaaatgatagttctttctgggctacacaactattaatggtagtgtcgtctactgactgggtctcgaattag

SEQ ID NO: 18853 - DNA, 566 bp, Glycine max
  Peptide Sequence Number=SeqID_110538
aaaaaacttttctctcccaaaaacttcttaaagcagttgaaaagtgggaagaagacaagaagtgccaaggacaaagtttcgtaaataatgaaacagattctgatgacaccgataaaggcgatgaatatatttttagacaaaagttattctcaacaatagataaggaaaattcagatacagatagtactgaagatttacttgagaagattgatttacaagaattttacgaaaaagaaatcaacttcaataatgcattagaaattaattccaagattgatgaaacaaaatcattggtttcttttcctaaatcttacaaaggtctcatggctgatgcttttggtactagttcaaattttaccccacaatttgattatagtatggaagattaccagatgaggttcgctccccgtgaaaaaattatcgctcctgaagacttagccctaggagataatataaaatccaaagggaaaaggttgcccattgaaccaacattcaatatgtcgtctctcctattaaacataggaagtgttaaccctcaactacttccaaattacatagaacaatga

SEQ ID NO: 18854 - DNA, 609 bp, Glycine max
  Peptide Sequence Number=SeqID_110539
atgatcgcgatcgcgatcctcgccgtggtcgcgattctcgcgtggcgcgggctcgaccagatcatgcgcggtcgcgacaaggtcgcgtccgcgatggaagacgagcgcgtgttcgcgcagatgttcgaccagatgcgcatcgacgcgcggcgcgccgcgaccgacgacgaagccggccagcccgcgatcggcgtcgccggcaacacgctgcagatcgttcgcgagttcgacgtgccgggcgcggcgccgcggctgcaggtggtccgctaccggatcgccggcgggcgcgtcgtgcggtatgcgtcgccgccgatcgacgatgcgaaccggctgcacgacgtgctgaaggacagcagcgtcgacggctggagccgggtggcgttgatgggcggcgtcggcgcgatcgacgcgaagctgtacgtgccgcgcgtgggctggaccaccaacctgcagacggccaacgacgcgctcgcgcagaacaacgatgcgctgaaggtgccgcagatcggcaacgcgccgccggcgcgcgcggtgacggggctgcaggtcagcatcggcgcgacgtcgctgcgcgtgcccgtcacgcgcatctttctcgtcggggaatga

SEQ ID NO: 18855 - DNA, 264 bp, Glycine max
  Peptide Sequence Number=SeqID_110540
atgtctcaagatcacaaagttgaagaagatgtcaccatcattcgtgactgccttgatttactccgccaccaccatcagattgtcatcatcaaaaagggggagattgtggaagcaatgacttccaaggttattttgatgatgccaaagaatcatgagctaagcaaattccacagattcaagaatcaagtttcaagaatcaagattcaagaattcaagattcaagaattcaagaatcaagtttcaagaatcaagattcaagaataa

SEQ ID NO: 18856 - DNA, 287 bp, Glycine max
  Peptide Sequence Number=SeqID_110541
atggggaaagaaaaacagacggcggagacttccggaagacccgttaggggttcttccggaagttccggaagaacattttccggaaagtttcctcgcagaagcggtagtgcgcgtcttcccgaattcttcccgatgaaccacttcttccggaagactcccggaaaaacctcttccgggaactttccggaagaagtggttcatccggaagaattccggaagacgcgcacttccggaagaagtttcaaatttccggaagacctttccggaagaaccccttcttccggaag

SEQ ID NO: 18857 - DNA, 510 bp, Glycine max
  Peptide Sequence Number=SeqID_110542
atgagtcatcattcatctagtgttaatggcgagggtactagtcataaggaccctctatctagaatcttagatgagttgagttccctcaagttatggaaagaaaaactagaaagaaaagaaaaaggaaaagagagagtagaaataaatcaagatgagagagaacaaataagaaaggaagaaagaagaaaaataatgaaagaaatgaaaagagaaaaacatgtttcctatagtagtcatgactcttgcaagagtttaagtgaagaacttagcaactattatagagggcaccatagttcacatactaaacatcattcccaaataaaagaaacggatagaaggcctcaagaggttaacattagcctcccatatttccatggaaaagataatgttgaggcctacttagattgggaaatgaaggttgaacaactctttgtttgtcatcatattaacgaagagagaaaagttccattggctacccatagctttcaagggtatgccctctattggtag

SEQ ID NO: 18858 - DNA, 156 bp, Glycine max
  Peptide Sequence Number=SeqID_110543
atgtgtaattggatgcattgcacattagctcaaattgcgatatccaatcagtggaagggctaccttgctaaaatctcttataaagcgcctgcagaatcctgcatgactgagaaaagatcgcacctctcgcacgcaagaggggtaaggcaattgtga

SEQ ID NO: 18859 - DNA, 348 bp, Glycine max
  Peptide Sequence Number=SeqID_110544
atgcccccgactgtccctgttaatcattactccgatcccgaaggccaacacaataggatcagaatcctgtggtgttatcccatgctaatgtatacagagcgtaggcttgctttgagcactctaatttcttcaaaaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 18860 - DNA, 351 bp, Glycine max
  Peptide Sequence Number=SeqID_110545
atggaggccatgatgagcatgaagaagataatggaggtcaatgcggctgcaatagccgctaccaacaccattgctaaggtgtacctgactcccccatatggccttaaccaaataaatccttcaacctcagatatggtaggtttggaaggcgaagagttggaaggtacgggcggccctcatttagtgcgaaaaacaagtatgccttcccaccatatggcttgcctcccaactatacaccacccaatgtggcgtacactcccaatgaggatgtcaatgactccgctcccatactcattgagagccgacaacctcatcatgtacatgtctctcaacccatggggagacacatga

SEQ ID NO: 18861 - DNA, 420 bp, Glycine max
  Peptide Sequence Number=SeqID_110546
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaacttctttttacaagaaagcatctggatggaagcctcatcattctcctacgcctctcggtagcccttttaccatctcttctgattctgaagactctagtgatgagttcctaaggaagcttgatgaagaagctgccaaacaacgggggagaaaaatgtaa

SEQ ID NO: 18862 - DNA, 660 bp, Glycine max
  Peptide Sequence Number=SeqID_110547
atggttactgctaatcgcttttggtcccaaatctttggggttgctttttccaataaacgttggttacatttctttatgttatttgtaccagtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaaggtttaattttacttccccatctagctactctaggttggggggtaggtcctgggggggaagttatagacacctttccatactttgtgtctggagtacttcacttaatttcctctgcagtattgggctttggcggtatttatcatgcacttttgggacctgagactcttgaagaatcttttccattcttcggttag

SEQ ID NO: 18863 - DNA, 285 bp, Glycine max
  Peptide Sequence Number=SeqID_110548
atgggatcaagtttagcatatgacaacggaatttggggtgaaccctacaggctttttgctgcaaaattcctttttgttggtgtttttttggcttgtgctaaagggatagcctttgtggataactgggtggtgggtaaggaggaggtttgttattggctgagtaaagatattgttgggtttggtgggaaacttggccgcacaggaatggcagtcacagcatgggtttctccctcatcctcaccctctttatttgccccagttttctcagtcgtcctagtaggatga

SEQ ID NO: 18864 - DNA, 468 bp, Glycine max
  Peptide Sequence Number=SeqID_110549
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccccatggtcataaggacatactaaacactagcatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 18865 - DNA, 145 bp, Glycine max
  Peptide Sequence Number=SeqID_110550
tcctttcactaagcgcaagcctcgcgctaagcgcatccctgttcatgagctaagccacgagtctcacacgcttagtgcccaacccttgcatctgaggctgattcattccgctaagctagccatggccaagctgagcctaatctaa

SEQ ID NO: 18866 - DNA, 348 bp, Glycine max
  Peptide Sequence Number=SeqID_110551
atgaattcgtggggctccagactcaatggtggaggaggcatgaacagtgctagccaaacaattcatggggccccagactcgatggtggaggatgcacgaacacgcttggcaatcaattcgtggggctccggacttgatggtggaggatgcatgaatgacaatcaattaatggggctccgaataagatttgatggtggaggatgcatgaatggcaatcaattaatggagctccgaataagatttaatggtggaggatgcacgaacagcgcttggcaatcaattcgtggggctacgaactcgatggtggaggatgcattaacgacaatcaattcatggggctccgaataa

SEQ ID NO: 18867 - DNA, 541 bp, Glycine max
  Peptide Sequence Number=SeqID_110552
atgacctctaaaataacgctgattttcgccgccgcgctgctgctggccgccatcctcatcttcgatctggtggtgatggctgccgaaatgccgcttgccgaaatcgcggcgacgctctggcgtggcgaggccgacacctatcagcagtcggtgcttctctatcagcaaatcccacgctcgctgattgccatctatgtcggcgccaccacggccgtcagcggctgcgtgctgcaggggcttgtccgcaatcccctcgcctcgcccgcaacgctggggctgaataccggggcgacgctttttgtgatcgccggcgcactggtgttcgatttctctcccgaggtgcaggggcttgcggcgcttgcgggcgccggtttcggctttgccgcctgcttttttgtcgcgcgcctcgccggacgatcgaacgatccgcgcgggtctgtcgctcattcttgccggtgcgctggtttcgatgctgctgatcggcgtgaccaatgccctgcttctctccaacccctcacaccgcgccgaattcctgatttgg

SEQ ID NO: 18868 - DNA, 181 bp, Glycine max
  Peptide Sequence Number=SeqID_110553
atgtcgaggcgctcctccactcgccaatttcctagtcggaaatcaggagggcatggtcgtaccaaatccgacccactcggagcatcatcttcacatattgcaacgacttggccttcgtcccctagacccgcgctcataaagctcctacttatatggcagggcgggcttccttcgtcttctt

SEQ ID NO: 18869 - DNA, 251 bp, Glycine max
  Peptide Sequence Number=SeqID_110554
tccaagtgatcgaggtgacgtcatctgaggaagaccctaaggaagacccagaggagctacctcctgagcctgctgtggatgctcttgactttctagagggtgatgaggacccactccttgaggtggattctcccgaggacgccatgtcggcatctgaggaagactctacggaggagagcggccctggagagatggcgactagtggaggctcttcatcataccgctacagtggatacctttgctctggatga

SEQ ID NO: 18870 - DNA, 507 bp, Glycine max
  Peptide Sequence Number=SeqID_110555
gacatttatagtagccaagatgaggctactacttcaccttcctctagtgaaagtgaagaagcaaaaggggaaaaatctagtgaagaaatctacccccaagaagaaggacaaccattagtggttaaagagaagtgtaaggaggtaagtgtctcctccaatagtttagctaagaaggaaactcattttacaataaagacaaacattaatgaaactttccctcttagacaacctccacattttctcttttgtaaaaagacacttgctagcattgccacacctcttgggcttgagtttattcctcaagtaaaaaagttgttggagtgggcccaaaatagtgatcaaggggttcccatgaaccctaaaagaataaaggtcattcttgagtggcccactccaccaagtgttgagggaaggagcccaaagtatgaagaacctcgggatttgaggtcaaatcctttccaaggtggagggaatgaggcaatcctaccccgcaagggcattgggtag

SEQ ID NO: 18871 - DNA, 162 bp, Glycine max
  Peptide Sequence Number=SeqID_110556
atgaaacaaaaggcgagcgaggcgaggctcatgggtgcgctttccaaaggaggaaagatgcgcggagtcaccaccagcgtttatttgtggaaaatgtcagaaaaaccgaaggaaaccggtcaaaatgaaaattctaagttcgggagttgtatttacgtttga

SEQ ID NO: 18872 - DNA, 412 bp, Glycine max
  Peptide Sequence Number=SeqID_110557
gtcgactctagaggatccccaggaataaccaattcgtggggcggttggaatatcacaggagggactataacgaatccgggtatttggagttacgaaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcagcttttgtcgttgctggaactatgtggtatggttcagcaacaacccctattgaattattcggtcctactcgttatcaatgggatcagggatactttcagcaagaaatatcgagagttggtgctggactagccgaaaatccaagtttatcagaagctg

SEQ ID NO: 18873 - DNA, 165 bp, Glycine max
  Peptide Sequence Number=SeqID_110558
atggagaattggcgaacagcgctacgcaataacttcgcggggctccagactcgatggggctccgaaaaacgtggagaatggagaattggcgaacatcgctacgcaataacttcgcggggctccagactcgatggtggaggatacatgaacagcgctaggcaataa

SEQ ID NO: 18874 - DNA, 387 bp, Glycine max
  Peptide Sequence Number=SeqID_110559
atggtgggttacacaccttcaagctttgcggatttggtcttcaccagcgaaatgatcgaggatgagaaggagggagaaacctatgttgtgactaccattcttatacgaccaagtttcccaccaacccaacaatgtcattactcagccaataacaacccttctcattatccaccacccagtcatccacaaagggctctgaagcgtaaggtgcaaggtctaattgatatgggctggctgaaatttgaggagaatcgcgtgattttcaactttcaccggaagtgggtgctagccattggtctgtttgctcaagcgacctgtgctcctgagtttggacttccaagaccgttcaatcagagattactcgtcttgcgcgttggtggggctgcc

SEQ ID NO: 18875 - DNA, 342 bp, Glycine max
  Peptide Sequence Number=SeqID_110560
atgatgatgaaggacaattaccggttgaaggggactcttctctccttcagagtattttggacaagttcgatggactccaaacctatgttggtgaaaggtttgatgctttggaacgacaagtggacatgcgattcgatgcaatggactcaaggatcacaaaggattgtcatcatcaaaaaggaggagattgtggaagcaatgacttccaagattattttgatgatgtcaaagaatcaagagttaagcaaattccaaagattcaagaatcaagtatcaagaacaaacaagatccacattcaagactcaagattcaagaatcaagagaagactcaatcaagataa

SEQ ID NO: 18876 - DNA, 663 bp, Glycine max
  Peptide Sequence Number=SeqID_110561
atgcatgaaggtcagggcgatggcaggcagagccgccagcaggacaaggtgtgtgcgggtggtatgggcgctgctgtctgtcagttgcatgcccaaccccagtatcagcatcgccaggatcgccgcagctgtaggcgcgacaaagcgggtgctccaactgggatccacgtgccgctgcgcccaaagaaaggccagtgggagcagggtaatgatggccgcgaagtggccaaagatcgttcggtcgaccgcgtccagcaggttgagagccgggacgaacagtgccgtgcagatcgacaacgacagcagccagaggccggtggctgcctcggacggcattctccttcgatgcaggtagaccaccagcatcgccatcggcatcagcagtgtcgaagccagaatgacccaatccaggccataggagtcgatcataggaatgcgcagcgttgcgaagtacgcatactcgcccagcagcaggtagggccacagacgggtcgggacgatcagcagcgccgctgcccggatacctgcgggcaggaagaactgatccagcgagaactgacgcgatatgaggcagctggcagcataggtggcggccagcacaagaccgaccggacggatccggaagctcagctcaattgccttcttgaatcggtccaagcctga

SEQ ID NO: 18877 - DNA, 667 bp, Glycine max
  Peptide Sequence Number=SeqID_110562
atgaattatgttttcgttcatgcgtcctccaccttcgagtttggagccatgcgtagtgattgctcagtgcaattctccattctcaaccctttttcggagaccatgaattgcgttttcgttcatgcgtcctctaccttcgagtttggagccacgcgtagtgattgcttagtgcaattctccattctcaaccctttttcggagcccatgaattgtgtattcgttcatgcgtcctccaccttcgagtttggagccatgcgtagagattgcttagtgcaattctccattctcaaccctttttcggagcccatgaattgcgttttcgttcatgcgtcctccacctttgagtttggagccatgcgtagtgattgcttagtgcaattctccattctcaaccctttttcggagcccatgaattgcgttttcgttcatgcgtcctccaccttcgagtttggagccatgcgtagtgattgcttagtgcaattctccattctcaaccctttttcggagcccatgaattgcgttttcgttcatgcgtcctccaccttcgagtttggagccatgcgtagtgattgcttagtgcaattctccattctcaaccctttttcggagcccatgaattgtgttttcgttcatgcgtcctccaccttcgagtttggagccatgcgta

SEQ ID NO: 18878 - DNA, 581 bp, Glycine max
  Peptide Sequence Number=SeqID_110563
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccaactgccccaagtttggggtatcacggtataaagtcaaggatgatgacgagtgtagcagtgatgaaaacaccaagaaaggccccccagcgaaggtgttatggtatcttccgatcattccaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatcacaaaatcgacgctcaa

SEQ ID NO: 18879 - DNA, 789 bp, Glycine max
  Peptide Sequence Number=SeqID_110564
ctctctatgtggggctggtttcacacctttttctccaagaaggtaggcccgcctatccgctacaaggaaggaagaatcaggattctatcttcatgcgaaggatgtccaaatgttctcttgatgggaacaaggggttgtattaattataatcccgtcctcgccataagacagcttggctaccccatgagagaagtgccatcagatgaaagcatcatgcctttcatcgcatggggtttcagtgaccacaaacgcgagggtactccaaggagttcgcaaggcatgggatgcggcactgtgagggacgatgaggttaaagcttcagaagaaagtgatgaggtacaagctctaaaggcagagcttgaaagagcccgagtagtcgaagagaagttcaagtccatagccatcaaaggcagcaatagtaagctcaagctccgaagagtgaaaggaatcatcacgggtcaaaggcatgatctgaaggacgagctaaaggtttgccttaggtcgaaaagaaatttgtcccaacagttaagcaagactgaagggaatatgtgggccatcatcgataagtgcaaagagaagctaaatctagcggcgactcacgagcaaaggctagaggatgagtacgccaagatatcagcagaaagcgaagcaaaggagagggagtcaagaatttccccgattgctagccaaggccaaagcaatggcggacacctactctgcccccaagaagatccacagacttctcagctattgtcaacatatgatagacttaatggaccatatgattag

SEQ ID NO: 18880 - DNA, 312 bp, Glycine max
  Peptide Sequence Number=SeqID_110565
atggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggacatag

SEQ ID NO: 18881 - DNA, 499 bp, Glycine max
  Peptide Sequence Number=SeqID_110566
gtcgactctagaggatccccggcagttgattcggcaggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcag

SEQ ID NO: 18882 - DNA, 722 bp, Glycine max
  Peptide Sequence Number=SeqID_110567
cggtgcgacagccagcgcatgatgagcttgttcgggcccagcagttgctggcggtagatgcccaggttctggcggcgggcgttggggccgcgcgtgatcaccaggccccaggtcaagagcggcgccacgtcgccggtccagcaggtctggatcggcaggcgcgtcaggtccacgtccttgccttcccagacgatctcctggcaggccgggctcttgacgttcttcgggctcatgtcccacagggccgacttcagcatcgacaccttggccagcgcatcgcgcaggcccttgggcgcctcgggctcgcgcagcgaggccagcagttcgccgatgtcgcgcagcgcgctgacgtcgtcggcgcccatgccgcgcgccacccgcgagggcgtgccgaacaggttggccagcaccggcatcccggccggcttgccgtcgtgcagggccttttcgaacagcagggccgggccctcggcgcgcagcacgcggtcggaaatctcggtcatttccaggcgcgtcgagatcggcgcggcgatgcgtttgagctcgcccatgcgttcaagttgggcgaggaagtctctaaggtcgcggtatttcactacagatcccggctatttggttacatcttgggtagaaagagaggagcatggcccaaggagtgcaccaatatcttgccgaatcactgcgcatctgcgccctctacctgggcattggggatcctctag

SEQ ID NO: 18883 - DNA, 399 bp, Glycine max
  Peptide Sequence Number=SeqID_110568
atggtggtgaaaataataaaaaacatgcagctgccaaatttgtttccaacaatgaggatggtgattgtagaagattgtctatgggctatggttcaagttgaagtcagagacaataataacatggctggactttgtggactgtccaaaggctttggtcttggaatcctaataataccaactgttgccactggtatggagtcctctgccacaaccttacttcccatcttcttcagcttcacctcaacacttcaccttctgctttctatcatgactactatgatgatggattctaccgtagattcgatgaggaagcttataggagatggagctttgatgttgccaacggaacagtaccctctcagatcgggaatctctctaagcttcgatatcttgacttga

SEQ ID NO: 18884 - DNA, 711 bp, Glycine max
  Peptide Sequence Number=SeqID_110569
ggacccttgggtactagtaccctcacctttagaggaatatacgtcctcgtcatcagagggttgcacgccctcaccttcagaggactacacgtccttgccttcagagggctacacgccctcaccttcagaggactacatgtcctcgccatcagaggattacaagtcctcgccattagaggactacacgtcctcgcctttagaggactacacgtcctcgccatcagagggttgcacgccctcaccttcagaggactacacgtcctcgccttcagagggctacacgccctcatcttcagaggactacacgtcctcgccttcagaggactacacgtcctcgccatcagagggctgcacgccctcaccttcagaggactacacgtcctcaccttcagagggtcatggctacacgccctcaccttcaaagggctacacgccctcatcttcagaggactacacgtccttgccttcggagggctgcactccctcgtcttcagaggactatatgtcctccccttgagaggactacacttcctcgcctttagagggctacacgtcctcgccttcagaggactacaagtcccccttttcagaaggctacacgctctcgcctttagagggcgacatgtcctcgccttcggagggttgcgctctccctcgccttttgagggctacgcgtcctcactttcagtgggctccatatccacaccttaa

SEQ ID NO: 18885 - DNA, 460 bp, Glycine max
  Peptide Sequence Number=SeqID_110570
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccttatacctttcgacttgactaatttgtccacaaatttattgcttaactggtcctacttgagaatgagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 18886 - DNA, 225 bp, Glycine max
  Peptide Sequence Number=SeqID_110571
atgagattggttaagagactcctatccctcttaagattattgaggtcacaaggtccaacatgttttgcgagaatgctccaaccatatgagatcaacataggcttaaaggagcaatcaaacccagtgacccccaaggcctacactccaaagagtccgtcagagcctcttcctcctgattcaggtccaacccctaaaatcattttagcacacagacattgctcgtga

SEQ ID NO: 18887 - DNA, 399 bp, Glycine max
  Peptide Sequence Number=SeqID_110572
atggctcttcctctgccaccgctgttgctggccatcaccatcacggaccatctaaagcacccacaacatcggttcctccttccgtgtcatccccatgatcaagtgcaaaatatacccgttgttattaatcagtctttattcttctcattgactaaattacccagtcaaggtgttccttttgagggcactattgttgatgactggaagttcgattactcaagtcatgatgctcgctgtatggatgttgatggtcagtggattcgtaaacaagacttgcctctgcctattcctgacgaacgtaccccatctcctccgctacaaagggttgattcctcttctcttctgaccgaagtcctcaagaacttcgtggtggttgtcatcatcaaaaagtgggagaat

SEQ ID NO: 18888 - DNA, 327 bp, Glycine max
  Peptide Sequence Number=SeqID_110573
atgacggtgaaaactctgacacatgcagctcccggagacggtcacagcttgtctgtaagcagatgcccgggagcagacaagccccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 18889 - DNA, 410 bp, Glycine max
  Peptide Sequence Number=SeqID_110574
gatcatggcttcttcacctggctcgcctcctctttctccttctcctcctcctcctctcctctcctcctcctcctcctttagacgcatcagcttcgtcgtctaccatgaagcggacacgcaaagccatacgtctaagattcttgtctactagaccacctggtgctgagagaccaatggtcaacattgatcctgctaccaacaaggccgacgaggcttctgacagtaggaggaaaaagaagttacttaagactgtcggcgagagatggaggcagtttaaatcagacctcacgaggaaatgggcccttgcagccgatcaggacggtgtggacgacactgtctgtgagaaatacgacataagcaaggaaaaatgggcccagttttgccagactcacagagacccttcttgggag

SEQ ID NO: 18890 - DNA, 606 bp, Glycine max
  Peptide Sequence Number=SeqID_110575
atgtgccggtactgtccggctcccagaccaccagcggtgacaacgtctttaattcggttgaacgtaaaaccgtcggtacccaagctgaagattgtgccgcagatcaacgacggggatatgatccacctgaagatcgaacaggaagtctccagcgtcgatgccagcgccaccacggacgccagcctggggccaaccttcaacacccgcaccatcaataacgaagtgatggttcacagtggccagacggtggtgctcggcgggttgatggagaatgtcaacaaacagaacgtgtcaaaagtgccgctactgggtgacctgccgctggtgggacagctgttccgctatacctcgcaggacacgtcgaaacgtaacctgatggtgtttatccacaccaccgtgctgcgtgatgacgacaactacagcgcggcgacgaaagagaaatacgatcagatccgcgcccgtcagcagcagcgtatggaagagcagaagctggggattattgaaaacagtgataacccggtactgccggcacttctgccgcaaagccgttcgacgccggtggggacgactgcgtcgtcatcgacccgcaatcccttcaaagagtaa

SEQ ID NO: 18891 - DNA, 150 bp, Glycine max
  Peptide Sequence Number=SeqID_110576
atggctaccattgcattattgagtagatatggaaggtggtgtttggcctcgggtgtgcatcagacgggctttgtggctgatttaggggcgacctttgtggatgattgggtgttcttggctggtagggtggtgggtaatgagaaggattga

SEQ ID NO: 18892 - DNA, 294 bp, Glycine max
  Peptide Sequence Number=SeqID_110577
atgaaagatattgagctggtagaggaggaacaggcacagattggtgctaatccttctagtgagacctccaataaatctgagaattataaggaggaagcacggaatgcaacacagaagcataaaccaaagaaggtagagagtgtcaacactgatgcagaagcctttgctgaaccactagaacatacgaagaaaagagatacaggccatcaaagtgtgtcattggagaataaggcaggagattcaactgtgctgaagataggaaattcgggtaaagttgtgataaacaagacatga

SEQ ID NO: 18893 - DNA, 346 bp, Glycine max
  Peptide Sequence Number=SeqID_110578
atgactaggggcaatccaggtgatttacaaccctttgatcctaaaatagatagaagttttcatagattagttaggcatagtgtgcatcctagtcattctgtgcattttgagcattctgagcattctgttgaggttaattctgaatattctgattttcaacattccactacaaactttcatactgagaacatggctcaacctccacctcgtgagaggactcttagggagatggctgcacctgatttcacttatgaaagcttgtgcattcaatatcctgatgagggtgttccatatgttctcaagactagactaatacatttgttgtccaagtttcatggtcttgcag

SEQ ID NO: 18894 - DNA, 714 bp, Glycine max
  Peptide Sequence Number=SeqID_110579
atgatctccttgcgccaactggcgataggctatggcgtcacgccgcttttcccaccgctgagcgggcagttcagcgccggttcgttaaccgcggtggtgggcgtcaacggggccgggaaatcgacgttgctgaaaacgctcgccggattgttgccgccgctgggcggcagtctgagttttagcggcggcaagccaccgcgcagggcttatctaccgcagcaggccgagctggatcggcaattcccgatcgcggtaagtgatctggtggcgatgggctgttggccgcaaagcggcatgttcggcggcatgaacagtcgcgcggcaagccaggtcaatgaggcgctggcgaacgttggcatgagcgcgctggcgcgcagcccggtgggcgaactgtccggcggccagctgcagcgggtgctgtttgcgcgcctgctggttcaaccggcgccgctgattttgctggatgaaccttttaccggcatcgacagcgccaccacgcagatcctgctgcaggcgatcgcgcaactgcaccggcaggggaaaacggtgatcgccgtgctgcacgatatgtcgatggtcgccgagcattttccacaggtgctgttgctgacgccgcaggcttgccactggggcgcggccgagcgggtattggaacaggtgccgaggtatcacgccgccgaacggcagccggatctgcgggcggtggcgccatga

SEQ ID NO: 18895 - DNA, 234 bp, Glycine max
  Peptide Sequence Number=SeqID_110580
gttacctcaagaagattgacatctttctgaaggaaccaaagacttccttgagtggtaaattctcaggaggtggacgcaggattggcttcggtctgtccacaggtactggagtacagcaatggatccctggaacagctacaccgctagcaggggggatattctttaaccaagaccggcattttagtggaaggcgtgctcctcaactcctatacccggaagtgggactagtagatg

SEQ ID NO: 18896 - DNA, 360 bp, Glycine max
  Peptide Sequence Number=SeqID_110581
atgcataaggcattacgggccaatgcacctctcccttacccacaattgataactttgtttctgcgtcattttcaaattccgcttgatgatgaaccatttgttcaagtcaagcgttcctttgcaattggtgctggtgcagtgacttcctttggttaccgtaaggattggaatggtcaatggctgaagaaagacgtactccctcctcaagatgagcgtactccttcacctcctcctcagcgagatgattcagctctcatgattgaagttctttctgaattacggggtcttcgtgatcatcaattccaaaacatagggggagacggtcatcatcaaaaagggggagattgtagaagcaaatga

SEQ ID NO: 18897 - DNA, 583 bp, Glycine max
  Peptide Sequence Number=SeqID_110582
ccgaacgaccgagcgcagcgagtcagtgagcgaggaagcggaagagcgccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccagcaccttcccatgcaaagaagcaaagcaatgggacaagaaatggttaaattcaaacttccattatccaaagtatttgtagctacaacaattatctggtacaccaccacagcattgcttgttggtgacaaaaaaaggataaacacccatagtaatgatagtatggaaacgcttctggtaaagaaagacataatcctttttcttgaagatattaagataaatgtgtctgtgagaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18898 - DNA, 213 bp, Glycine max
  Peptide Sequence Number=SeqID_110583
atgatgactaacaagcatgatgaagcttgtcacacctgccgtaaaacaagaattaattggttttcaagagtagatattatctacaatgtcaatgggggaaataatcaatacatgaagtcaaacaatacacaggcaggcacactgatttcacctgttcctattttgaaagcttgtgtggatgaagctaagaaacttggtaaaagacttttctag

SEQ ID NO: 18899 - DNA, 228 bp, Glycine max
  Peptide Sequence Number=SeqID_110584
atgacggtgaaaacctctgacacatgcagctcccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 18900 - DNA, 474 bp, Glycine max
  Peptide Sequence Number=SeqID_110585
atgagaaagcgcacgcttcccgaagggagaaaggcggacaggtatccggtaagcggcagggtcggaacaggagagcgcacgagggagcttccagggggaaacgcgtgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctgactttgaagataagaagtaaaaagagatttagcaacaagaagcttaagctgccttatgtttcatatgctctcccagggatcctctag

SEQ ID NO: 18901 - DNA, 186 bp, Glycine max
  Peptide Sequence Number=SeqID_110586
atggggaactttccctcgaggccaattccagaattcaccccgatcccaatgacgtacgaagacctcttgccgtccctcatctaccaacatcctttcccaaagtggtatgaccctgatgcaacttgcgcgtaccatgggaaaaccctgggccactccaccgaaaaatgtctggcccttaaatacaag

SEQ ID NO: 18902 - DNA, 375 bp, Glycine max
  Peptide Sequence Number=SeqID_110587
atgtctcagcatatcagtgttacagttgtggattctagatctgggaaatcacagtttgagactgaaagttacataaagagttggatgcagagttcaaaacgcaatgtctatcttggagcctacttgaatgtcggacactggcagatggtggtcattgtgcctaaagaacacctagttgtttggttttgttcattgcataataggccagacaactaccttaagggaataattaacagtgctttaaaagcgcttgatgatgctccacagcctaaatcaaaggctcctgctagtgtaatagacaaaaaggaatattttaacgatgctagaccattggagccaaagagattaaaggcgctgtggatccagtgggcatag

SEQ ID NO: 18903 - DNA, 105 bp, Glycine max
  Peptide Sequence Number=SeqID_110588
atggtgacgttttatggatgcaacctaagcatgtttcagaacatgtttggaatgggaaacaagacggaaaattacacatcagacgagttgtccccacgtatcaag

SEQ ID NO: 18904 - DNA, 528 bp, Glycine max
  Peptide Sequence Number=SeqID_110589
atgcaatcacagggacttgtactgctttcggagcctgaggggagttgtgttgatccctcagggaacaatccagacactggtgactcagaaaaatgcgggttgtacatcgaagaaaatcctccccgcttggttgccctaggaagagtttatgagggatccacaaccgttcacaacatccctttgttgcatgatcaagtgaaggtcggtgttgagcaggttaaagatgcagatgctcccattcttgtacccactgacgaggttattttagtggggcaagcacttaacaccttccttgcttggttgacacatctcgtcaagcatttatcagaacaaggagctgtgggaccagcaaaacctgcagataggccggatcatgaggtcgatgatcccctatatctgatgacattgaccatcccacaactatttttgaagtcgttgcaggcatctgacagagacaagtatgcgagtggggaattccgatgtgtatggattcctcgagccatagtcctctgggcaatcacaatttga

SEQ ID NO: 18905 - DNA, 471 bp, Glycine max
  Peptide Sequence Number=SeqID_110590
aggactacacatcctcaccttcagagggctacacgccctcgccttcaaaggactacacgtcctcaccttcagaaggctacacgtcctcgcctttacatcgctacacgtcctcacctcagaggactatatgtcctcaccttcagaggactacacatcctcaccttcagaggactacacgtcctcgcctttagaggactacacgtcctcaccttcagatggctacacgccctcaccttcagaggactactcgtcctcaccttcagagggctacacgcgctcgccttcaaaggactacatgtcgctcaattgatttctaatgtcatctattatttgcaaggatcgcgcccacaagatacccagtggactcggaggagtccaacagggccctggggtttgcagctctggttatgggcctctgtcagtcctaccgggtgcccgtcccgccagcaaggtcacaccatcgtgacataa

SEQ ID NO: 18906 - DNA, 459 bp, Glycine max
  Peptide Sequence Number=SeqID_110591
atgcagatattcattgaagccatagatctaaatatttgggaagcaatagaattaggacaacacatacccattataatagatgtaagcacaagcactacaacccaaaaacctagagataagtggacagaagaagataggagaagaatccaatatgatctcaaagccaaaaatatcatcacttcagccctaggaatagatgagtactttagagtatcaaattatactaatgccaaggagatgtgggatactctccaattaacccatgaaggaaccacaaatgtaaaaagggaatggaagcccaaggtaactgctatttctaaaagtaaagatatctcttccgtgtctcttgccactttatttggtaaattgcagaaacacgagatggaacttcaacgccttaatcagaatgaagaaaatgacaaaaagaagagaagtatactcttaaagcctcatcattaa

SEQ ID NO: 18907 - DNA, 447 bp, Glycine max
  Peptide Sequence Number=SeqID_110592
atggagatcacacctggcaatcaattcaacaaagaccagggtggaccttctaacaggccaatccaacaagggcctaacatctttcagaggactactaagctagaggagactttgactcagtttatgcaagtaacaatgtcaaattataaaagcaccgagtcagcactgaaagaccttgaggtccatgtgggacaactagccaagcggataactgacaagtcatccaacagttttgtggcgaatacagaaaagaatcccaaggaggaatgcaaagctatgatgacaaggagtaagaggtttgtggaggcggaggatgaggatagtgttgtatccaagaaggaagctgttgaaaagaaaagtgcggaagtaccatatcctgtggtaccttccaagaaggagaaggaccgccatttggcgagtgatcgaggccgtacccgaatcaaataa

SEQ ID NO: 18908 - DNA, 365 bp, Glycine max
  Peptide Sequence Number=SeqID_110593
atgggcagaaatgtgtcaacattgataggtaaatctgttcctcgcattcctgagaaatgtaaggacccagatgtggtgattcatttggcaaatagaagtgttgcttacttcgcaggtttcatagaggatgtgctggttcagaatgaatctgaatttgagtctggttctgattttctgggtgttgtacctcttgatgttgagtttttagagtcagaatacactaaccatgttgcaagaagtacatatacttctgaattgctttatgaggtacaggctgaggaaccttcttcttctcctaccctggttcctcccactgttcatccaccacccacaccagagttgaagcccttaccagcaaccctcaa

SEQ ID NO: 18909 - DNA, 288 bp, Glycine max
  Peptide Sequence Number=SeqID_110594
atgaccactcttacgtggatgacgttgctatttagcaacattctacccagcgaccataatgccaatctccccctgcagatgatcgcgcccacaagacacacagtggacccgaagaagtccaacagggccctggggtttccagctctggttacgggcctttgtagtcctatagggtgcccgttccccccggcaaggtcacgtcatcctgacataggtaaggatcgcgcctgcaagacacccagtggacccgaagaagtccaacaaggtcttggagttgtcaagctctaa

SEQ ID NO: 18910 - DNA, 357 bp, Glycine max
  Peptide Sequence Number=SeqID_110595
atgagggatggcaagaggtcttcgtacatcattgggattggggtgaatgttggcctcgggggaaagttccttatcgcgttggagccggtgccaaagtgggcattgccggccgggcgagccggggttgaagctgtagcttggggggcctccatgtggatgggcgcaggcgccctagtttgtacgggttctgagttggaggagttcccggcgcgagctaagaagctcgggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 18911 - DNA, 1317 bp, Glycine max
  Peptide Sequence Number=SeqID_110596
atgattgagtctcaaaaactcaactatgtcagacaaaatcaacaggaacttagagttgacaagtacatcaatttgaatgtctgtaataatggtcccgaaacacatggcaacgaaaaaggaaggagaattatactgctaagctcctttgtgggtagtcgtaggtatatggaacaactatattttgatggtatgccaattggtggccatataggatttccagacctgtttttgacattaacatgtaatccgacatggcaaaaaattcaacgaagagttagaaaatacaatctaagacttgatgattgccctgatgttgtgtcacgaacattcaaaatcaagctcactcatttgatgaatgatctcaaaagtggacatgtgtttggcacaattctcggatttgtttacactattgagtggcaaaaaagagggttgcctcatgctcatattttaatatttctacatccttcaaacaagtatctgaatctagaagacattgataacatcatttctactgagatcccaaataaggacacacatctagagttatatgaattagtcagcaagcatatgattcatggtccatgtggactgccaaacaggagaacaccatgtatgcttgatggaaagcgtattagattttttcttaagaagttccagcaagcaacaattgttgacaatgacgttttccagtttataggaaaagaaacaatggacatatggttgaaaagaatggtatttatcaccaccaaatgcatgctagaagatatttgcattcccaatgcatgcattggtctgtattttcatcttgaaaatcaacaagttgtttactggaaagatattgaacaaattggttcaatactatctaaaaaaatagtcaaagaatccatgtttacaacttggatggattctaaccaaagatattctcaaggtcgagatcttacttatgcacaatatttgtccaaattcgtgtatgtagcacgccgaagatgctggcaaccaagaaaacaaggatatacaattgacaggctcatatgggtaccctgttcaactgaagatttgttctacctgagaatgatgctatcttctgctaaagggcctaaatcttacaaagaaattagaacagtagaaaatgtgatgtatggtacattcagagaagcatgctttacaaaaggttttctaggaaattatcaagaatttattggtgctctacgagaagctaacacatggggatctgcacactttcttagaaagttatttgtcaagttgttatttatgaataccatggatataccacaatatgtgtgggaacaaacatga

SEQ ID NO: 18912 - DNA, 1084 bp, Glycine max
  Peptide Sequence Number=SeqID_110597
atgggattaataatcccacaagattatgatgaagaagttgcaaatcgctcgatcgaaggccagagagcacttcgattaacacccaagaccttcgatcaaaacccacaaaagctgttcctaaagtacatgaggatttttctgagctttgacaagtttcttccccaacatgctccattcattagtcgagaggtcggcccggcctggttcactgactattttcctgctgtcgatccggacaatgaagaagaagtgaacgaaatatggtcattttacttgaatccacagatcctgtcttgtcgtacaggtgttcaatcgaactatttaggcttggttggataccagcctaatttggtttcaagacaatttggcctctcgcaaatccgtcctaaaagcttgttcgaagatcctcgagatgttataagaggagccaatctttcagaaaaaactttcaagaattttttgaagatttctctagatgaaaactataacctgcatccttttgaattcaaccattcccacttctgtaccatagggtttgttacctggtgggagaaatattattcgggccgttcagttggagacactactatcatgatctccagacttgagagtggttttacacaaccaacggtcgagaatatccgctcaaaccttcaagctcgaggcaaaacaatcatgacaaagaaaattgctgaaacgtctcgagctgatgtgagacccaagaaacccactggggtgaagatccaagaatggaaacaagaagagaagagtcataagaaagatgatagcaccgagactaccacgacctcaaaacgctcgaagcgtgtggtcatcgaattcgacgaagaaaaagatgcaagtcttatttctaatgaagaagaggaaagacctcttgtaagaaaaagaaaatcacctgagacttcgaccaaatctgccgaccaaacagaggcaggcgatttccaggctcaaatgcctaagaagaaaaagaaagtgaagcagatcgagcctgaaccttctgtgacggtcgagggtggtgagccagtcaggaagaaaaagaagaagaccaagtcttcaaaagaacaag

SEQ ID NO: 18913 - DNA, 54 bp, Glycine max
  Peptide Sequence Number=SeqID_110598
gatgttacacaacccatcccgttgcacattcacttctctacccctccagcctga

SEQ ID NO: 18914 - DNA, 444 bp, Glycine max
  Peptide Sequence Number=SeqID_110599
atggcacgtattgatgacaagataaaatccattgatggatctaaagaaactctgaaacttgctgtaaggataaccaagctctggtttgttgggacgccgggtaggtctgaacaagctgagatgatcatcgttgactctgatccgttagttagatatttttatgattcacagggtgatcaaatccatgtggtctgtaagcaagaccagttaaagacatggaaaatggatttgaaggaaggttgtacttatgtgatgcacaattttagagtcagcaagaatgatggacagtacagagtttgtgatcatccatataaattgacatttattgaagttacagttgtcagacaatgtgaattggatgggcttccttttaaaaattatagatttgcagatttttcggatgtcgttgctagccaattacagtctggcctattagtaggttag

SEQ ID NO: 18915 - DNA, 321 bp, Glycine max
  Peptide Sequence Number=SeqID_110600
atgacacattcgactgaagatgtgagaagaactatgcaaggaatgtttgctgtacaccggccctctatgtatgctttcaatagccccaacacgggggtgcttcagggggtccacaaggcatgggaattggtgcgaaagaaggacaaggaactaagaggaagtggcaacggggccatcggcggctaccataggtggttgaaagccattgcacaaggtttggattggctcccgaggttgagagccactaaagaggtggagtttgaagcctcaaaggaaggcgaagaggtacaagtcctcagaacggagcttgggaaagcctaa

SEQ ID NO: 18916 - DNA, 84 bp, Glycine max
  Peptide Sequence Number=SeqID_110601
atggctgcggagttagggcaacagatgatggagttatccaccctcgtcacacgtgccgctcacgataagtcctccgatttgtta

SEQ ID NO: 18917 - DNA, 246 bp, Glycine max
  Peptide Sequence Number=SeqID_110602
atgcagaacatgggctacttaagcatagtttcaagggtccaaatcatagtttcgatgatgtcgttacaggggtacttaaacatatttgagtcccattatcacaacattttatacttcaatgaccaagacgatgaccaatcccacaaggtggtggacgccgattacgtcgcggatttcttctttccactgaagaactttgaccttgttctccaaacgaatatggtgcatcgaacagttgtaaagtag

SEQ ID NO: 18918 - DNA, 282 bp, Glycine max
  Peptide Sequence Number=SeqID_110603
atgccaatctcccccaacagatgtatcggttgggatcgcgcccacaagacgcccagtggacccgaagaagtccaacagggccctggggtttccagctctggttacgggcctctgtcagtcatacagggtgcccattccccctgcaaggaatcgctctcacaaagacacccagtggacccggagaagtccaacagggctctggggtttccagctctggttacgggtctctatagtcctacagggtgcccattccccccggcaaggtcatgtcatcataggtaa

SEQ ID NO: 18919 - DNA, 444 bp, Glycine max
  Peptide Sequence Number=SeqID_110604
atgactaggggcaatccaggtgatttacaaccctttgatcctgaaatagatagaatctttcatagattagttaggcatagtgtgcatcctgatcattctgtgcattttgatcattttaagcattctgagtattctgttgctggtgattctgaatattctaattttgagcattcgactactaattttcatactgtgaacatggctcaacctccacctcgtcagaggactcttagggagatggttgcacctgattgcacttatgaaagcttgtgcattcaatatcctgatgagggtgttccatatgttctcaagactggactaatacatttgctgcccaagtttaatggtcttgcaggtgaagatccttataagcatcttaaggagttccatattgctttttccaccatgaaccccctgatgtccaagaagatcatatctttctaa

SEQ ID NO: 18920 - DNA, 660 bp, Glycine max
  Peptide Sequence Number=SeqID_110605
atgggatatgtgaagatcaagagtgttgcaaaggccaaaaagcatcaaaaggtacccataatgtccatcatgggtttgaaaaactattttggggttgaaggcaaatttgatgaaagccatagcaccggtgaagagaaaaaggctagtgttaggcagaatccacctattatggaggagcttggcaacttgagcttcaatctccaatttttgagcatgcaattatcgatagggagttgttgcatctctggctggaaaaaaggtaatacaggagaaggaggggctctcaatagaagatgtgggttcttcctcggaagagatcaacccatcatacaatcttacaacataagaaggtggattatcatcttcctcaacaaccagaacaagagagagtttggtagtgcaaggatggtgttggtgtcagcaacaaaggttgaaaggattttgggagtgacgagaccaactgagaaggcggttgcttctggaggaagcaaccttgctcgcctgggcgagctgggtggcaagctcctcccctattttgctataaatagggggaggaatgaagggggaaagggttcaaccttcttggcacttcttattctctcgaaattgctgaggaaaattgtttccgtgaagaaaatccaagccgaggcgcttccgtaa

SEQ ID NO: 18921 - DNA, 90 bp, Glycine max
  Peptide Sequence Number=SeqID_110606
atgacactcacccgaccctcatgttttggaattaatgaagcattgggcttgaatctagaattgggcttggacttgaagagggcagactaa

SEQ ID NO: 18922 - DNA, 536 bp, Glycine max
  Peptide Sequence Number=SeqID_110607
catccgctaagcgtaacattcctaggctaagcgcgaggaagaatccagaagaagatgagttgtacagggtttctagagagagaaaggtccaagttccagagagttttgagagattttgctatgtgaagatctgcagagaccagagctggaagcaggagctggaaccggtcatgtacgattaccatgagaaagaaagagctccggatcttgaaagttatcaatgggagtcattccggcaatctgagtatcacaataaagcagaaggagttcttaatatggatgatctgttaatgcaattcaaagatatggtagaatcaatacaacaagcctttagaaggactgaaactcagattagtaagttgattgatgacatgactaacgctgtggctagaaaagaggaagagcgtacagagattgaaacacatcaagaaagcatttgtcaagttacctcactccatcatcaattgaccaatgaagaggaaacgcctaaagtctccaatactccagaatatccctacttggctattgttggctat

SEQ ID NO: 18923 - DNA, 396 bp, Glycine max
  Peptide Sequence Number=SeqID_110608
atggtcgtcattttgcctaaggaaaatcttgttgtctggttttgttccttgcataataggccagacaactatctgaaaggaataattaacaagtcagtgttgtttttcaatacatttgcattagcattaatcagcaacatcaatattttaatgttcattgtattcaacagtgctttgaaaggacttgacgatactccacaacctaaatccaaggctggtgctaagtggattgttgttaaatgtaatagacaaaaagaaagcactgagtgtggctattacgtgatgcactggatgacaactataatcttaggatgtttcaggaataattgggaaatgtattttaatgatgttagaccattggaatcagacacattaaaggcgtttcacatccagtga

SEQ ID NO: 18924 - DNA, 259 bp, Glycine max
  Peptide Sequence Number=SeqID_110609
acaagcccgtcaggccgcgtcagcggtgtgcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctcaggattttggctcaaggcttgtacccatggctagacatgatacat

SEQ ID NO: 18925 - DNA, 156 bp, Glycine max
  Peptide Sequence Number=SeqID_110610
atggctcctatggtgtggcatctccaatcatctttcttccttctcattccgcttcatgatcttcaagaagcaaaagactcattgatgaagaatatccaaggcctacaagctccacatggagctacatcatgtggtatcaagagcatctttgtgtag

SEQ ID NO: 18926 - DNA, 92 bp, Glycine max
  Peptide Sequence Number=SeqID_110611
atggatgacaatgatatggactcatctgaagattcagaaaacgaagttgtaaacctgagtctaatggccaagagtcatgagagcctgaaaag

SEQ ID NO: 18927 - DNA, 164 bp, Glycine max
  Peptide Sequence Number=SeqID_110612
gtgtcaagggaagaagcccagagtataaagaacctcgggatttgaggtcaaatccttttcaaggtggaggggatgatgcaatcctacccccccaagggtattggatagaagactccaagaggattaggctagagatgctaaagaaggccctagggatctcatga

SEQ ID NO: 18928 - DNA, 318 bp, Glycine max
  Peptide Sequence Number=SeqID_110613
atgggagtggagttaggatcaatggtggaggaagctgtggagggtaaggttggagttggagaggcagaggcactgatgtatggtgaagatgtgtggctgggaaaggtagttggagtttgttggggaatatggttgacaactccaaggggagctgctgatgtgactgtttggttaggagagcaggtgcagtatgaaaagcatggtcccagtaatgataagggagagaggagtgggagagtaaggagaggcccatctccacaatgtgcctatgctttctttcgaccacaccattctgatggtgggtgtgagggcagataa

SEQ ID NO: 18929 - DNA, 624 bp, Glycine max
  Peptide Sequence Number=SeqID_110614
tacggcattagcaaggagaagtggacccaattttgtcagagccacagagacccttcatgggaggccattcagaaacaaaacattgcccttcacatgttgtcttatggggattatgaatttctagaaaacaagttgatggaggagaagaaaaagaaacaactggaggaagctgctaaatctgaaagcactaacaccgtcattgatcctccatctcccatcagaagacacgtgaagtggaagatggcccgcaccaagaaaattggccaaatgacgtctgaggcagtaaaggaaattgctgacaagattgattccttagaggagcatacctcacaaggttcctttgtcgcctatggacgtcaagatgtactgactgctgccattggtcgatgtcacgatcaaacaatactttggactggctccaaggacctcttgcacgtcttcgtccatggctcccaaagatctaaagtagctgacacaaaaaatcagggaccagctggaagagttggtccttcagctgcttgtgtcagcacaaaggaaggttttgtcgatccctcagggaacgatccagacatgggtgactccaagaaatgcgggttgtacgtcgaagaaaatactccccgcccg

SEQ ID NO: 18930 - DNA, 165 bp, Glycine max
  Peptide Sequence Number=SeqID_110615
atggcgaggacgtgtagtcctctaaaggtgagggcatgtaaccctctgaagattgactgtccttttgaaagaggtgataattcatgcaacctcatcctatccttttttgcaaatctcttcgggaacttcctcagagtgtgtgttctgtttgatttagtcacttga

SEQ ID NO: 18931 - DNA, 438 bp, Glycine max
  Peptide Sequence Number=SeqID_110616
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaattcgataaaagtaaacaaaacgagaataaaaatgcgcgaaacacaatgtggaccaccaagggtacatggaatgaatcgaaaagcttggttcgaggggaggtggttgccgcccagctcgcccaggcgagccaggttgcttcctccagaagcaacagccttctggaggaatattctggagggcccaagtgggcctgg

SEQ ID NO: 18932 - DNA, 90 bp, Glycine max
  Peptide Sequence Number=SeqID_110617
atgatgcatatgcgaaaggtactgtcataccctaatttcgtccgggaacctttgcttgatgacatgcgaccattctttggtccttgtgag

SEQ ID NO: 18933 - DNA, 261 bp, Glycine max
  Peptide Sequence Number=SeqID_110618
atgacctccgtggagactttcgccatggctaggtgtcataccctaatttcgtctggggaccatccgtttttgggatacgaccctcgttcgaccacttcgagaaagaaaacaagcatcgttacgaaattcgtaaagtttcgtaacgttacggaaaaagaatcaccaaaaacaaaacaaggggtgtatttagtaaaaatgggggtgcaaatagcaattaggcccacttggtccttccaggatgttcctccagatggcggttag

SEQ ID NO: 18934 - DNA, 562 bp, Glycine max
  Peptide Sequence Number=SeqID_110619
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtggttctccttcttcaactatttctgattgtttagtttgcattggacctgagaaatatgataaaggaaatagtttctcttcatgtaggcatgctggtgatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18935 - DNA, 843 bp, Glycine max
  Peptide Sequence Number=SeqID_110620
atggtcatttctccgggagcgacgcgtccagctcagggacgacgagtataccgatttctaggaggtgggcatcactggtctacagaggacatagtcttcgaattttatgccaatgcttggcctacagaggagggcgtgcgagatatgaggtcctgggtgaggggtcagtggatcccgtttgatgcagatgctatcggccagttcctaggatatcctttagtgctggaagagggtcaggagtgcgagtatgggcagaggaggaactggtccgatgggttcgatgaggaggccatcgcccattttctatgtataccggggcaggattttgcccggactgctgccgggagacgggtgcggatcatgcgcaccaacatgaccaccctgactcagatctggatgactttgctgctcagcaacatccagcccagcgaccataattccaacctccccctgccgaagtgtcagctggtgtacgccatcctgacgcggatgagcattcacgtggctcagttaatcgctgatgccatctatctatttgcaggtatggcgcctaccaggcaccctctggacccggataagtccaacagggccctgggatttcccgccttgatcacaggactctgccagtcattcggagtccccgtcgcacctagcaaggtgattcggccgcccatcacccaagcttttattgagaagtattgcacacagagacaggcccagggggatgctctgcaggccgcagacgcgtcgccacctcatcaggctggtccagccgaatcgtttgatacggagcagtatttgcggcatttggttcgccagcaggcggccaaccaccgggctcat

SEQ ID NO: 18936 - DNA, 297 bp, Glycine max
  Peptide Sequence Number=SeqID_110621
atgaagcagaaaaagaggttgaagctcaagaaaaaaaaccctgtaaaagagcataagtcaagagaaaaatatgaggagaaagatgaggaacaagcacaacaacaatgggagaatcctttcgctaagcgcacgcctcgcgctaagcgcgtctttgatcacgcactaagccgagagtctcaagcacttagcgatcaacccttgcatctaaggctgatttggttcgctaagctggccaaggctgagctaagccaacttcaattcgatctgaattcggctaagctgcagcctgatcgctaa

SEQ ID NO: 18937 - DNA, 255 bp, Glycine max
  Peptide Sequence Number=SeqID_110622
atggagaagtctgaaaagaaaaatattaatgaaaagaaattgaagaaagcatacattacatgggatgaaaacgatatggaatcttctgaagattcagaaaatgaagaaataaacctctgccttatggcaaaaagttatgaaagtgatgaagaggaacccttgaggaaaaagtggtacatagatagcggttgctcaaaacatatgacgggagacaaatcaaaattcacacatatctctcccaagaaaagcggacat

SEQ ID NO: 18938 - DNA, 534 bp, Glycine max
  Peptide Sequence Number=SeqID_110623
atgcaagcagaaccagaggaggctatcacacagctactatgcataccggggcaaaatttcacccgtgccgctgcaaagagacgagtgcggatcatgcgcaccaacatgatcactcttacacagatatggatgacattgctacttagcaacattcctcccgacgaccacaatgccgatctccccttacggaagtatcagttgagattgtgcccacaagacacctactggacccggagaagtccaacagggccctggggtttccagctctggttacaggactctgtcagtcctacagggtgtctgtctcccccagcaaggtcatgccatcatgacatagggatcgcacctgcaaatcacccaacggagccggagaaatccaacagggtcctaaggtttccaactctgatcacgggcctctgtcaattctacggagtgctcgtcgcccccaacaaggtcatcaagccccctactaaccgagctttcatcaagaagtactgcacccccaggcaggcgcaaggcgagacaccgcagtag

SEQ ID NO: 18939 - DNA, 369 bp, Glycine max
  Peptide Sequence Number=SeqID_110624
atgtgcgaagggcaacacggggctcgcgggtgcatcttccatgggaggaaaatgtgcggagtcgccaccaacgtttattcgaggaaaacgtcagaaaaaccagaaaaggtgtggtctacgaactttaagtgtgaaaggttcgggagttgtatttacgcatggggaaggttatttaaggctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 18940 - DNA, 489 bp, Glycine max
  Peptide Sequence Number=SeqID_110625
atgggagggtacatccttggtggttcgcttcaagtagagggtacatctacttggttgttcaaagagaacaagggagggtacatcctttgtggctcttttcttgtaaaggattttacaaggttattggaaatctcaagaaccgtgggctgcttgaggactggatgtgcagatggtggagatggttgtggggtctatgctggagtggtctcctcctctactactgctaatgatggtgctggtgttgtgggctccctagtcataggctcctgggctgtggaggccccaccccctccagaggaagaaggctggtctcctggccaggccacctgtgcgtcaaactcctccatgctcataagtgtagaaaaacagggtgttggtgcctctgatggccgggaatccaagtctggacgtatcatgttgagcagtgagggagatctgatgggaaataaggggctacccatcagcattaagctcgaatcccctccctag

SEQ ID NO: 18941 - DNA, 417 bp, Glycine max
  Peptide Sequence Number=SeqID_110626
atggtaacaatattggtggaggtaatacacttacatggaggaagatgtgccattacggagttaggctgtgataaaactgcagagttaagtaacccatcaaaggtagggaatgatgcaatttcagtcaagtccacattagagttaggttgtagaaaaactgcaaagttatgtgacccatcaaagtcaaagctaggttgtgataaatctacagggttatgtaattcatcaaaggtagggaatgatgatggaattgtagttaagcccatgttagagttggcttgtgatgaaagtgtagggttgtgtgaaccatcaaaggtagagagtggtacacttgaagttaagcccattacttgcctctgttcttccaaaaatatgttgagtagaaacattttatgcttccatgccatgtttgcataa

SEQ ID NO: 18942 - DNA, 933 bp, Glycine max
  Peptide Sequence Number=SeqID_110627
atggatttcttttccaatgagaattttgaatgcattcaggcatttgagaactcaaatctcattccttttatgtctttgaaattgcctgtttattcggaattagttaaatttttttattctaacctcgaaattcaagaaagcactttgatttctgaggtttttgggataaaaatggtcattgaccaatccctattctatgacttgacccaattatctagtgaaggtgtaccatttgaaggtgcactgaatgatgattggaaatttgatttctctgtgcatgatgcccgccagttggtttgcaccaaccaagcggatatgaccggaaggctgcttgccggttccttggcttttgaaagccgcatccttcactatcttattgttcgtattttacttccaagatcttcaaacctagcacaagtttctgaagaagatcttatagttatgtgggcttttcatattgttcgacaaattgattgggcacacctagtccggtatcacatgcataaggcattgcgattaaatgatcctttgccctatcctcatcaagtcactcttttccttcagcattttaacatccctcttgattctgaaccatatgttccaatcaagagatccttcttgatcggtgctgctgagattgcatcttttggttaccgcaaagagtgtgatggctctagggtaaaaaagggtgctcaacccaatgatgatgaaggacacttaccagtaggagtggattcctctctccttcagagtaatttggacaggtttgatggacttcaaacctatgttggtgaaaggtttgatgctttggaacaacaaatggacatgcgatttgacaagatggactcaaggatcaccaaggttgaaggagatgtcactttcatccacacatgctttgatctactaccaccaccaccaccaccatcatcttag

SEQ ID NO: 18943 - DNA, 171 bp, Glycine max
  Peptide Sequence Number=SeqID_110628
atggcggataatcttcatggatttgctcacggaaacgtctcagaagcaatacgggaaaaagggaggtgtttgccgcccagaggcttcttgaggaagatttctgagcgcatcccagttactaagtttacccccctttttgtactttacggaagccttacgggagtgttttag

SEQ ID NO: 18944 - DNA, 392 bp, Glycine max
  Peptide Sequence Number=SeqID_110629
atgacattgctacttagcaacattctgcccagcgaccgcaatgccaatctccccctgcggaagtatcagttggtctgtgccgtccagacatggggatcgcacccacaaagacacccagtgaacctgaagaagtccaacagggccctagggtttccagctctggttacgggcctctatcagtcctacggggggcccgtacccccccggcaaggtcacgtcatcatagggatcgcgactgcaagacacctagtggacccgaagaagtccaacaggttctacggagtacctgtcacctccagcaagggcatcaggccccctactaatcgagctttcatcaagaagtactgcgccccagacaggcgcagggcgaacaccacagcagcattgggatg

SEQ ID NO: 18945 - DNA, 966 bp, Glycine max
  Peptide Sequence Number=SeqID_110630
atggatggtttggtggacctagccgcaattgatgctttccttgcatatcaccatggcaaagaaagcccggtggtagctatcttggcagacttatttgacacatttgaccgaaggtgcgagaagagtaacgcacggattatctgttgtttacccactctttgtgtatggttggtttcacgcctattccaacaagacataaggcatccatgtccgctccgaagctattcgtgtgtcaaaaagagaagagtagattgggaccaacacttggctgggataggaggtagaacaatcagctggtttcctcgatggaaggaaggaaaggagggagtcctcttctcatgtggggactacccaaacattccgttgatagggacgaggggttgtattaactacaatcctacacttgctataagacagttaaggtaccctatgaggggagcatcgattgaagagagcctctctcctttccttattatcgacaaagaaagcttcgaagctctagaagaggatgaagaagtccgagctctaaaaacagaactaggaaaagcaagacttgccaaagaaaaattcaagttggtcgctacagacgtccgaaaagagtgtgtcgggttacaagaagaaaatacagctaacgcaaaagcccttcaacaagaaaccaagagggctcgcaaggaagagcatggccgtgacaaatttcgtggagctttatggggcagcaacagtgagctcaagcttcgaagggaagagagagaccaatcacgagcacataacatggtcttgaaagaggagtcagctgcttgctcaaggtccaaaagaagcttgtctcagcgtttatgcgagacagagaccaacatgttagccatcatcagcaagtaccaagaagagctaaatctagccacggcccacgagcataaagtggcggacgagtatgcccaagtgtacgcggaaaaggaggctagaggaagg

SEQ ID NO: 18946 - DNA, 501 bp, Glycine max
  Peptide Sequence Number=SeqID_110631
atgactggcagattacttgctgggtcattaacttttgattgtcgcatcatgcattatatcattgttcgtattttgcttcctcggtcttcaaaccttgctcaagcctctgaggaggatttgattatgatgtgggtctttcaaactattcgtcagatcgactgggcccatttagttcagtatcggatgcataaggcattacgggccaatgcacctctgccttatccccaccttattactctttttcttcatcatttcaacgttcctttgaatgatgaaccatttgtcaaggacttgccaccgcctatttccaacgaacgtaccccatctcctccaccacaaagggctaattctacttctcttttgactgaagtactcacagatctccgcgaccttcgagcttttctgggtgaacgcttcaatgccatggacaccaggattactaggcttgaagatgatatgagcttcatcgggcgtagtttcgctccctcggccgactcttag

SEQ ID NO: 18947 - DNA, 243 bp, Glycine max
  Peptide Sequence Number=SeqID_110632
ataagtaaagaggggaaactgttagaccctaatttcgtccggggactatcattcaatgatatctggtttcttgctagtcaaattacgatgttcgacaccagttaccacacaaagcaaggaatcactcagtgttttgatcgagaatacaaaaagataccaagaaagggggcaaaagggtcatttttcttgatttttctggaccctagctcacccaggctagcatttggcttgcctgggccatga

SEQ ID NO: 18948 - DNA, 60 bp, Glycine max
  Peptide Sequence Number=SeqID_110633
atgtctgtgcaagagtggctattgttcggtcgcggcaagtgcaccggatcacacaagtag

SEQ ID NO: 18949 - DNA, 183 bp, Glycine max
  Peptide Sequence Number=SeqID_110634
atggttggcgagcgggttcgtcttcacatttggcccgtcttcttggaatgtcaaccatcctgcctcgatcaagctctagaccttatgcttgagggctatgcattgctcaaccgaatgccccagagttcccccatgctacgcacaagtcgcattggggttgtaccactttgggaaaggagactg

SEQ ID NO: 18950 - DNA, 144 bp, Glycine max
  Peptide Sequence Number=SeqID_110635
atgtggaccactacgggggagaagcttgccgcccagctcgcccaggcgagcaaggttgcttcctccagaagcaacagccttctggaggaatcttctggagggcccaagtgggtctggttgctatttgcaccccctatttactaa

SEQ ID NO: 18951 - DNA, 693 bp, Glycine max
  Peptide Sequence Number=SeqID_110636
gctgacgatggccagcccggcaacgcgggccgcggtcatggcgtcctcggtgctggcggcaaagcggccgaggctgggcgccacctcgacgcgatcggggtaatggaagtattgatagaccagcagcgccgcttcgccgtaggcgaatgccggcagcagcttgcccaggtcgggcgcgggcaggcgtcgcagcggcagggaatcgccggcctggccgtcctgcgaggaatacgcatagcgctcgacgcccggcttcaggtgtgcgccagcgtacggaaacgtgccggcggcaaccaggtccggaccgggatagcggcgaaaacgcgagaagcggtcgtttgtcgccgaagcgggttccatatagggctggccgccgccgtcggtcgaggatccggcgcgatagtccagccagagcgtgcgtccgctgaagttgacgtggttctcggtgatcgccgggttggcgccgcggaagcggtcggcgccggcccgccggatctggtcgtcgatcggcacgatcatcaacgccaccaaagatggcaggaacaacagtccgtgcaccctagcgggcacctggccgcgatcccgcaccagcgccgccatgccccagccgaggttgtcgctggagacggccaccagccccaggatgccaggagcgttgccagcagcagcgacacgatgatgccaaacagatag

SEQ ID NO: 18952 - DNA, 578 bp, Glycine max
  Peptide Sequence Number=SeqID_110637
atgaagatcaagaaaagaacaaaagaaaggaaagaaggattcccgatcaaagatcgaaaggaagtgaaaaggggaaaagaagcaactcttgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattgctagaagttgacatcctacccttcattctcggttacaaggaagattacccttggcgcaagtatattgtttctctaagacgtggtgctctcgcgaatgatttatttttctttgcaaaaagcatggctgttcatgtgttctccacttttgagtctggagctgtgttccatgattgtctaagagaggaccctcaaggcaatcctccattctcatccttttccagagccgcggctgttcatgtgttctccacttttgagtctggggctgtgttccatgattgtctaagagaggaccctcaaggcaatcctccattctcatctttttccggagccgc

SEQ ID NO: 18953 - DNA, 468 bp, Glycine max
  Peptide Sequence Number=SeqID_110638
atggaagcatgtttagtggtaggagacctattgcaacaaatgatagaccaaggccggcttgaagtcagtgatgagggggaagaagaacaacatatatgcatgcaatccgcagataaggaaggtcctagaaagcctaaacctttgaacagccacatagttccgtggaggtacgcgtcttcgagcgataagaaggaagaagctatcgacatcagctcactattggccaaacctgcaaacgctaaagggaaagcaaggatgacggaaggacaaaatgtcaaagtgatccccacaccggacgaggacgttccaatgaaaggtctttccgagggaggagagggctgtggcaagaaagaggtatcgctcgaggaggccggcgagttcctctgcattatccaacaaagcgagttcaaagtcattgagcaactcaacaaaacctcggcaagagtctctctttggaactgctcatga

SEQ ID NO: 18954 - DNA, 134 bp, Glycine max
  Peptide Sequence Number=SeqID_110639
atgaagcatacctctaaacgcgaaggtggaggactcatgaacagctgtcgcaacctacccttcggcgggagggcgacgcgtgactcgcgggatgcgtgttccacgaaaggaatacgcgcggagtcgccaccaac

SEQ ID NO: 18955 - DNA, 591 bp, Glycine max
  Peptide Sequence Number=SeqID_110640
atgttgagtcagcatcccaatatgttaaactacactgactctgtgataaagagagaatctcctctatccctgcattacaaactgtttgaggggacacatgtcccagacattgtctcgacatcagggaaagctgcttcaggtgctgtgtccaaggatgccttgattgcagaactcaaggacacatgcaaggtgctggaagcaaccatcaaagccaacacagagaagaagatggagctggaacggctgatcaaaaggctctcagaaagtggcattgatggtgaagcagctgaggaagatggtgaagcagctgaagtagaagaagaagctgctgaagaagaggaagaagcagccgaggaagaagaagaagctgctgaggaagaggaagatgcagcagaaggagcttgccacccagctcgcccaggagaggaaggagcttgccacccagctcgcccaggcgagctagataacgtaatcatcccttttttggctttcggaatgttatggaacctcacggattgcgtaacaatgcttccttttgatttccggcatgttacggaatttcacggatcgtgcaacaatgctctcttttga

SEQ ID NO: 18956 - DNA, 132 bp, Glycine max
  Peptide Sequence Number=SeqID_110641
atgtctgcattacctttcacttacccttgtctcaattttggtgtgttttacttaaacgcttacggcaccccattgatcaggccaaatggctccggatttgatgcaatcctaccctgcaagggcattggatag

SEQ ID NO: 18957 - DNA, 525 bp, Glycine max
  Peptide Sequence Number=SeqID_110642
atgtggatggataggttcgctttcaccttgaatgggagtcaagagcttccaagactgctagccaaagctaaagcaatggcgggcgtgtactcgacccctgaggaagtgcaagaacagatgaaggcagatatggtggccttgaaagatcaaatggcttccatgatggaggccatgttaagcatgaaaagaatgatggaaagtaatgcggccacagctgccaccgccagcaccgccgctgaggcggatcctacccatccatgtgccataaatcaagcacatcaacccatcccagacatggtgggacaaggagaagtattgggcggcaccgatggtctacacatggggtataataggaatgcttacccctacggcttaccccccaattatacgccgcccaccatgcacgtgcctaatgagaaccctataggaggcgtccgtgaagaacctcgggagcgtgctcaagctgatttcgacctatatcccactttcaccaccgagggaccagcatataacgctatgccttag

SEQ ID NO: 18958 - DNA, 441 bp, Glycine max
  Peptide Sequence Number=SeqID_110643
atggtcaagcgacttagcctcctcaaaggaagaagttcatcacatcgaccatgtcatcgtcctcctgagcaacatcctcaccttcgagggtccctgcgggtcctgcccctgcctgaaattgggcctatctacaggccatgcaactgtggccccgaactgctctgggggtgtactggtaaaagctctcattcaactgcacccgacccctatgattggccacttgctggtcagccacatgctacatgtagagttccatcctctagatgtgagcagagatggactctagggatggcggctgctatggaggtggcggtggtgcatatgcgactagctactgctgatgtacttttctataaaggtcctgttaataggaggccagataagctttgtgggcgtaaccggcaccccatagaactggcagagacccgtgatcaagggtag

SEQ ID NO: 18959 - DNA, 345 bp, Glycine max
  Peptide Sequence Number=SeqID_110644
atggggtcaaacactttcttaagtttgaagatcccagtcaatgagaagcatgagactggagtctttaaggccgttgcaaagacaatggacacatccagattaccatctcggacattagctattcctgctagcctagtcaaaaagggtagcaaaggcttaaagaatattttcaaagcagggttgcttctggaggaagcaacccagctcacctggccgagctgggtgaggcggcaacctcctccccccttttcctttaaattggcgaagggaggttgttctaaagatccctaccccccttggctatgcatttcagttgttttgggtgaaaacaaattgtttccgtga

SEQ ID NO: 18960 - DNA, 556 bp, Glycine max
  Peptide Sequence Number=SeqID_110645
atgaaaagagaaaaacatgtctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaacaagtctacttcaaaatcttatagctctcactcttatccaaagaaagaccaaggtcaaggcatcttaggggcagcaccttctaagcccaaagatgataaggggaagacaatagaaaagcaacccctaaggctagctactacttcaccttcctctagtgaaagtgaagaagaaaaaggggaagaatctagtgaagaaatctacccccaagaagaaggacaacctttaatggttaaggaggggtgtaaggagacacttgttagcattgccatacctattgggcttgagtttattcctcaagtaaaggagttgttggatgagg

SEQ ID NO: 18961 - DNA, 610 bp, Glycine max
  Peptide Sequence Number=SeqID_110646
ggcgtacggccaggaaaaacgcgcgcagcggatgcgcagcagcctcgcgctggggcggcggatcaccgagacgatatatgagactggatacgggcgacgccgaactggcgaaatatttcagacctcaggagctccagatgtcgatcacccagcgccacctcttcgtggcggtatcgcctccttatcctcgaagctggtcgatatggtcggcctacgggacggagagcccgcgaccgcgagcccctgccgggatgcgcgccgtgccgccagggtcggtaatctctatgacgagatcgcccgccgacgtcggtcgcccccgcgccatcggcgccgtcgcgagcgccttcgcgccagcaacccgctagcggtggccatccctgtcaccgggtggtcaagagcccagacggcgggtactggagtactggggtcttcgatcacggaaacgggcgctgctgtgcgcgaaggcgccgaaacccacgcagggtcatctgcatcgtctcttccgcgcccggaccggtcttacccccagggcgtacggccaggaaaaacgcgcgcagcggatgcgcagcagcctcgcgctggggcggcggatcaccgagacgatctatga

SEQ ID NO: 18962 - DNA, 399 bp, Glycine max
  Peptide Sequence Number=SeqID_110647
attggtgccattgtcagtaatgatcttcctagggagtccgtaccgataaatcagctccctctttatgaatctgaccactacactcctcgtgacattggtgtaggaagccgcttcgacctatttggtgaaataatctattgccacgagaatgaagcgatgaccgttcgaagcttagggttcgatggcccctatgacgtctatcccccacatggaaaaatgccaaggggcgaacatgacattcagaggatgtggcaggttattaacattgtcagcgaacgcttaacatttaaggcatttcattacatgggtgcaacaatcactttccatggtgagccagtaataacctgctctcaggatcttcctggccatagcatgcccattggcgtgtgttccaaatga

SEQ ID NO: 18963 - DNA, 297 bp, Glycine max
  Peptide Sequence Number=SeqID_110648
atggaggtcaacacggctatagtcgttgccgcaagtaccgccattgaggtggacctgactcacccatctagcctcaaccaaggtaaatcgccagcgtcggacatggtaggtcaagaaggcaaagcattgggaagtacgggtggcccccattttgtgcaggtccaaagcaagcattccttcccaccatatggcttgcctcccaactatacaccacccaatgttgcacacactcccgatgagaacatcgataactccactcccatactcattgaaggccaacaaccccaatttggatag

SEQ ID NO: 18964 - DNA, 270 bp, Glycine max
  Peptide Sequence Number=SeqID_110649
gaatgtcctgaattgaagttatcctctcatggaaggaaggttcaaaaattcggggttcctactgcagagatagaagggttagttgctgccacaggattaagtcctctgatcgcatgttcattggacactggcgatcggggacttatatcggcttttgcggagatgaggcataaggaaactagcagtttccatcttcttgtaggagaggtgaccatcaccctcgatggtggcctctttgcttcatttttccatcacaagcgccttccataa

SEQ ID NO: 18965 - DNA, 366 bp, Glycine max
  Peptide Sequence Number=SeqID_110650
atgggagcgaatgggattagataccccagtagtcctagccgtaaacgatggatactaggcgctgtgcgtatcgacccgtgcaatgctgtagctaacgcgttaagtatccctgcctgggggaggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 18966 - DNA, 570 bp, Glycine max
  Peptide Sequence Number=SeqID_110651
atggatgctcatccgtgtcaggatggcgtacaccagctggcacttaggcatggggaggtcggaattatgatcggtgggcaggatgttgctgaggagcaacgtcatccatatctgggtcagggtggtcatattggtgcgcatgattcgcactcgcctccctgcagcagtccgggcaaaatcctgccccgaccggttcctcctctggccatactcgcattcctggccctcttccaataccatcggatatcccaggagctggctgatagcgtcggcatcgaacgggatccactgacccctaacccaggatctcatgtcacgcacgccctcctctgttggccaagcattggcataaaactcaaggactatttctggatcaaacttggccatgggagtaaccagtggtgcccacccgccgggcgccctatttcctcctggaaatcagtatactcgtcgtcccctgagctggacgcgtcgctcccggagaaacgaccatcccttgatggcctcgaagcgctgctggtgtacagcactcctaaagccggtgactatcatactccggagcggaactag

SEQ ID NO: 18967 - DNA, 363 bp, Glycine max
  Peptide Sequence Number=SeqID_110652
atggagatatacacctcggagggggaaggagaagaagccaccgacgtcagctcgttgtcggctaaggtaacaaatatcacgggactgagtggtgtgactcgtagtggtcgtgtgtttgcacccgcggacctaccagtccaacccgcaaatgtcaaggggaaagcaaaagtggtggaggaacaagatgacgaagcacccctcacttcgaataaagatattccggcgaaaggtcttccggagaacaaggatggtaaaaaagaggtgtcactagaggaagccagtgagttcctccgtataattcagcagagcgaattcaaggttatcgaacagctcaacaaaaccccggccagggtctcgctgtag

SEQ ID NO: 18968 - DNA, 165 bp, Glycine max
  Peptide Sequence Number=SeqID_110653
atggagaaaaatgaagaaacaacaatggaagagaagcttgcttgtggagcttctatggaggctggatctttgagcttgaatgaggtcctttataaagtgattttccaccatggagatgcagcggaagacaaaggagaagaggtaagaggcggcgccatccactag

SEQ ID NO: 18969 - DNA, 300 bp, Glycine max
  Peptide Sequence Number=SeqID_110654
acaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccaagggtgattttgttgtcgagtttacggttggtattgataaagtttccatcattcattatgaggtggatgacatcattgttgggttgaa

SEQ ID NO: 18970 - DNA, 1002 bp, Glycine max
  Peptide Sequence Number=SeqID_110655
atgctgcaggtcgactctagaggatcccgtatgacagtcaccgctttaggagcactgtacaccaacagcgcttcgaagccatcaagggatggtcatttctctgggagcgatgcgtccagctcagggacgacgaaggagggcgtgcgagacatgaggtcctgggtaaggggtcagtggatcccgtttgatgccgacgctatcggccagctcctgggatatccgttggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctaactcagatatggatgactctgctgctcagcaacatcctgcccaccgatcataattccgacctccccatgccgaagtgtcagctggtgtacgccatcctgacgcggatgagcatccatgtggctcagttgatcgctgatgccatctatatttttgcaggtatggcgcctactaggcaccctttggacccagataagtccaacagggccctgggatttccctcgctgatcacaggactctgccagtcgttcagagtccccgttgcacctaccaaggtaattcggccgcccatcacccgggcttttattgagaagtactgtactcagagacaggctcagggtgatgctccacaggtcgcaggcgcgcccccaccacctcatcaggctggccaggctgggtcatttgacatggagcagtatttacggcatttggttcgccagcaggcggccaaccaccgggcacatttcagggcagaggttgcatggcccggagattggcccgaggcccaagcaggagaggcgcccccagaagctcccggcgatggaggagaggcccacgaggacgaggagatggccgatttgcttgacttcttgggaggaagtggagatacatga

SEQ ID NO: 18971 - DNA, 342 bp, Glycine max
  Peptide Sequence Number=SeqID_110656
atggagcagttcagggagatgttagcctggcctgggacccaaccttctcttcacagggaagatgaaggagaagaggcagatgagacacaggtgagacaggtagctgctaccactcccgagagatcccttgaggccactttagagcctcctgcaccagtggtggacctaccctcacctcagcatacagcagacccttccactcctatcttagagataccagaggacccgaccacaccagtcttggctatggacacttctcctccagctactccaatacttcatctaacagatgaagaggatgttcagacacaggacacccaggaccagtcacaggaattctaa

SEQ ID NO: 18972 - DNA, 372 bp, Glycine max
  Peptide Sequence Number=SeqID_110657
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggctctcagccacatggatagtttaatgtgctcattggcacctgaccctgagatgtggatcatccaaggcatattagcatggcgtacttctcctgtttga

SEQ ID NO: 18973 - DNA, 614 bp, Glycine max
  Peptide Sequence Number=SeqID_110658
cggatatgaccggaaggcttcttcccggttcattggattttgagagccgcatccttcattaccttattgttcgtatcttgcttccaagatcttcaaaatttgcacaggtttatgaagaagatcttattgttatgtgggcttttcataaaggccgacaaattgattgggcacacttagtacaatatcgcatgaataaggcattgcgattaaatgctccatttccatatccacacctagtcaccctcttccttcaacactttaacatccctcttgattctgaaccttatgtttcaatcaagagatcctttctaataggcgcttcagtcattgcatcctttggttatcaaaaagagcatgatggctcttgggtgaaaaagggtgctcaacatgttgatgaagaaggacatggtgaagaagattcatctcttcttcaaaagattttggataggttcgatggtcttcaaacctttgttggagaaaggtttgctactttggagttacaagtggacatgcgcttcaatgagatggagtcaagaattgccaaggtcgaagaagatgtttcttatattcgttcaagctttgatctaccaccaccgccgccaccatcatcttag

SEQ ID NO: 18974 - DNA, 1143 bp, Glycine max
  Peptide Sequence Number=SeqID_110659
atggcacaagaaacctttctattcacatctgaatctgtaaacgagggtcaccccgacaagctgtgcgaccagatctctgatgcagtacttgatgcgtgccttgaacaggaccctgacagcaaggttgcctgtgagacatgcaccaagaccaacatggtcatggtcttcggagagatcacaaccaaggccaacgtagactatgaaagattgtccgcgacacatgccgcgaaattggattcatctctgatgatgttgcaacagagcccggatatcgcccagggtgtgcacggccacttcaccaagcgcccagaggaggttggtgctggtgaccagggtcacatgtttgggtatgccaccgatgaaacccccgagtacatgcccctcagccatgtccttgcaaccaaacttggtgctcgcctcacagaggttaggaagaatggcacctgtgcttggttgaggccagatggtaagacacaagtaaccgtcgagtactacaatgacaatggtgccatggttccagttcgtgtccacactgtcctaatttccacccaacatgatgagactgtgagcaatgatcaaattgctgcggaccttaaagagcatgttatcaagcctgtcattcctgagaagtaccttgatgagaagaccatcttccaccttaacccttctggccgttttgtcattggtggccctcatggtgatgctggtctcactggaagaaagatcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcattgtgcaagtttcctatgccattggtgtccctgagcccttgtcagtgtttgtggacacttatggaactgggaagattcctgacaaggagattctgcaaattgtgaaggagaatttcgacttcagacctggaatgatcaccattaacttggaccttaagaggggtggtcataggttcctcaagacagctgcttatggacactttggaagggatgatgcagacttcacctgggaagttgtgaagccactcaagtcagagaagcctcaagcttaa

SEQ ID NO: 18975 - DNA, 1344 bp, Glycine max
  Peptide Sequence Number=SeqID_110660
atgaagcattctcacattttaccactagcatcctgtatctttttccttactttagttattctcgtccaagctaggcatcattctcatcatgcaaaacacaagcactcacatcctcataaatcttctaaaactccaaagcctgcaccacctcctagccctccacataatcagaactataacaatgcctctggcattttcgatttacgaaaatttggagcaataggagatggagaaacagatgatacagagtcattcaagatggcatgggacagtgcttgccaaagtgaatcagcagttaatgttatccttgtaccccaaggtttctcctttcttgttcagtccactatcttcactggtccttgtcaaggtgtcttggagttgaaggttgatggaactcttatgccacctgatggacctgaatcttggcctaagaacaacagtaggcaccaatggctggtcttttaccgaatcaatggaatgtcactggaaggaagtggtttaatagatgggagaggagaaaaatggtgggaccttccctgtaagcctcacaaggccataaggtttttcatgagttccaacttgactgtgcaaggacttaggataaagaacagtccccagttccatttcagatttgatggctgcaaaaacgtccatatagaatcaatctacataacagctccaaaactaagccccaacactgatggaattcacatagaaaataccaatgacgtgaaaatatacaattctgttatttctaatggtgatgactgtgtatccattggatccggttgcaatgatgtcgatattaagaacattacatgtggacctggtcatggaattagcattggtagtctgggaaatcacaactctcgagcctgtgtttcaaacattatggtgagagactccttcataaaagtgacagataatggggttaggatcaagacttggcaaggtggatcaggatcagtatctggagtgacattcagcaatatccacatggttagtgtaagaaatcccatcataattgaccagttctactgcctcactaaggagtgcaccaacaagagctctgcagtatctgtttcaaatattatttacacaaacataaagggcacttatgatataaggagcccccccatgcgttttgcttgtagtgactctgttccatgcaccaacttaacactctcggatattgagcttcttccttctcaaggagatatagtgcatgaccctttctgttggaatgcttatggagatttggagacactaaccattccaccggtttcttgcttgcttgagagcactcctcagttagtgttagactatgacataactcgttgctga

SEQ ID NO: 18976 - DNA, 1464 bp, Glycine max
  Peptide Sequence Number=SeqID_110661
atggctaatagatccgatccggatattgatgatgattttcttgagctttataaggagtacactggccccctggggtctgctactacaaacacgcaagagagggcaaaatcaaataagaggtctaatgcagggtctgatgaggaggaggaagcccgggaccctaatgctgttccaaccgatttcaccagccgagaagctaaggtttgggaggctaagtcaaaggctacggaaaggaattggaagaaaaggaaagaggaggaaatgatctgcaagctttgtggagaatcagggcatttcactcagggctgcccatctactcttggagcaaatcgcaagtctcaagatttctttgaaaggataccagccagagacaaaaatgtgcgggcacttttcacggagaaagttttaagcaagattgaaaaggatgttggctgcaaaattaagatggatgagaagtttattattgtcagtggtaaggatagattaattttggccaaaggtgttgattctgtgcacaagattcgagaggagggtgatcaaaggggaacatctagttctcaaatgacccgatcaagatcacctgaaagaagtcctgttagtgctcggtttcaacgctctgagccccaaaggtctcattctggacctcgaaatacatctcagtttcaacaaagatttggtaggcaagagcgggcggttgaagaccgtatccgggatgacgtgcaaaagttttctagaggttctccacaaggtagggacagcataggatatgtttacagcatccttagaaagctgcaagagtgcttaacatactcttcatttcctgaagcttatggaaatagtggagctagaggtcgttcaagccagtcaagatctccaagacatgccccttatacaggaaactcatataactcatttgagggtcgtaatcaaaacatgggtgcttataggaatgatgggtgggattctcatagaagagaatctggtatccggcctggtcatcagtttgattacagcgcctccccacagactttagaagaattagagttggagtacaagaatgaggcagcagagctaatgaaaatccgtgacagagaagaagatgaagaaaatttcaagcatcgtgaggctattagagatttgagggagaagtacatgagcaaagtttccttggtaagggacacacatgcaaaacagtgggaaggatttcttcagcttgatgcgcagaggcgtcaacagcaggcagttcaacagatgccttctggttatcggggttttaaacagcagagctttcctgaatatgatggatccactgccaatcctcctccttatgctggttctaatctaccattggaatcgaggaacaggttctcagacaacatggaaacttatcctaataggcctcatgataattttggtgaatttcataggcgtggagatttcgcaaaagcttacaacagatattaa

SEQ ID NO: 18977 - DNA, 2070 bp, Glycine max
  Peptide Sequence Number=SeqID_110662
atgaagagttttgctgctaaggttgaagaaggaagagaaggtataaatggtgaactatctataggtccggtatatcgcaaccttctctccaaaaatcaatttcctccactggatcctgatttaagtactgcatgggatattttcagcatggctgttaaaaagtatcctaaaaaccgtatgttgggatggcgtgaatttgttgatgcaaagataggaccatatgtctggaagacatataaggaagtttatgatgaagttttgcatattggttctgctttacgagcatctggtgctgaacttggttctaaaataggaatttatggagctaactgtcctcaatggatcgtggcaatggaggcttgttgcgcgcatagcttggtttgtgttcctctatatgacacccttgggccaggtgctgtaaactttatcatagatcatggagagctggattttgtgtttgtccaagataggaagacacttgagaaacaaatagaggtacttattgggtacatgtactattttcagcttttgaatcctgattgtaaatctgctcaacgactcaaagcgatggtgtccttcacttcattaacagaggaagagaaagataaggccatcagcattggaattaagccatattcatggcaagagttcttgcacatgggaaaagaaaatccatcaaacatttcggcacctcagcctaataatatctgcacaataatgtatacgagtggaaccagtggagaccccaagggtgtagtgttgacgcatgaaaacatagcgactttcgtgagaggaatggatcttttcatggaacaatttgaagataagatgactgtagaagatgtgtatttgtccttcctcccattggctcatattcttgatcgcacgatcgaggagtactttttccataagggggcatctgttggatactaccatggggatctaaatgcgttgagggatgatttaatggaattgaagccaacgtttataaaactcatcaaagatcatctgtttctttcaggtatcaaaaaagcagtggaagaactcaacccagtaaggagaagagtttttggcatgctctacaaacacaaactaggttggatgaacaaaggatataaacattgtaatgcatcgcctttagcagatctgttagccttcagaaaggtcaaagctcggctaggtgggcgtgttcgactaataatatctggaggtgcacccttgagctcagaggtggaagaattcttgcgtgttacttcttgtgcctttgtatgccaaggctatggtttaactgaaacttgtgggtcaactactctcgcctatcctgatgaaatgtgcatgcttggcactgttggtcctgtatctgtatacaatgaaatgaggctggaggaggttccagagatgggttacaaccctcttggaagtccttcatgtggtgagatatgtctgagagggaaaactgtttttactggctactacaaaaaccctgagttaacaagggaagccataaaagatggatggtttcacacaggagacatagctgaagtgcagcctaatggggttgtaaagattattgacaggaaaaagaaccttataaaactttctcaaggagagtatattgctcttgagcatttggaaaatgtttatggaatcactccaatagttgaagatgtgtgggtttatgggaatagcttcaagtcagctttggttgcagtagtagttccaaatgaagaaattaccaagaagtgggcattttcaaatggtcacattgctcctttctcaaaactgtgttctcttgaccaattgaagaaacatgtattgtctgaactcaaagtgactgctgagagaaacaaggttaacatctatgaatatgaaaataatagtttaactcaaatgaagaaacacggctttgaatatatcaaaggggtgatattagacccgcaaccatttgacatggaaagagacttggtgacttcaacaatgaagaagcgaagaaataatatgctcaagtattatcaggttgaaatagatgacgtataccgaagtttgagtggagataaggctaaaatttga

SEQ ID NO: 18978 - DNA, 875 bp, Glycine max
  Peptide Sequence Number=SeqID_110663
atgggggtgaagatacaggactatgcttctaatatggagagtaataattatccattctttgatttctctgaagataagggctctttagggtttatggagctattgggtgcgcaagactatagtcctctccttgatttccctctatcgtcacacgtgtcagggcctcaaacctcttctgttaaggaaccacctgagactaagaaagagtgttccgaggctaagaagacaaatcagaagagacagagagaaccgagattcgcgttcatgacgaaaagcgaggtggatcatctggaagatggatacagatggagaaagtacggtcaaaaagctgtgaaaaacagcccctttcccaggagctactatcgttgcaccagtgtttcatgtaatgtgaagaaacgtgtggagcgatcttttagcgacccaagcattgtggtgacaacctacgaaggacaacacacgcatccaagcccagttatgggtcgctccaacaactttggttcggtaattatgtctggatctgctggaaactacatgtcccaatattatcagcagcagcatcaacaagtccacatcgatgcattgtcctctttgggtttcctctcttcttcgtcttcaaggaatgccacttttcctcaagagactgccttgttaagtgactatgggcttcttcaagatgagaatatagatgaggactttgttgctgcactgggatatttaagttttagttttcattctcatcatgatcacacttgtaaaacccacgaatgtgcgttcgtatcactggcacggccctgtagattgttaggtttacgtttttcaaaacgggaaccaattggggatacggtggccaaagatctgacccaatatggtcatgg

SEQ ID NO: 18979 - DNA, 5916 bp, Glycine max
  Peptide Sequence Number=SeqID_110664
atgtcgaagaggaagttcggattcgaaggtttcggcataaaccgccaatccacctacagcttcgagcgaccccaggcccctcagcgactctacatccctccctccgcgcgtcacggccacgaccactacgaagacaccgacatcgacaacatcgactacgacgacaacaacagcaacaacaacaacaacaaggacgacgacgacgattacgggagcaataataacaacggtggcggcaacgacgaagacgaaatcgaccccttggacgccttcatggaggggattcacgaggagatgcgggcggccccgccgccgaagccgaaggagaaggcggaggaccggtaccgcgacgacgaggacgacgatcccatggagagctttctgatggcgaagaaggatttagggttaactctcgcgtcggacgcgctgcacgctgggtatgattccgatgaggaggtttatgctgccgcgaaagctgtagacgctggtatgattgagtatgattccgatgataaccctattgttattgacaagaagaagattgaacccattcctgctcttgatcactcttccattgattacgagcccttcactaaggatttttatgaggagacaccttcaatatcaggtatgagtgagcaggatgtaagtgaatacaggaagagtttggctattcgtgtatcaggttttgatgttcccaagccaataaaggcatttgaggactgtgggttttcttcacagattatgaatgctattaaaaaacaaggatatgagaagccgacaactatacaatgtcaggctttgccagttgtgctttctggcagggatatcattggtatagcaaaaactggttctggtaaaactgcttcttttgtacttcctatgatcgtgcatatcatggatcagcctgagcttcagaaggaggaggggcccataggggtgatatgtgcacctacccgagaattggcacatcagatttttctggaggccaagaaatttgcaaaagcgtatggggtacgtgtctctgctgtctatggtggaatgtcaaaacttgaacagttcaaagagcttaaggcgggatgtgagatagttgttgctacccctggcagattgatagacatgctgaagatgaaggcattgacgatgatgagagcaacttacctggtgcttgatgaggctgatcggatgtttgatcttgggtttgagccgcaagtaagggaaatcctttctgatcctattagagttactgttggagaggtggggatggcaaatgaagatattactcaagttgttcacgtaactccttccgattctgagaaattgccctggcttttggaaaagctgcctgaaatgattgatcaaggtgataccctagtttttgcttcgaaaaaggctactgtggatgaaattgaatcacaattggctcaaagaggctttaaagttgctgcattgcatggtgataaagatcaagcttctcgtatggatattttacagaagtttaaatctggcctctaccatgtgctaattgcaactgatgttgctgcccgtggtcttgacatcaagtcaattaagtcagtggtaaactttgatattgcaaaagatatggacatgcatgtccatcgcattggaagaacaggccgtgctggtgacaaggacggggttgcatacactcttataactctgaaagaagcacgatttgctggtgaattggtcaatagcttagttgctgctggtcagaatgtgtctgtggagttgatggatcttgctatgaaggatgggagattcaggtcaaaacgtgatgcaagaaaaggaggtgggaaaaaaggcaaaggtagaggaggaggtggtgggggtggccgaggtgtgcgaggagtggattttggcctgggcattggatataatcctgagtcaaataatgcaccatctaccacagctcccagtcgatctgccgctgtaaattctctgcgaacaggaatgatgtcacaattcaagagtaactttgttgctgcttcatcaaactctcagaatcaaggctttggtaacaatacaagcatgactgctaataagagaacagcactccctggttttgtatccggtggatcaattggtggtgacataaatacttatcagagtactgcttcacccaatcctgctacatcagcggtaatttccaccagtcaaggttatggagtaaatcctggtcagaagagcacgaacagttctaaacctaaagaaaggcggagaccatcagatctgtttatccaccttaggttgaattcatcgccgagcatcagatccgaaatgtcgatcggagatgcttttctgtgcttactgttcatcgcaacttgttggatttccgctgcttctgctgattccatctatggctgcggtggatttgtcgaggcgagctcatcgttggtgaagtcgaggaaacaaactgatgccaaattggactattccgatgtcacggttgagcttcaaactgtggatggactggtaaaggatagaacacaatgtgctcccaatggatactattttattccagtatatgacaagggttcctttgtaattaaaattaatggacctccaggatggacatgggatccagaaaaggttcctgtggttgttgacaataatggttgcaatggtaatgaagatataaactttcgtttcacaggattcactatatctggtagagttgtaggagctgtagggggagaaagttgttcagttaaaaatggaggtccttcaaatgtaaaagttgaactattgtctctttcgggggatcttgtctcttcagtcttgacttcatcgtcagggagttacttgtttacaaatataattccaggaaaatacgaactacgtgcttcaaatcctgatatgaaagttgaagttaaaggttcaacacaggttgaattgggctttggaaatggggtagttgatgatattttctttgtccctgggtatagtatcggtggatttgttgttgctcagggaaatccaatattaggagttcatattttcttgtattcagatgatgtttctgaagtagaatgtttgcaaggttctgctaatggtccacgacaagaagttgctctctgtcatgctgtatcagatgctgatgggaagttcacattcaattcaataccttgtggaagttatgaacttgtgccctactataagggtgaaaatacagtatttgatgtttcaccgcccagcgtctcagttaatgttaagcatcagcatgcaacagtgcctcaaaagtttcaggtaactggattttctgttggaggctgcgtagttgatggaaatggcatgggagtggagggggtcaaaatcatagttgatggtcatgaaaggtctattactgacaatcaaggatattacaagcttgatcaggtattgccaaatatggcttcgatagaagatatcaatgccatttcatacaatctttgtggtttggttaggatggctagtggtgatctgaaagtgaaggtggctttgactcatggacctgataacgtgaaaccacaaaagaagcaaacagatgaaaatggaaacttctgctttgaggttcttcctggtgaatatcgcttgtcagccattgctgctactcctgagaatgctgctggactcatgtttgctccatcgtatattgatgtcgtgattccccagcttcagtgtgtcactgtaattgtcaaaggagaaaatgatgaggtatctcccaatgctgttgaaatgatcgtagaaggagctaccaatatgggtgactctgtatgccttcattcaggagatgatggggctttggtcaatattcatggtgatgtatcctgcaaggagaaatgtggtccgtttgtatctgttactctggtgagacaggctgataaacataatgaagagagaaagacaattagcttgaccaccaagagtagtgaatttctgttttcaaatgttattcctggaaaatacaggcttgaggtcaaacatagttcccctgaatcagtgaccttggaagataattggtgctgggaacagagcttcatagatgtaaatgttggtgctgaggacttagaaggaatcctttttgttcaaaaaggctactgggtcaatgttatctccactcacaatgttgatggttacctgactcaacctgatgggtcaaatgtgaatttgaaaattcggaaaggtttccagcatatatgtgtagaacaacctggtgtacatgaatttagttttgttgactcatgtatcttctttgggagttcatcagtgaaaattaatacatctgatcaattgcccatccatctaataggagagaagtatcttcttaatggacaaataaatgtgcagtctggctcacttgatgcattgcctgataatatagttgttgatattaaacatgatggagctggtgttattgattatgctacagccacatttaagtcccattcaaaagatcaaatggaggctgctatatttgagtattccgtttggaccaatctaggagaaaagcttaccttcattcctcgcgactcaaggaatgatgggcagaagaaacttttattttatcctagagaacatcaagtatcagtgactgatgataattgtcaagtttatattcctacattttcttgtcaactgggtgtatatattgaaggatcagtttcacctcctctttctggcgtccatatcagagtttttgctgctggagatagcagctttactacacttaaaagtggtgaattggttcttgaaacgaccactggtattgatggttcctttgtggcaggtcctctgtacgatgatattggttacaatgttgaggcttcaaagcctggatatcatttaaaacaagttgcgcctcattcttttacttgtcagaagcttagtcaaatttcagtacacatacatcacaaagatgattctaaagagcccattccttctgttctgttgtctttgagtggtgacaatggttatagaaacaactcagtatcaggagctggtgggacattcctgtttgacaatttgtttcctggaatgttttatttgcgtcctgttttgaaggagtatgctttctcacctccagcacaggcaatagatcttggagcaggggagttcaaagaagttgttttccaggccacacgcgtagcctacagtgctacaggtatagtgtctctcttgtctggtcaacccaaaggagaagtttcggttgaagcccggtcagagtcaaaaggctattttgaggaaactgtgacagattcatctggaaattatcgtctgagaggactactgcctgatactgactatgttgttaaagtggctaaaagggatgtgggcagttctaatatagagcgtgcatctccagattctattgctgtcaaggttggaactgaggatatcaagggattggattttatagtttttgaggagccggaaatgacaattataagttgccacgttgaaggaaatggtacagatgaactacataaacacctgatggtagaaatcaggtcagctagtgacctaaacaagatagagtcagtcttccccctgccaatttcaaacttcttccaagtgaagggcttatcaaaaggcagacaccttctaaagcttcaatctggtctcccatcaagctcgcttaaatttgaatctgatatcattgaggttgacttggagaaaaatgttcagatccatgttggtccaatgagatacaggattgaagatcagctgaagcaggagttgactccggcaccagtattccctcttatagttgcatttctagttgttgcactttttcttagcatgccaagattgaaggatttgtatcaagccacggtagacatacccaccccaggactcactgcggcttcaagaaaagacgtgaagaagccgctgttgcgaaagaagacttattaa

SEQ ID NO: 18980 - DNA, 1566 bp, Glycine max
  Peptide Sequence Number=SeqID_110665
atgattcagaagatgtttgaccccagccgttctggtatgacaagaagctcctcccatgtagcctccatttatgacaatgatttccttgagttggtgtgggaaaacggtgaggttgttgtacgaggaggttcatcaaacagatcacgaaagacaaacgacgaaagaatacatgaagatgccagcattaacaaaagaacaaggttaaacccattattatactcacttgaagatcactttccacctcaaagggactctgacatgagcacttcacaccaaagcaatggccaagattcgtgtggtcaatcctcccaaagcaagcttcatgaagaatttgcaaacttacttaagcccgttagcataggcaataatcacttacaacagtgcttaccttcatctccgctcaagaaacaaagaacagtagattcaactcaaacaccaccaacaccaaaagtgaacttctccaacttttcaatacctgcagtgtttctcaaatctactactcatcagggaaacagtgcaacccagcagacaaacaatcattcgtctccagcaagaatggaggagatcattgaagcccgcaaggttgagcaatcagttaaagaatcacatggttttcaaaagcaaacatccttaactgttgaaagaagcaccaaattaccaaccccaccggttgatgaacactctgaagctgttggtcataactgtggtgttcttggaattcacagatcccaaggtcaactacgttgtgaccaaacctcaacttcagaagcacttattagagccaaggcaaaagcttataataataatgctaacatgtgtcatgaaccgttgctagcatcttcttctgtgtgctcgcttggagcctccaacgacccaaaccttggtctcaggaaacatgaggacactgaaacgtatttaagtgataatgatggagagcctgaagatatggtaaagcaagatagggatggtaacagagtcaggagaatcaggaaccctgtggttcataacttatctgaaaagaagcgaagagaaaaaatcaacaagaagatgcgtacattgaaagagctcatacccaattgcaataaggtggacaaagcatcaatgctagacgatgccatcgactatctgaagaccctaaagcttcagctacagataatgtcaatgggaaatgggttatggccacttatgatgctaccagctgcaaccacggcgcatcacatgaatcctcagctaggaatgggattcaggccaccacaactacctattccaccatcactttctgctatcacagacaacagacttcagatgtttggttgtttcccaaaccaaataccacccatgccagcaatgcctcatgcacctttcttccctatcattgcaaattctgccacacaaccacacttggctaacaccaccaacttggcagaacatttggctgcatctctgcatggaaatgcaacaaagctagcgccaccaagtcagaatatatcagctttagaatctgacattgtacagtttcatgctttcagccttatacaatatactgctccgatgtactaccgatga

SEQ ID NO: 18981 - DNA, 2073 bp, Glycine max
  Peptide Sequence Number=SeqID_110666
atgagcgccaagaacctcaatttcgacgcagacacagctctggcgaaggatttcctttccaactttgcagatgccaatggcgaagccaaatacatgaacatcctgcaagatgttgcaaaccacaaaactcgagcagtccagatcgaccttgaggatttatttaattacaaagatctggacgaggaatttctgagccgtgttactgataacactcggaggtatattgggattttttccaatgcaattgatgaactcatgccggagcccacggaggacttcacagatgatgatcatgacatattgatgactcagagatctgatgaaggagtagaaggcaccgacggttccgatccacgtcagaagatgcctcctgaaatcaagcgttactatgaactttatattaaagcatcttcaaaaggacgaccctctacaattagggaggttaaagcttcgaacattggtcagcttgtaagaatttctggtattgtgatacgttgttcagatgttaaaccattgatgaaagtggctgtatacacatgcgaggattgtggatttgaaatttaccaggccaaaattcaagaattagctgaacatgtccccaaaggccatattccaagaacaatgactgtgcatctaagaggagaactcacaagaaaggtggctcccggggatgtggttgaattttctgggatttttcttcctataccttacactggttttcgagcaatgcgtgcgggcttagttgctgacacttacttagaggccatgtctgtaatgcatttcaagaaaaaatatgaagaatatgagtttagaggagatgaggaagagcagattgcacgattagcagaggatggtgacatctacaataaattggcacgatcacttgctcctgaaatatttggacatgacgacattaaaaaagcactgcttcttctccttgttggtgctccccatcgtacgttgaaagatggaatgaagattagaggagatttacatatatgtttgatgggtgatcctggtgttgccaagagtcagctccttaaacacataatcaatgtagcacccagaggggtgtacactactggcagaggaagtagtggagttggtctaactgctgctgttcagaaagatccagtgacaaatgagatggttcttgaaggtggagcattggtggatattataaaagaacattctaaatttcaggtgttagcagatatgggcatatgtgccattgatgaatttgacaagatggacgaatccgatcgtacggctatacatgaagttatggaacaacagactgttagcattgccaaggctgggatcactacatcgctgaatgcaaggactgccgtccttgctgctgctaatccagcatggggaagatatgatctaagaagaactccagctgaaaatattaatcttcctcatgccctgctatcaagatttgatcttctgtggttaatccttgatcgagctgatatggataatgatcttgaaatggctaggcatgtcctatatgttcaccaaaataaggagtctcctgctcttggattcactcctcttgaaccatctgttctacgtgcatacatatcagctgcaagaagattgtctcctagtgtccccagggaactggaagagtatattgctactgcatactccagcattcgtcaagaagaagcaaggtccaatgctccgcattcctacactactgtaaggacattgctcagtattctccgcatatcagctgcactagcaagactccgtttttctgagactgttgctcagagtgacgtggacgaggcactgaggttaatgcagatgtcaaaattctctttgtattctgaagatcgtcaaaaatctggtctggatgccatatctgatatctattccatactgcgggatgaagcagctagaggtaaccgaatggacgtcagctatgcccatgcactgaactggatatctaggaaggggtacagcgaagcccagttgaaagagtgcttggaggagtatgcagcacttaatgtatggcagatacatcctcacacctttgacattagatttatagacgcttga

SEQ ID NO: 18982 - DNA, 2688 bp, Glycine max
  Peptide Sequence Number=SeqID_110667
atggatgctctgtgtttacacagtagcatttgtgggatagctccgtctccgtccattctcattactgcaactgcacgcgccaatgattacgcgtcacactctcgggtgaaagcggtggggagctcctccttgttttccatattctcttttagataccctttgaagtccttttggccacgaccaacggggaatgccaccggctacaacgacgccgttttggcagagaatgcaacggccgagacagaacaaccagaaggcgaaggagagggacaaaatgggaactgggtttttaagatttttcatataaggtctgtttggagaggggaacagaggagcgatgataacgatgaagaggaagctgtaaccaatggtcaaacggatgaagaggaagaagagtgtgatgattgtagggttgattatgatgatgacgaagaagaagaagaaaatgaagaggtttcgttcgatagagactcgttttcaagaatgcttcggaggccagggaaactcttcaaacactatggtctgcgttttgtaacttcatccatagagaaaaaggaattagctatggcagctgaaaaaaatcagatatctcaaaaagaagaaactaatgagaaggatgtggatgaaacaaaagaggaaaagaataatggtggatacatgataagtgcatctgctgtatacgagattgctgcttctgctgcctcttatcttcatgctcagacaaggagcatactttcattaacatcttctgatgctgcggaaggtgaaggctcaattgaagcaatcaatgaaagctttaacggcgataagattagaaacacggaggaggcaaatttgaaggcaactacggattcggtaacagcagttgttgctgcaaatgagcaagtaaagcaggcttttgcagatgatttgaactcaacaagctcttcaccttgtgaatggttcgtatgtgatgatgaccagacctctacaagatattttgtgatccagggctccgagtcgtttgcatcctggcaagcaaatctactatttgagccagttcaatttgaggggttagacgtccatgtacatagaggtatatacgaggctgcaaaagggacatatcaacagatgttgccagaaattcgtgctcacctaaaatctcatggttcacgtgcaactttccgtttcactggtcattcccttggggggagcttggcattacttgtaaatcttatgctaccgataaggaaggaagcgctattctcctctctgcttcctgtcataacctttggggcaccatccatcatgtgtggaggtgacactctacttgacatgcttggattgccacggagccatgttcaggcaatcacattgcacagagatatagtaccacgagcattttcttgccagtaccctaaccatcttgtagaactactaaaggctgttaatggtaacttccgcaatcatccttgccttaataaccagaagctattatatgcaccgatgggagaactgctgatcctccagccagatgagaatttttcaccaagtcatcatctcctgccctcaggcagtggactatatattttgagtggttctttatcagaatctagtgacacattaaaacaaatttacaaagctcaaatggttttcttgaacacaccacacccacttgagatattaagtgatcgatctgcctatggatttggaggaaccattcagagagatcatgacatgaattcctacttaaaatgtgtgagaaccgtgattcgccaagaacttaaccagattcgcaaggcaaggagagagcaaaggcaaaagtctcgcaaaacgcagcctacaacgcaagttcgcaaccctaacgcgaagctcctcgtcgctcccaaggcctccgccgtctccgtcgcgccagagtccagacatagcgtcgtgaacattttcctcacaaagcgtagaagtatggagggtcaccagtttttcaggatgtccattgaacagaatcataatcagaagcacttatatctcccattggcatcacagctctacagctctattggttcaatgttctatctcagtaaaatcgaacacaaattgcccctgcctccttctcgttttgttcttcctattcgagaagctatacacatggagcttgagaaacttttcttagataaggttatagcaaacttgggcctctgcatttctgtctatgatatcagatccattgatggtgggtttatcttccctggtgatggggctccaacctatacggttgtgttcaatttgattatgtttcgtccgtttgagaaggagatcattactgcaaggcttctttcatctgatgctgatggcttacgattaaccattggattctttgatgatatttatattcctgcaagtcgtttgcccgacccaaaccactttgttgagactgaacagaaaaaaagggtattctctggccaagagtcaacgactaattcctcgagcaagaaaggtgtatggtattgggattataacgaacaagaatatcctattcaagatactgatgtgatcaaattccgagttacaaacgtgagttatccccaaattccggttgagcaaccaaaagaatcaaagccatttgcccctatgttgatctctggagcgatggatgatgatggtctaggtcctgtttcttggtggtttgcagatgaggatgaggatgagtaa

SEQ ID NO: 18983 - DNA, 1542 bp, Glycine max
  Peptide Sequence Number=SeqID_110668
atgaagagcctaggccatcataaattacgtcaatatcttgttaggatccactttttctttaatgagaattctgtggagatattagagattggtcactacgctaagatagagatcttagtagttcagtggtacggtacagactacagagcaataagcactgccgtggaaagcaatggagaagacaatggtggaccatgtaaacagaatgcattcaaggctaggcctcacagtgtgtcgatcttggagtttggggcggttggagatggaataacactgaacacagttgcattcgaaaatgcaatgttttatctcaagtcatttgctgacaaaggtggtgctcaactatatgttccatctggcaaatggctaactgggagttttaacctcaccagtcacctcactttgttccttgagagaggagctatcatcattgcatctcaggattattctcattgggacatagtggatttcctcccttcttatggtagaggaattgggagatatcgcagcttgatctatgggcagaatttaagcgatgtggtaataacaggtgataatggaactatagatggacaaggctctatctggtgggagctgttcagttctaattccttaaattatagtcgaccaaatcttatagaatttgttgattcggttgatatcataatttccaatttgacttttcttgactctcctgcttggggcatccatccagtacattgcagtaacgttcaaattcaaaacataacttctcgtgcaccagctgaattcccttacacaagtggtatagttccagattcttctcggtatgtatgcattgagaacagtaacattagcactggtcatgatgcagtggtgctgaagagtggttgggatcagtatggcattgcctatggaaaaccaacctcaagtgttcacatcagtaatgtttacctacaatcatcatcaggtgctggcttggcatttgggagtgagatgtctggggggatatctgatattattgcagagaagcttcatatactcaactctcctattggcattgaactgaagacaactaagggtagaggtggttatatgagagggatcttcatttctgatgcagaattggaaaatattagcttgggaataagcatgacaggatactccggtttccatccagatgacaagtatgacacaagtgcacttccaattgttggtgacattactttcaagaatgtgattggtgcaaatattagtgttgctgggaatttttcaggaatcgttgaatcaccattctcaacaatctgtctttcaaacgtgactttttctctcagctctgagccatctccttcatggttctgttctaatgtaattggtttctctgaggatgtgattcccgagccatgtcctgatctccagagctcgtattccaagttttccttttcttgtttttcttctctatatccactctttagtaatgtctcaggctatttggatcatcaaccacaagaattacagtcactcattttcattcactctatacatgagatacaaaattcataa

SEQ ID NO: 18984 - DNA, 555 bp, Glycine max
  Peptide Sequence Number=SeqID_110669
atggaacgctctacaaaactcttctcggcggcgttggttctcttcgtggttgtggtggcacaccaggcagcagcctcacaggatctaaaaggaaagaagctaatcaacaaggtatgcacaatcgccccaagcagagacctctgcgttcaaatcctctcatcggacccaataagaagccctaacgcagacctcaaggacttggctgttatctcccttagggttgctgccagaaacgcttccggcatcctcagcgacaccaaaatgttgatcgacgacgacaacctagaccccgacgtccaacaaggtttggctgattgcaaggagacaatcttggacgccgagagccagctcgaggacaccattgcttctttgttggttggttccgacaccgacgcacaggtttggctcaaggctgccgtggccgcaatcgacacctgcgacgcttccattcccggagacgacgacgttctctccgtcaagagtgccatgttccgcaggctgtgcaacattgccattgccatcagcaagctcttgaacaaaccacttaaattctaa

SEQ ID NO: 18985 - DNA, 252 bp, Glycine max
  Peptide Sequence Number=SeqID_110670
atggtgtggggaggcacggaggcaaagaagggatgggatgaatgtggtgtacggctagcgtgtgccaaatatgctgtgttcggtatggattatgaagggcatggacgttctgaagagctgcaagagtataaggcaaaggctagattcttgtatggagagtccatgggaggagcagtgagccttcttttacataaaaaggacccttcattctgggacggtgcagttctcgtcgcacccatgtgtaaggtatga

SEQ ID NO: 18986 - DNA, 819 bp, Glycine max
  Peptide Sequence Number=SeqID_110671
atggctagcagtgtcgttggaggtttcgtgactcaagcattcgtttttatgcttaaggattgttatggcaataagtttttcgaacttgaaaaagctattcgggattacacgtgcaccttagatccctatttccattgctttcattgttcgattggtaacattgattcattagttcacctagttatgatgctattgatgcacgataaagaagagggagaaaagagcagagaaattgttgccactgaggtcgaggtggcattaggcatggcacccgcgcgggaaatgcacggtgcgactcgaagaataaaaatgtgcaacaaaggctttcacgagtttacggctgaaacgaatcgtgaagaaagaacggtgaagaagaatcgaagacctcaaatgaaacggtctccgtggggatctgagttgcaggaagaattgtcatgtctaggtggcattgaagaagttgcactaaattggaatgccatctgtgagaattgccttgggtggcaaggagatagttggggagcgatagtatggagtgagatcagaggaagggaggaggcattaggtgtagaaagagcgaaagagagagagatggcgtcggggtggggaatcacaggaaacaaaggtcgctgctacgatttctggatggatttcagcgagtgcatgtctcgctgccgagagcccaaggactgtgctcttctccgcgaagactacctcgagtgcctccaccattccaaggaggaagagacagatgtggaagtgtttaggctagaattgatttttcaactccccgtttccgctcttgtccacaacagaaaatga

SEQ ID NO: 18987 - DNA, 2604 bp, Glycine max
  Peptide Sequence Number=SeqID_110672
atggctaacccaacacaacctaatgttgggttcacccctgagagagagatttcaaaccctgagaagagtccaattccgccccctccaagttttgtagcctcatcacccggttttcctccaccaaaattgcatttacagcaagatcaagcctcttcccgttccgttaaaaccccaaacgttttatcaccagccaatggggttaccactggcagtcctgttcctcacttgagcacccctcctggaccacctgtttttacttcgccggtccgtccagctgctgttccttttcgcacatcacctgcattgcctcagccacttgcattttctccaggctcttctttgccaacatcatcatcgccgctgcaattttcaaatggaacatttgagtcacagcaccaagtttctgatagtatagaggaccatgttcccttgggagagtcatcctttgttcttttttcagctcataaggtattgaaacagaagaaacaagctaatgtacccagtttgggttttggggcattggtctctcctgggagggaggtttcagtgggccctcagtgtgttatatgtcggaaactgaatggaagtgagggggagtacattgcgcatagcaaggaagatcttcacagatttccggaattatcttcacctatgtttgactatgttcaaactgggaacaagagacctggttttgttccagtttctgattctagaatgtctgccccaattgttcttgttatagatgaatgtttagatgaaccacacctacaccatctacagagttctttgcatgcttttgttgattctctcccgccgacaacgagattaggaattatactatatggtcgtactgtatcagtgtatgatctttctgaagaggctatggcatctgctgacgtgcttcctggggacaaatcaccaagtcaagaatctttgaaagcattgatttatggtactggtatatacttgtcaccaatgcatgcttcgctggctgttgcacattccatattttcatcattgagggcatataagttgaatgtaccagaagcttctcgtgatcggtgcctaggaactgctgttgaggttgctcttgctataattcagggcccatctgctgatctgtcccgggggttggtcaaaaggtcagggggaaatagtagaattattgtctgtgctggcggaccgaacacttatgggcctggatctgttcctcattcttttagtcaccctaattatccttacatggaaaagacaggaattaaatggatggagaatcttggtcatgaggctcatcgacacaatactataattgatattttatgtgctggaacatgccctgtaagagttcctatcttacatcctcttgcaaaaacatcaggtggagttttggttctgcatgatgattttggggaagcctttggtgttaatttgcaaagggcatctgccaggtcagcaggctctcatggtttgttagaattgcgcacgtcagatgatattctcattactcaagttgttggtcctggggaaggttcacgtgtagatacccatgaaacatttaaaaatgacactgctctttatattcaaatgctaagtgttgaggaaacacaaagtttctctctctccatggaaaccgaaggagatatcaaaagtgattttgtctttttccaatttgcaattcagtattcaaatgtgtatcaagctgatgtgtcgagggtcattactgttagactggcaacggtagatagtatttctgcgtatcttgagagtgttcaggatgaagtggccgctgtactcattgctaaaagaaccctgttacgagcaaaaaaccattctgatgcaattgatatgcgagcaacagtagacgaaagaatcaaggacattgctctaaaatttggctcccaattacctaaatcaaaacttcatagcttcccaaaggagctttctctcctaccagagctccttttccatctcaggagaggaccactattgggaagtattattggccatgaagatgagaggtctgtgctgaggaacttgtttctgaatgcatcctttgatctatcactcagaatggtagctcctcgttgtctaatgcacagggaggggggaacttttgaggagctaccggcgtatgatcttgctatgcagtctgatgctgctgttgtactcgaccatggcactgatgtcttcatttggttgccttttctgctaccaggccagtggctgctgccggtgctaaaagcagctgtggctggtggtcagatggctagccaagggggtgctgaacttgcagctgatgaaggaagaagtgctgctgctctagctgcatgtaggacattggctgaagagctgactgagtaccgatttccagcacctcgaatccttgcatttaaggagggtagctcccaggctcgatactttgtctctcgtctcattccagctcacaaggatcctccttatgagcaggaggcaagatttccacaactgaggtcgttgacatcagaacaacgaacaaagctgaaagccagttttgttcacttcgatgatcctagtttctgtgaatggatgcgaagtttgaaagtggtgccaccacaaccaagttga

SEQ ID NO: 18988 - DNA, 741 bp, Glycine max
  Peptide Sequence Number=SeqID_110673
atgactttcactcttttaaaaaaggttttgggtgaaaacagtaaaatagtggatgggaaatgcaaagcccttgtacagtttgtaaaattgggttgggccaatatagttacgtctgagtatattctagaaaatgattcaacgcagggaagtcgtcatcccgaggttaagtgggctcagaggcttgacaaggtctatatcacggtgcaattggctgattcaaaaaatgcaaaagtggatcttacgccagatggtatttttaccttctccggtagtgctggtgctgaagaccatcagtatgagctaaaactggagctctttgataaggttaacgttgaggagagcaaaattaatgtaggagagcgaagcatattcattgtagtgcagaaggcagaggatggatggtggaaaaggttactgcgtggagaaggcaagactccacattatgtgaaagtagattgggataaatgggtggatgaggatgaagatgagggtaatactggtgaagtggacttgggagggatggatttctcgaaatttggggggatgggtgctgatgcaatgggagggatggatgcaatgggaggcatgggtgggatggatttctctaaatttggtgggatgggtgatgcaatggatgacattgatgagagtgacgatgaagagcaagaagtgtcaaagcctgttgaacaagatgcaggcgaggggtcgaccgagaaaaaagaggctgctccaagcacataa

SEQ ID NO: 18989 - DNA, 1176 bp, Glycine max
  Peptide Sequence Number=SeqID_110674
atggaattgatgtgccattgttcgagctttcttcttccgccggagaatcctaacacgacgtgttcgctttctctaaagtacgctctcgttgttctcaaccaaagcctaccgagatttgctcctctgctctgggaccacgctcaagtacgagtttgcgctgatggaggtgccaatagggtgtatgatgaaatgcctcttttcttccctcatcaacaaccttcccatgttcgcaccaggtacaagcctgatgtaattaaaggagacatggattcaatcaggacagaagtacttgacttctatgcaaagctgggaactaagataattgatgagtctcatgatcaggacaccacagatttacacaaatgtgtggcatacatacgtgacctcaccccaaatgttgatggatcagaactatgcattcttgttgctggagcacttggtgggagattcgaccatgagattggaaatattaatgtgctgtgccgattttccaacacacgaattatccttctatctgatgattgcctcattcatcttcttccaaagaatcattgtcatcaaatctttattgaatcttctgttgagggtccgcattgtggactcattcccattgggatgccttctggaagctctacatccacaggactcaaatgggatctcaatgacacagcgatgagttttggaggtttagtaagtacatccaatattgtaaaaggggaaatagttacagtacagtctgattcagatcttctttggactatttctattaagaagctcgagttggtggaactgaaaaatggggagacatataacgggcatttggttaattgcgacacatggatgaacatccatctgcgagaagtcatttgtacatctaaagacggagatagattttggaggatgcctgaatgctacatacgaggcaatacaatcaagtaccttcgagtacctgatgaggttattgataaagttcaagaagaaaccaagagccgtgcagatcgcaaaccacctggtgttgggcgtggaaggggaagaggcagagaggaaggtcctggtgggcgcccaacaaaaggaattgggcgtggtcttgatgatggtggtgctaggggagctggaggaagccgaggcaggggtggtcccagtggaaagcctggtggaaacagaggtaaatcataa

SEQ ID NO: 18990 - DNA, 588 bp, Glycine max
  Peptide Sequence Number=SeqID_110675
atggtttatgatgacaagaattggattgggttgaacactgggaatttcttgttaaggaattgtcagtggtcgttggatattcttgatgcttgggctccaatggggcccaaagggaaagttagagatgaagctgggaaagtgctcacgcgtgagcttaaggataggcctgtttttgaagctgatgatcaatctgcaatggtttatttgctggctaaggagagggacaagtgggagggtaaggtttatcttgagaatggttattacttgcatggctattgggggattctggttgatagatatgaggagatgattgaaaattatcaccctggttttggtgaccataggtggccattggtgactcattttgtggggtgcaagccttgtgggaagtttggggattatccggtggagagatttatggctttacacacgagtcgttgggtagtagggggagagttaagagaatacggaatgagactagcaatcctcttgaggtctaagatgaacttgggttgcttcatccagcgtttaaagcagttgagcctctctctctttctcggtcttaagcttctcaacttatacctgtag

SEQ ID NO: 18991 - DNA, 1515 bp, Glycine max
  Peptide Sequence Number=SeqID_110676
atgtttgatatatgtgagtgttcatatatcatcagtcggggcgctagcaatagcatgttcaattgttatttgcctaagttctgccagctaatggatgcatttgatgaaacagatcctaatgctgaagttgttgtcttatcaccaaccacactaatggcaacaaatagattcgtgtgtgagatctgcaacaaaggatttcagagggaccaaaaccttcagttgcaccgcagaggtcacaatcttccgtggaaactgagacaaagaacaagcgctgaggtgaagaaaagggtctatgtgtgccctgagccatcatgcgtgcaccataacccagctcgtgcactaggggacctcactggcatcaaaaagcattatagccgcaaacatggtgagaagaaatggaaatgtgacaagtgctccaaaagatacgcagtccaatctgattggaaggcccaccagaaaacttgtggcactagggaatacaaatgtgattgtggtaccatattttccaggagagatagtttcatcacccacagagctttctgtgacgcattaaccgaagaaaacaaccgagtgaacaaccagggattaacaagtggcatgccaccaaacttgcaaagtaaaatacctgatctcatgtccaccatgcccctaacaactagtcccaacacaacaaccaaattcggggactatgaccctaagaaccctctaaaatcactagcccaagaacttgtcccaatacccttcaagcccacaagcatgggagggggcatgttctccaccaatgcaggtgcacgttttggtggcccaaaaaccatgtctccctcttcttccagcctccaactaggttccagcacctcatcaagcttcaattacttgcaagatagcaaaaacggaggactaatcgcagcctcggctcaaatgtccgcaacagctttgttacagaaagcagcacaaatgggtgccactgcaagcaatagtattaactccccaatgatgcaaaaaggctttgttggtggcactaccactggtcctgatcatgtttctttcactactaggccaccatattatggtgctatgcttcagcacaacaactcctatgaccacttctctccacagcatgatctttccaacatggctggggtgagtggtggaggagcattcatcaatcaattgtttcataaaggacaagaaatttcacaagtttttgacactaacactacaatgaatggtgtgggaatgttcagccaaatgccaatggggagtgaacacaatcacaaccaagggttgatgaagaatgtggaacaagaggttagtaatggttccagtttgatacatgtaagagatgtgagtgatggtaaccacacaatgcagccatcaaggtttggagggagtgacatgacaactgttcatgacttcttggggattggtggttcaacttcaagagttatgaatcattttcatcaccattttccacacgaggattcggctattgaggaacccatgtgggatgtttga

SEQ ID NO: 18992 - DNA, 162 bp, Glycine max
  Peptide Sequence Number=SeqID_110677
atgttattctgtggaaaagtggaagaggaagaggttggaagagaaggtgcttaccaagctagggcatacggcggagacgacgacgatgtttgtgtctcgcaaatgacaaaacacaaaacacaaccagaagcgaaggtcgtgggctgggtccatttcaactaa

SEQ ID NO: 18993 - DNA, 978 bp, Glycine max
  Peptide Sequence Number=SeqID_110678
atgcaagcagttagaggtgatgaagaaaacttcttaagagaaacgaaggttatagagccaaatgagtgtgtccgaaacattgtgaactcccttatttatctggctcctatggtaaccatctatgataccttccaggagcaaaccaagcaacattataatgccattccctattctctctctctgttcactgcaagtttaatgctatactatgcccaccttaagggcaacgaagaagctttgcttcttatcaccataaactcaattggttgcaccatggaagtggcttatctcatcatatgctacatttatgccaacttcagagccaagacagtgattgtccgatgggtgtttttgttcaatggtgcgacatacttagtcatcctatttttaacttccttggtctcaccattaagtaataggttgaaagttgtgggatggatctgcgccactttctctgtcggtgtttatgtgacttctctgatcaatcccatgatgagaacggttgtgaggacaaaatgtatatccatgcctttattgatttctctgaccctgagttccatcgtttggttcttctatggctttttttctcacgattatttcatcgtgatgccaaatgtactacacttttggcttggtgttgcacagatgatcctatgcttcatctacaggaatggtggtgctgatgagagagaaagggtgcagtcagaaactggtgagattaataatgaaaatgacgagattttggagacaatagaaatgcaaattgctgaggcgaagaacacaaatgttgatcaccaaacagacaacgatgatattaagaaaaaagaaaatggcagcagcagcagggtggaattggaaccttgtgagattgtccatttgcagaacaatattgttgttgttacaagaaacggcacaagaatagtgtgtaatgagatccagtcggtggcggaaccagagattgttgaaattcccggatga

SEQ ID NO: 18994 - DNA, 513 bp, Glycine max
  Peptide Sequence Number=SeqID_110679
atggcttccttttggtcattcttggcaatgttgatggccatgttggcatgtagttgttcattggccttggcttctagttctcaacaaagtatgcaagttacttccatcacagcagcaccagcaagtgcccctctagtttctcctactcaatcaccagatattgagccactttttcctaccccaggtgcaggtggagtttctcattccccatcatattcctcactgccacaattccttcaagccagagccctcctaatcccaacccagaagtcttgggcactccaggcactgtgttggattctttgccatctgaggctcctgctttccactattcttatcagcccttatattcaatttcatttttcaagtgaggtaggagattttcacggaataaaagcagggaaattttcccactacagtttgagagacacaaaggagagaagtccttgccatcgccaacctaccaactttgctattgatcgaactaaagatgaggaagtccctttcacctag

SEQ ID NO: 18995 - DNA, 519 bp, Glycine max
  Peptide Sequence Number=SeqID_110680
atggtgagtttggggttgtttctgttgaaatatttgtcgttgagcaccgtggactcgctgatggtgatgcttagtacaatgatttacggggatgtgaccaaatatggggttgcaaggcccaatgagggtcccttttatatgaaggtcaagtatggaaagtacccagttattgacgttggaacctataaaaaaatcaagtctggagaattgaaggttttgccatcagaaatagaaagcctaagaggcaaggatgtcctattcaagaatggtgagtcgcacccatttgactccattgttttctgcaccggcttcaagagatcaaccaacaagtggcttaagggggatgattaccttctgaatgatgagggtcttccgaagccgagttacccgatccattggaagggaaataatggtttgtactgcgttgggctatcaaggagaggcttctatggcgctgccgcagatgctgaaaatatagcaaatgatattgccctgttagctgccattgctgctagctag

SEQ ID NO: 18996 - DNA, 432 bp, Glycine max
  Peptide Sequence Number=SeqID_110681
atggattcgcaagctggaggaaacaaatcaaatatgcagtttggtgttgagaaacttgtaggatcgaactacaactgctggtggttgtgcatggaagcttttctcccggggcaagatttatgggatctcatggtgggaaatgatactgaaatgccaccagatacaccgaataggacggaggctcaacgaaagtggaaggtaaaatgcgggaaagcgttgtttgctctgagaacgactgttagcaaggaattaattgatcacatagagatcttgacacaccaaagatgcaccaaacatatagaagtgcatcaccactttgttagagaaaaggtgttgaataaggagattgatttgaagaagattcatacaaagaagcatctggctgatatttttacaaaggcattggtgaaaccattgtttgagaagttctaa

SEQ ID NO: 18997 - DNA, 903 bp, Glycine max
  Peptide Sequence Number=SeqID_110682
gaaatctcggttgtcgctatcttggccgatctctatgacacgttcgaccgaagatgcgtaaagaacggcacaagaattctttgttgtatgccagctctctatgtgtggctcgtctcacaccttttccgccaagaaagtaggcccacctgtccactgcatcgtcaccgcttatgcaccgagaagggaaaggcaaactgggagcaactcttggctagtgtggtaggggcatccatcaattggttcccccgttggaaggaaggaaaagttggagttttgtcctcatgtgagggattttcaaatgtccccttgatgggaacaaggggttgtattaattataatcatgtcctcaccataagacaacttggctaccccatgagaggagcaccatcgaaggaaagcatcacacctttcatcacacggggtttcagcgaccccaacgcgaggtggttgagagtccggacacaagggttggattggctcccaaagctaagggctgcgagaaaggaagaggctgaaactccggaagaaagtgaagaggtacaagccctaaaagcggagcttgaacaagcccgagcagtcaaagagaagttcaagtcaacggccatcaaagtccgaaaggagtacgatgaactaaaagacatcaatatggccaccaccgaagccttggaacaagaaaccaagaaggccctaaaagaagaacacgaccgaaacaagttccgaggagctttgtggggcagatacaatgagcttaagctccaaagagatgaaaaggatcagtcgcgggtcgaagtcatgatcttgaaagatgagttaaaagattgtcataggtcgaaaagaagcttgtcccagcaattgagcaagactgaaggaaatatatgggccatcatcaatgattacaaataa

SEQ ID NO: 18998 - DNA, 494 bp, Glycine max
  Peptide Sequence Number=SeqID_110683
atgactaggcacaacttggaagttcatctcaaatggctgttgcaacaaggcccttcgctttacccctctttatcgccatcggcacgcgagaatcgcaactctattcgagagaatcacactcaaaatcggctgattccagcgctgcatgcaacgggtaaccaagttccagaaatcgcaattggagactcccagccattacagaagaaacctgtcgacaatgtagaaaaagatttcgaggtagaatcggacgaagacatggcacgattgttaatggctccacaatctgcgagcaaacctgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 18999 - DNA, 755 bp, Glycine max
  Peptide Sequence Number=SeqID_110684
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccgaggagcacgcgctcgagctcgtcgagctcgggccgacgttcgtcgtcgattcggtcgcgctcgcggcgcgctcgggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagttcaacccggtaagacacgacttatcgccactggcagcagccactggtaacaggattagcagagcgag

SEQ ID NO: 19000 - DNA, 444 bp, Glycine max
  Peptide Sequence Number=SeqID_110685
atgcggaggaactcgcttgcttcctctagcaatacttcctttttgccacagccatccctttttatctggaagacctttcactggaatatccttgttcggagtgagggtcgttttgttactttgttcttccaccatctttgtcttccctttaacgtttgcgggttgtgtcgtcaggtcggggggtgcaaacatgcgactgttgtaggtccgccgcccagccccgtgatattggtcaccttggctgacaatgagctgatgtcggtggcctcttccttcctttcacttggaggtgcatacatccacgggactgcgtggctgtttcggtatgggaacagaacaggtttaactaccaaggggtatcagggcttttggggagcggcgtctttggtgaaatatatcaccaaaggcttaggccttccaaaacttctctcatctggggactag

SEQ ID NO: 19001 - DNA, 135 bp, Glycine max
  Peptide Sequence Number=SeqID_110686
atggcatcttcaggcactcctactatcttcaccgtgttgcaaatgtcgatgtatgtggccagctggatcaaggaatatggatatgagaagttggccgtctgcacctctggtctagatatgttggtgaagtactga

SEQ ID NO: 19002 - DNA, 354 bp, Glycine max
  Peptide Sequence Number=SeqID_110687
cttagagggagcagcaacggtgttattgccgggtatcatcaatggttgaaggctcggatgcaagggataacttggctcccgaagctaaaaagttcaagtggaggagagactgaagtccctaaggagagtgaagaagtgcaagccttgaaagcgaaacttgaaagaacacaagtagtcaaggaaaagttcaaggcgacaaccattagggttaggaaggaatgtgacaagatgagggatgtcaaggacaagttgaaggcttgtcaaaggtcaaagaggatcttgaacgaacagttgagtaggacggaagagaacatgtgggctatcattgaccagtataaagagatcagaagctga

SEQ ID NO: 19003 - DNA, 348 bp, Glycine max
  Peptide Sequence Number=SeqID_110688
atggagagatttgaggaattaaagcattccctacttgttgacggattatctatggttaccatggacaagtggacgaatattacggatatgggatgtgtcattgcttcacgatacaacgtgaacgttgtttctctaccacgacaacaaaacatgacattttttcctcttagaagtcagccgccaccagattcttctgtgcatcgcgtaatatgcattggtcatgtgtatggaaatcattttgtacaggtttttttacgagaccagtgtcctttaccaccattggcgtttattgtggaatacacattgtcattatcaggcaaagaagtggctcaccccatacataggtag

SEQ ID NO: 19004 - DNA, 160 bp, Glycine max
  Peptide Sequence Number=SeqID_110689
atgggatgttacaatggtcaatgtctcagcatatctgtcatacagttgtggattctgcatttgactgagacaactatgcgagcggggaattccgatgtgtatggattcctcgagccacagtctattcagagatctaggcaatcacagtttgactcagaaa

SEQ ID NO: 19005 - DNA, 48 bp, Glycine max
  Peptide Sequence Number=SeqID_110690
atggaagtgttcttagctgataggatggtgggtaatgagaaggactga

SEQ ID NO: 19006 - DNA, 270 bp, Glycine max
  Peptide Sequence Number=SeqID_110691
atgatgtcttgggtgatgtggaaagacacccaccagatttacccaggacagcatttcacaccatataggaaacactttgctgcagtgaaaaaacaaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19007 - DNA, 492 bp, Glycine max
  Peptide Sequence Number=SeqID_110692
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcgtctgggggtatgcaccacagaattggctgttgagagttctaaaccctccgtcgatgactaa

SEQ ID NO: 19008 - DNA, 123 bp, Glycine max
  Peptide Sequence Number=SeqID_110693
atggatgaatgggatgataaaacaacaaggttgaagatgaaaggaaggaaagaatcactctttccggcgagggcaacacacaaaggttgtgaaagtcctttgatacaaccagggtgttcttga

SEQ ID NO: 19009 - DNA, 291 bp, Glycine max
  Peptide Sequence Number=SeqID_110694
atggccaagtttgatccagatatagttctcgagttttatgccaatgcttggcctatagaggagggcgtacgggacatgtggtcatgggtaatgggccagtggattcctttcgatgcagacgccctcagtcagttcctgggatacccgctagtattggaggagggccatgagtcaggattttgcccggaccgctgccatgagacgggtgcggatcatgcgcaccaacatgactaccttgacccagacatggatgacgttgctgctcaacaacatcctgcccagcgatcataa

SEQ ID NO: 19010 - DNA, 441 bp, Glycine max
  Peptide Sequence Number=SeqID_110695
atggatccattgttcacaatgacagtggtgtttcctttcaagcttccactccagttcccatacgagtacctgacgggtaatcaatttcggtttcaatgtatgcaactgaaagatgatgctgatgttaacacaatgttaatgtgtaatcatgaattttcatttgttggttcgattgagttattatgtagcattgctagaaccccaaatggtattttaaacatacttgaagctactatgacccctactcatgatgccctgctatattacaatgggaggtggaacatgtcacgccaaaatgagtttgttggttactcgttcacaggaaaaaatcccaaaaactttgacattcccatcggatgcaccatggatgaactgaaggatttgatcaagcaagttgcgcctcgtgggatttccccttatggtattgatgaaacacaaatg

SEQ ID NO: 19011 - DNA, 387 bp, Glycine max
  Peptide Sequence Number=SeqID_110696
gacctccaagtccttcaagtggatcctagctccaagtcctttagaggactacacatcctcgccgtcataggactacacgtcctcgctttcagaggactacacgtcctcgccttcagagggctacacgtcctcgccatcagaggacaacacgtcctcgccttcagagggctaccggccctcaccttcagaggactacacgtccttacctttaaaggactagacgtcctcgcctttagcgggctacatgccctcgcctcgacttcagaggacagcacatcctcgcctccagagggctacatgccttcaccatcaaaaggcaacacgccctcgctttcagagggctgcacattctcaccttcagaggactacacgtcctcgccttcatag

SEQ ID NO: 19012 - DNA, 598 bp, Glycine max
  Peptide Sequence Number=SeqID_110697
gctaccctatgagaggtgcgccccggaggagactatcgcgcctttcgtcgcacggggtttcaatgaaggcaatgcaaaaatacttcagagaatctgcaaggcgtggaatacagtggaaagaaaggataaggagcttagaggaagcagcaatggtgtcatcagtggctatcataaatggctgaaggctaggacacaagggataacttggctcccaaagctaagagatccaagtaagaaagaagttgaagtccccgaggaaagtgaaaaagtgaaagccttgaaagcagagcttgaaagaacgaaagtgatcaaggaaaagctaaagacgacagtcactagggtcaagaaagagtgtgacaagctaagggatgtcaacatgactacgaccgaagcattaaagcgggaaacaaagagggcccaaaaggaagaatggagcaggaacaagtaccgaggggctctatggggtagcaacaacgagctcaagcttagaagggtcgaaagggatgagtcaaggttggaaagcatggttttagaggataaattgaaggcttgtcaaaggtcgaagaaaagtttgaccgaacaactgagtagaacataa

SEQ ID NO: 19013 - DNA, 591 bp, Glycine max
  Peptide Sequence Number=SeqID_110698
atgggatacaacaggatgaagccttctaaggtctcctatcaaaacataaaacaaacaatgaaattcgacaatcaagaattgttcgtacttacaaatgagtttcactatcctagtagagaagccatcaacgataaattcaattgccttattgacaatatttggaatattccaaagcacacaaacaataatgagcattttttctatttagtaaaaaagaacatagtttgtgccttatacaacttcagtatagtagataaccaaggagtccttctccttacaaaagcctctccttctgggaaaggttatacaacttttgtcctattatcagggccccataaaggtgtttacaccaatttcaaagacctttgtttggcaaaggagggtattcaaagcccaatttacataggattttattcaagggaagaagcagaaaaagcccttgaattaaataccacaaacattaataaaatcaagaaggcccttgagccagaaaccacaaacatagtcataaacgctgaccaaaccaaaacctgccacaaaacctacaaggactcagtcagctcaaatgtccccagaccagtaaatagatag

SEQ ID NO: 19014 - DNA, 440 bp, Glycine max
  Peptide Sequence Number=SeqID_110699
gcacctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatagagcagtatttacggcatttggttcgccagcaggcggccaaccaccgagcacataccagttcagggcagaggttgcatggcccggagattggcccgaaagcccaagcaggagaggcacccccagaagctcccggcgatggagaagaagcccacgaggatgaggagatggctgatttgcttgacttcttgggagggagtggagacac

SEQ ID NO: 19015 - DNA, 618 bp, Glycine max
  Peptide Sequence Number=SeqID_110700
atgttttctgtgcaggattcctttgaggagcagatgacacagggatccttcgtcccccatggacgtcaggatgttctcaccgctgctactggacgtctagagcaccctggacgtgtctgtgctgctggagtcggtgtcacgatcaagcaatactttggatcggctccacggacgtcccgcagctcttcctctctgcctcctgaagaattgctgcaactgactcagcaaatcagggacctgctagaggagtccatcacagaaaaagtgacacggcagctcatggcatccttcagccagatgcagtcccagattcagtcccagatgcaatctcaaggacttgcactacctcccgagcctctagttggtccctccggtcctcgagtaagcacaaaggggagttttgttgatccctcacgaaacaatcctaaaacgggtgacttagataggcatctcactgatacaagtatgcgagcggggaattctgatatctatggattcctcgagccacagtccattcagaggtctgggcaatcgcagtttgagtctgaaagttacataaagacttggatgcaaaattcaaaatgtgatgtctatcttggagcctacctaaataggtaa

SEQ ID NO: 19016 - DNA, 318 bp, Glycine max
  Peptide Sequence Number=SeqID_110701
atggtcttggaagtccaaactcaggagcacaggtcgcttgagcaaatggaccaatggcttgcactcaattctggatttacatgcgattctcctcaaatttcagccagcccgcatcaattagaccttgcaccttacgcttcaggcccctacaatgctcaatggaatgccccggggcttctcaatgacaagcacacgttgcgttcgagtcgtattctcggagaaatggaggttgatgaaccttggttggggttatggctaccattgaattatcaaatagatatgggagcaagtcagcataggacactggaattggggtga

SEQ ID NO: 19017 - DNA, 378 bp, Glycine max
  Peptide Sequence Number=SeqID_110702
atgaaaataaaagtacgcgaaacaagtggggaccaccaaggaccgaagaacgacgaagaacgaacgaaggatggcggaaaatcttcacggaatcacccacggaaacgtttcgaacgcgttacggaagcgcctcggcttggattttcttcacggaaacgatttttgaaaggaaagagggttgaacgtttttgttattccctcctccccctatttatagagaaaagagggagaagcttgccacccagctcgcccaggcgagctaggttgctttctccagaaggcggtgccttctggaagaacttcctggaaggcccaagtgggcctggttgctatttgcaccccctatttactaaatacacccctacctttttttgctga

SEQ ID NO: 19018 - DNA, 342 bp, Glycine max
  Peptide Sequence Number=SeqID_110703
atgattatgaggggccaagacatttataatagcctatctactacttcaccttcctctagtgaagggatctacccccaagaagaaggacaacctttaatggttaaggaggagtgtaagaaggaaaggcattttgaaataaaggcaaatattaaagaaatttcccttcttagacaacctccacattttctctttagtaaaaagacacttgttagcattgccatacctcttaggcttgagtttattcctcaagtaaaggagttgttggatgagggtttggttcgcaagagcttaaatccttgtgctttgtttgtgcccaagatagtgatcaaggggttcccatga

SEQ ID NO: 19019 - DNA, 147 bp, Glycine max
  Peptide Sequence Number=SeqID_110704
agaaaaatgcaaggattatgtatgagtgaacataacatgcgaacgataaaaatagaatggactattagtgacaatgcatcacgaaaagaggaaatgaggcttcactgttatcaagcgagtcggagacccagcatgatcacagattga

SEQ ID NO: 19020 - DNA, 219 bp, Glycine max
  Peptide Sequence Number=SeqID_110705
atggcggaatcaggcctaaaagagtcagaatgggctcaagcacactacgaccaacttaaccttattgaaggtacatggggacggatgcaagtgggaatagggtcacgaccaaccgatcgttgccccttcctggcgctaaacaagcagagaacatcgctgcaaggtagcccagtatcctttgcattcgcagtttcttttactattgtttgttttaaataa

SEQ ID NO: 19021 - DNA, 267 bp, Glycine max
  Peptide Sequence Number=SeqID_110706
atgcaaagaagagctgttgtagctgctttgattcccatagacttggagattaacactacttgcaggaaaagaaaagcagaaagaaacaaaatttttttgcaggacattgaggcagcaccaactccagaagaacctatatcttctgaggcatcttctagttttccaactcaaggtcaatctcatacaattttagctaaagcaaatatcatggctgaggaaccaagaagagttactctagaagactactcaagctcaagtgtgtcgtaa

SEQ ID NO: 19022 - DNA, 336 bp, Glycine max
  Peptide Sequence Number=SeqID_110707
atggaaatttatgtgagtgatcgactaggaaaaaaagttgtcatcatcaaaaagggggagattgtagaagcaaagcttcatgatgaatcaagaatgataacaaaagatgatgacaaaggtgatgacaaaaagctcaaaggtcaatcaaagaatgagttcaagatattcaagatagaatcaagaacacttcaagattcaacaggaaagttgatttcaagaatcaagaatcaagattcaagagatcaagatttcaagaatcaagattcaagagatcaagattcaagactcaagattcaagaatcaagagaaagcttaatcaagagtgggatcctctag

SEQ ID NO: 19023 - DNA, 549 bp, Glycine max
  Peptide Sequence Number=SeqID_110708
atgtcttggaagaggacacattacttctcaatgccccaccacaaaaccatgattatgaggatccaagacatttatagtagccaagatgaggctactacgtcaccttcctccagtgaaagtgaagaagcaaaagaggaagaatctagtgaagaaatctatccccaagaagaaggacaacctttaatggttaaggaggagtgtaaggaggtaagtgtctcctccaagaggttagttaagaaggaaagtcattttgaaataaagacaaatattaaagaaacttcccctcttagacaacctccacatcttctcctttgtaaaaagacacttgttagcactgccacagctcttgggcttgaggttattcctcaagtaaaggagttgttggatgagggtttggttcgtaagagcttaaatccttgtgctttgttggtgcccaaaataggtgtcgagggaaggagcccagagtatgaagaacctcaggatttgaggtcaaatcctttccaaggtggaggggatgatgcaatcctaccccttaagggtattggatag

SEQ ID NO: 19024 - DNA, 282 bp, Glycine max
  Peptide Sequence Number=SeqID_110709
ggcctatcaaactggttggcagcaatatggttttcggccgcattccgtgtttccaagaacatcattgaggttccattgtcttaccatagacaatggaggccatattacccgacccgatactttttttctgatgggctaaagcagtttagaagaactcacgacattgacgacagtgtcatcatgcggttttttattgctgacaaaaatacttccttcgaggtggatgtcattggacctatccataggcagggctgtccaaggtccttccaccagcagctttaa

SEQ ID NO: 19025 - DNA, 972 bp, Glycine max
  Peptide Sequence Number=SeqID_110710
atgggacctctccaaatgcaagcctaccgcaaggcgtacggaaagatcttagatttaaccatagcggagatatccacagaagccattgcatcactcacccaatactatgaccagcccttgagatgcttctcgtttggagacttccaattagtaccgaacgttgaaaaatttgaggagattctaggatgtcctcttgggggaaggaaactgtatcttttctccgggtttcttccctccttaagcaaaattgcagttgtggtcagggattcggcgagaggattggaccgcgtaaagcaaactcgaaacggcatagtgggcctaccacggaagtacttagaaggcaaggcgagggatatggcgaatcaagaggagtgggtcccatttatagacgtattagcattgctaatctttggggttgtcctcttcccaaacgtggatggtttggtggacctagccgcaattgacgctttccttgcatatcaccatagcaaagagagcccgatggtagctatattggcagacttatttgacacatttgacgaagatgtgaaaagagtagtgcatggatcatctgttgtttacccgctctttatgtatggaggcagaacagtcaactggtttccacgatggaaagaaggaaaggagggagttctcttctcatgtggaagctacccaaacatcccgttgatagggatgaggggttgcattaactacaatcctgcactttccataagacagttagggtaccccatgaggggagcaccgacgaaagaaagcctgtctcctttccttgtgagagattttggcgtgcaaaatttcaaggttatacaaagtgtccataaggcgtgggaaagcccgttaaggaaagataaagaacttaggggcattcgtaatggcatcattggtggttatcatgaatggctgaaagttcgtacacggggtttagattggctcgccaaggggatcctctag

SEQ ID NO: 19026 - DNA, 362 bp, Glycine max
  Peptide Sequence Number=SeqID_110711
aggactacacgtcctcgccatcagagggctacaggtcctcgctttcagagggctacacgtcttcaccttccgaggactacacgccctcccctttagaggactacacgtcctcgccttcaaaggacttcacgtcatcgccattagagggctacacgtcctcgccttcagagggcaacacgtcctcacctacagatggctgcacgccctcacctttagaggactacacgttctcaccttcagagaactacacgtcctccacttctaaggactacgtgttctccccttcagaggacttcacttcctcgccatcagagggctacacgtccttgctttcagaggactacacgtcctcaccttcatag

SEQ ID NO: 19027 - DNA, 337 bp, Glycine max
  Peptide Sequence Number=SeqID_110712
atgactaggggcaatccaagtgatttacaaccctttgatcttgaaatagatagaatctttcatagattagttaggcatagtgtgcatcctgtgcattttgagcattctgaacattctgttgagggtgattctgaatattctgattttgagcatttcacaactaattttcatactgagaacatggctcaacctccacctcgtgatagaactcttaaggagatggatgcacctgatttcacttatgaaagcttgtgcattcaatatcctgatgagggtgttccatatgttctcaagactggactaatacatttgctgcccaagtttcatggtcttgcag

SEQ ID NO: 19028 - DNA, 749 bp, Glycine max
  Peptide Sequence Number=SeqID_110713
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgcagagatgaaaaaactgccagaggataccccggtcacagcgcaaaccagcattggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 19029 - DNA, 357 bp, Glycine max
  Peptide Sequence Number=SeqID_110714
atgaaaagaagactcaataagctgttcatggtggtgattttgtggactctaactcagattctgatcatgtgtgaccaaattctggcaaacgagcaagttccttcaatggacagcctagtaactaggcttcttcgtgtacctactttggtgagaggtgaaaactcagttgtagccgctgaaactttagcagcacctgctgaaaaattagccatgttagcaggctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 19030 - DNA, 435 bp, Glycine max
  Peptide Sequence Number=SeqID_110715
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccacgtccattagttggttcccacggtggaaagaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 19031 - DNA, 408 bp, Glycine max
  Peptide Sequence Number=SeqID_110716
atgccccgggacacctccatcataagcgcaggttgcgttggggttgtaccattgagggaagagaaattggtagatcttctcggggctcaccatcaccatttggttggtgatcaaggatggcagcaagtcagcctacgacatcaggattggggtgagttccacaagcttctttactggaaaatttcttcctggattagcgcttgtgctgggattggagttgccgacgaggcgagactatgtgggagccgagttttgagtgggaggcctttgtggttgagcgggaaccctttgtttgacgggtgccggattggaagggtttccgacatgggccgaatagcttggttggtgtggggaatattgctaagtgttgtgaggagtttgctgggacttaggccaagtaggagctga

SEQ ID NO: 19032 - DNA, 138 bp, Glycine max
  Peptide Sequence Number=SeqID_110717
atgggggggaagttgcatgtgcacgatagggtgactcgagcatccgctaagcacaacactcctgggctaagcgcgaggaagactctagaagaaaatgtgctatacaggttcgctaaggacaccgcttcatctcactaa

SEQ ID NO: 19033 - DNA, 429 bp, Glycine max
  Peptide Sequence Number=SeqID_110718
atggcttctcatctaaaagatgttgtaaaatcaactatgtcagatcaaatacgtaaggagttgtatgagtacaagagagataatcctgcaagcacacaaaaagacttgcagagatggcttgagggaaaatttgagttgaaagttagtcaaggaacaatatcaaacacacttaagcggtcagatgactatctctctgctgaaatagaaaagggaagagcagagatcaaaagacacaaaccagcaaaatatcctgacatggagaaggttgtttatgagtggtttctccaacttcaagaacgtgtgaatatcacaggagaattaattttgctgaaggcaagagatacaatgaaactcgtgtaccctcatgatgattcagattttaacttctctatggatggcttgggaaattcaagcatcgacatggcataa

SEQ ID NO: 19034 - DNA, 636 bp, Glycine max
  Peptide Sequence Number=SeqID_110719
atgggcgattttactcatgataattggaggtgggatatgaagtggaggaggaacttatttgatcatgaaagtgatttagctgtggagtttatggaggaaatcacctctatccctattcagagacatgctaaggacaccatgatgtggatggctgaacctagtggtgtgtacactaccaagtcaacttatagtttattgatgaaccccagcacaacaggttcagatgggaagactttcaagattatttggaagctgaaaatcccccctagggcagtggaggaggcgagtcatctcttctttaattgtaaaatgacaataggcttgtggtgggaatccatgagatggattcaggtagtaggtcctcttccagtttctccagctagccactttactcaattctatgaaggttttggtgcagcagtgaatcatagcagatggtgtgggtggtggattgccctaactaactctatatggcagcataggaatcttctgattttccaaggaaaagcttttgattcctctaaagtcatggatgatgctctctttctagcttggtcctggttaaaggctagagagaaagacttcaacaacagttttaaccactggtcttccaatatctcggattcctttggttag

SEQ ID NO: 19035 - DNA, 459 bp, Glycine max
  Peptide Sequence Number=SeqID_110720
atgaatcttataaggcgccaggtggtggtaaatgacaggttatgtccattctgtggacttaaagatgaggaggcagagcacttattttttaactgcacctataccttacccctgtggtgggagtctatatcttgggctaatttaacaacagcactgccaattaatccaagagaccatttcctacagcacacacttggagcagctggagattcagctgaatacttactatcaatagttgtatctctagtacctttggtactatttcacattgtcgcaacctacccttcggcgggagggcgacgcgtgactcgcgggatgcgtgttccacgaaaggaatacgcgcggagacgccaccaacgtttatttgaggaaaacgtcggaaaaaccggaaaagacgcgatctatgaacttttaagtgaaaggttcgggagttgtatttacgcacgggaaaggtattag

SEQ ID NO: 19036 - DNA, 195 bp, Glycine max
  Peptide Sequence Number=SeqID_110721
atgacgtcacgcttagcgcgagttagtgtatttgggcttggcgccaatcatgcactgagcctggctaaagacaaccgtcgcgctttattcttctgtcgcgctaagcgcgctgaagctgcacttagcgttggatgtgtgctgagcccaaatggtgagctgagcgccactgctccctttagcaccttaagattttag

SEQ ID NO: 19037 - DNA, 177 bp, Glycine max
  Peptide Sequence Number=SeqID_110722
atgtcagtgaaaaaccacatcgggcgcctaggatgttttgcgagaatgatccaaccatatgggatcaacataagcttaaaggagcactcaaaccgggtgacccccaaggcctatacttcgaagagtccatcagggcctctccctcctgattcaggtccaacccataaaacattttag

SEQ ID NO: 19038 - DNA, 117 bp, Glycine max
  Peptide Sequence Number=SeqID_110723
atgatatcaaaattcccaacggtgagaatgctcgtaattggggctgcaaacatagtgctcaaatttcacgacgatccaacggtgaacgattccgagattgtcatttttctgagacag

SEQ ID NO: 19039 - DNA, 469 bp, Glycine max
  Peptide Sequence Number=SeqID_110724
ggtcggaacaggagagcgcacgagggagcttccagggggaaacgcctggggggcgtgagcctatggagatttggatgacgccagcaacgcgggatcctttctacgacgaccagaggccgcagccgatcgccttcccaacagttgagcgcagcctgaaggcggaagagcgcctgatgcgtacaatccgcgcgtctgagccgattcagttaatgccagcgcacgacaggtcccgaccggaacagcccgctgagcgcctgaacgcattaatgaattgtgtcagccggtacaatttcaccggaaacagctatgaccgagattacgaattcgaggctcggaagagtatgagtattcaacatttccgtgtcgcccttattcccttttttgcggcattttgccttcctgtttttgctcacccagaaacgctggtgaaagtaaaagatgctgaagatcagttgggtgcacgagtggg

SEQ ID NO: 19040 - DNA, 366 bp, Glycine max
  Peptide Sequence Number=SeqID_110725
atgaaggcccaagtggagaaggatgaaggcccagaggcagagacactatcaagactattaattgttgctgaaggcccaaaaaaaaacttttggcatttgataaaatttggtaagagtttctctctgggttccttgttgaaccaatctcagacttatcaaggtaatccttgtggcgtctgtccagacttatcttccttcaccggaagtggcgtctaccctaacttatcttccttcactggaagtggcgtctatcatgacttatcttccttcaccggaagtggcgtcatccaaatcttcgtaacctgtatcaagcgatccgctcctactcaggttcacatcatctggtatcagagcttcggctcttga

SEQ ID NO: 19041 - DNA, 223 bp, Glycine max
  Peptide Sequence Number=SeqID_110726
atgaagctttgcttctacaaaagacaaaaaacaaaattggaggaagttgctcaatccgaaagcactaaggttgtgattgacccttcatctcccatcagacgacacgattctttggaggagcaggcgtcaaagggttcctttgtcccctatggacgtcaggatctcctgactgctgccattgggcgatcaaaacaccctagttgtgtgcgtgctgctggattcg

SEQ ID NO: 19042 - DNA, 424 bp, Glycine max
  Peptide Sequence Number=SeqID_110727
gggggcggagcctatggaaaaacgccagcaacgcggcctttttacggttcctggccttttgctggccttttgctcacatgttctttctgcgttatcccgtgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaattcgacctgcaggcatgcaagcttggcactggccgtcgttttacaacgtcgtgactgggaaaaccggggcgttacccaacttaatcgcgttgcagcacatccccctttcgccagctggcgtaatagcgaagaggcccgcaccgatcgcccttcccaacagttgcgcagcctga

SEQ ID NO: 19043 - DNA, 143 bp, Glycine max
  Peptide Sequence Number=SeqID_110728
atgtcggctcttcctatcattgtgaagcagaattcaccaatagggggcctcggccccccaaaggcacgtgccgttggtgaccctcgtgaggcgggattagccctacgagacgccttgaagcgcaatttcccatcgagcggcgg

SEQ ID NO: 19044 - DNA, 360 bp, Glycine max
  Peptide Sequence Number=SeqID_110729
atgaccatgattacgaattcgagctcggtaccctcagcggtagagtgtcaccttgacgtggtggaagttatcagttcgagcctgattatccctaaacccaatgctcgtgggattacacgaggggtgggggggctatatttctgggagcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacgggtga

SEQ ID NO: 19045 - DNA, 273 bp, Glycine max
  Peptide Sequence Number=SeqID_110730
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttggacagtggatggtcttaattgatgctgcaaagggatgtgctaccatgccacctgatttgtctaagtatcctgcagattttgttgctatctcattttacaag

SEQ ID NO: 19046 - DNA, 405 bp, Glycine max
  Peptide Sequence Number=SeqID_110731
gaatcgcaaccacaaagacacccagttgacccggagaagtccaatagggccctggggtttccagctctaggatcgtgcctgcaagacacccagtggacccgaagaagtccaacagggtcttggagttgtcaagctctaattacgggtctatgtcagttctacggagtacctgtcacctacagcaagggcatcaggccccctactaatcgagctttcatcaagaagtactgcatccccaggcaggcgcagggcgaaacaccacagcagcctggggatggccagcaacgagcaacagacgcaccgccatcacctctagagttcacctcagctcatccaaaaaaggttaaagcgttgcttacgacccatggccgaccaataggcgaccaagtccaaagccaaaagtaa

SEQ ID NO: 19047 - DNA, 780 bp, Glycine max
  Peptide Sequence Number=SeqID_110732
cccgctgtctcccttgatcgcgccgacaacaggcgctttgagaggtatctggcgtcgctgattgggatgggacagccgggtcagatgaacaaaggcagcctcagcgcgcatgcccgctttacccacgccgggcacctgacccgtcacgggcgggatccggaggggctggaaaagatcctgcgtcattactttaaggcaccggtcaaactggtgagcaacgtcccgcagtggatgccgctctccgcgcgcgagcaggcgcagcttggagccggtcggcgcatgccgcgcctgggggaatccgcctttctgggcattgcggtacgcgacgtgcagcataagtttcgcatcgagattggcccgctgagcgcggaggagtacaaccgcttcctgccgggcgaagcctgggtcaccgaactgcgcgactgggtgcgccagtatgccggggtggaatttgaatgggaaacacgggtgatcctgcgcgaagacgcggtgcagggcacctcgctcggcggtaccgggcgattaggctataacacctggctgggtcatcaacctcagcctgtcccgcgtggcgatctggtgtatcgcgcagagcgcgccaccgccttctgcaagctgcgcggcaacccgtatgtggagctggtgcactggctgcatcagctgatgcagcagcaggatggcgatctacagcaggtcatccgccactttgccctcgacgaacagcagctgacgcgcgatatcgttgccgcgctggacgccctgccgcgcggagcgagctct

SEQ ID NO: 19048 - DNA, 225 bp, Glycine max
  Peptide Sequence Number=SeqID_110733
atgctggttgccgcaggacagtttgctgttacatctgtgtgggaaaagaacgctgagatttgtgcctcgttgatggcgcaggcggcggaaaacgacgcatcgctgtttgccctgccggaagcattgctggcgcgcgatgatcatgatgcagatctatcggttaaatcagcacagctgctggaaggcgaattcctcggactttacggcgagaaagggatcctctag

SEQ ID NO: 19049 - DNA, 633 bp, Glycine max
  Peptide Sequence Number=SeqID_110734
atgtgcggtttccgcgtctatccgctggcagcgtcgcttgagctgtgcgatcgccgcgctatcggccagcgcatggattttgacaccgagatcatggtcagcggtctggtgatcaacgcgctgggtcaccgacaacgcccagagcgcttccgcgcggtgctggagagcattgcgcccatgcgggcgtcaatcgctgccggtcatgatatcgcccggacaccgtttactgccatgctggatgccggtggtggggatgttggcgaccgcaccgctgcagcgtcgcgcggcgcgaacggcggcgtggattgcgctgccgcggcggcgctgcagctgccactcctggtgctgctgataaagtcgcgctgcgcgcagggcaaactggacgcgtgcactgcgaggcctttgccgatcctttaccgctgccgcgcaatgggcgacagcaggcgctgcaggcggcggtcgatcgctacgctgcgcgcctgcagcatcatgccctgctggcaccgctggactggtttaacttttacgatttctgggctctgcccgaagaggagcaacgcgatgcgtgacgcaagctggcgcgcggagattgaacgggtggtctcgtttcatgactgcgatccgatgggcgtg

SEQ ID NO: 19050 - DNA, 255 bp, Glycine max
  Peptide Sequence Number=SeqID_110735
atgaacgataacgcaattcatggggctccgaaaagattgagaatggagaatggcactaagcaatcactatgcatagctccaaacttgaaggggttgagaatggagaattgcactaagcaatcactacgcatagctccaaactcgaagaatggagaattgcaccaagcaatcactacgaatagctccaaactcgaaggtggaggacacatgaacgaaaacgcaattcatggggctccgaaaaaggttgagaattga

SEQ ID NO: 19051 - DNA, 297 bp, Glycine max
  Peptide Sequence Number=SeqID_110736
atgaagaacagtggaaaatcatcacgaaatcacccacgtaaatgtctcggaagcgttacggaagcgccttggcttggatttttttcacgaaaacaatttttctcactaatgttaagtaattctcagataccaggagggttgaacgaatttttgttctgccctccttcccctattatagggaaaagagggaggtggttgccgcccagctcgcctaggcgagctcagctcgccagggttgcttccaccagaaggcaccgctttctgttggaacatcctggaaggcccaagtgggcgtga

SEQ ID NO: 19052 - DNA, 534 bp, Glycine max
  Peptide Sequence Number=SeqID_110737
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctggccagctgtgaactttgagtttatatgggatgtggcctctggtaatcgattaccaatggtgggtaatcgattacaaggcttaaaaatgaagacaggaggctaa

SEQ ID NO: 19053 - DNA, 132 bp, Glycine max
  Peptide Sequence Number=SeqID_110738
atgcaagccttgatatgtactaaaaatttgttactaggatttgatatgcaaggaaaagaagatgaagatgtggagattgagaaggttcaagctacttcaaatatggaatcatttgttgttggagatgtttaa

SEQ ID NO: 19054 - DNA, 315 bp, Glycine max
  Peptide Sequence Number=SeqID_110739
atgatgaaagccctcacaagctcttgttctaaggccacggtcgagactctaggacccttctctcccagagttccccgttgtgtttctgatagacccgaattctgcttcacccttcgttccaaaaatgagaaaaggggatggaatttattgctcctgaaactggttcgaaacaatgatctttaccctgttcatgcagtgccaccaaaggaccagcttgtacgattctttccagcatatttcgggtttgaagttttctctgttgctttggtgttactggtggagcctctttactgtcttgagaatttatttcaatga

SEQ ID NO: 19055 - DNA, 361 bp, Glycine max
  Peptide Sequence Number=SeqID_110740
agggtacatctacttgggtttgactgagaacaagagagggtacatctcttgtggatcagttctagtggagggtacatccactaggttcaaagagagcaagggagggtcgcttttgaatataggaggcctattaatagagttcccttcgggaaaaagaaagtttgatgagaccataattattcttgaagtttctaaaccttatacaagacaacgatctcaacacagaagattatgtgaagaatccctggagggtttgcatcattcagcaaatggaagaagtcaaatgtttgatcaaaatgcttccaatccgggctttaggcattctctgcttgattcccatagcacaacatggtgtccctaa

SEQ ID NO: 19056 - DNA, 1207 bp, Glycine max
  Peptide Sequence Number=SeqID_110741
actcatcttctccttgaagtggcgtctcctctctctcttccttctccattccgctgccattcatcttccaagaagcaaaggaatccattgatgaagaggatcctaggtctacaagctccaatggagcttacatcatggtcttcgcccaatggagcttacatcatggtcttcgccggagaaaggatcgaggtgggtttgaagaggggaaagtttgattacatctccccgataggtgccagcactaggaggaccggaatagctggggcgaagaagaaagagggagatgcccataccgtcacttcaacacctgcgtggccaaagccaccacaaacccccaacaatacccaccaatatgcacaatatcacctgagtttttcggctcgtgccaaggcctctttcgatacaacactcacccaaccaagggcgcccacacccccacaggggggagctcttcgggcttcggctccgactcggcctcacccggccaacaacgctcactttggcgcaaacacgacaaggaactttttgccaaggcaggcacagatttttgccccgatcccaatgacatatggagaactcttgccatctctcatcaccaaccaattggccgtggtggtcccgggaaagatcttccagtctccgttcccaaaatggccactcaatcgaacagtgcttggccttgacaagcaaggtccaaagcttgatagaggccgggtcacacgggcccaagcttttgaaggacgtaacgaccccagaaggtttatctacaaagccttgcaaaaggcgggcataattccctgcggccggcgtagagaagattcttgcttaatggatccgggtgtactccatgacatggaaacatgttcggcaataagagatctattacaacagatgatagaccaaggccagcttgaggtcgacagtgagagggaggaggaacaacatgtatacatgcagtcggtagatgaagaaggacctaaaaagcctaaacccttggtaatacacttcttcagggacacgactccccaaagacctcaacacccctcggtagtgggcggtagatctattccgtttccttacgagaacagtcgtgcagttccgtggaggtatgcccctccgggcggtaggaaggatgaagctactggcatcagctcactatcatccaaagtgaccaatatcagcgggctgagtggcataacccgcagcg

SEQ ID NO: 19057 - DNA, 714 bp, Glycine max
  Peptide Sequence Number=SeqID_110742
gttctccacctgcctccactcctcctcctcctcctcctccttctcctcattctcctcctcctcctcctcctccttcagacgcatcggctttgccgtctgccgtgaagcggacacgcaaagcctcacgtttacgatcgttgtccactagaccacctggtgctgagagaccagtggtgcatgttgatcctgctatatggaaggccgacggtccccacaggaagaaattaagaacatatttggagatggtggcgcgcgataaggtggacgtcacctacgagaactggaaggaggtccctactgctcagaaggacctgatttgggaggatattcaggatgtgcgcatcaaggcaccggccatccagaagcagaatactgccccccatgttttgtctcgtgggggttatgattatttggagcagaagctcctggctgagaagaccaagaagaagctgcaggaagctgcacagtcaggaagcgttgatggcgtcatcgaccttccatccctggtcagacgccacgtgaagtggaagatggcccgcacgaagaagacaagggagatgacgactgaggccgcaaaggaaattgctgacaagattgattcgtttgaggagcaagccacacagggatcgttcgtccctcaaggatgtcaggatgttctggccgctgctattggatgtctagagcaccctggacgtgtccgtgctgctggagccg

SEQ ID NO: 19058 - DNA, 70 bp, Glycine max
  Peptide Sequence Number=SeqID_110743
atggcctcgggacctgcggttggtgtctgccaatactgtcacaagaaaattgtctcctttgtgaggcaag

SEQ ID NO: 19059 - DNA, 258 bp, Glycine max
  Peptide Sequence Number=SeqID_110744
atgaagagatgcatgatgcaatcaaggaacatgccagaagatatcatcctcttaggtgatacatcatggcaatcgggactatcagcggcaatgcatcaccaaaggaggaaaactctagatgaggcttcactgtttcaagcaagtcagagacccagcatgaccacagatcgacctccactccttatggctcacatagacccgggtataaggcctagcatctcaatgtgtgtgcgaggtgtaggcgccatgtgtgcgtag

SEQ ID NO: 19060 - DNA, 216 bp, Glycine max
  Peptide Sequence Number=SeqID_110745
atgaagaaagagtgtcctaagtatgccgcatggtgtgtgaagaaagatacttggtggatagattttggtgctgctactcacataagtatgactatgcagggttgcctgtggagccgactaccaagtgatgatgaaaggttcatctttatgggtgatgacaagaaggttgtagtggaagctattagaacttttagattacagttaaaaacgggataa

SEQ ID NO: 19061 - DNA, 295 bp, Glycine max
  Peptide Sequence Number=SeqID_110746
gtcaaatataaaatcatttcaagatcatgatgaagaccaagccaacttatgtctcaagacaaaatctcatgagaacaacgagaaagaatctataaggaagaagtggtacatcgacagtggatgttccaagcatatgacggtagatgtatccaagtttacaaccatttcccccaagaaaagtggacatgttacatacggcgacaacaacaaagggaaaatcattggattcggaaaaataggtacgagttcctctacttcttattctccaagttatccaactgctgagggtcaataa

SEQ ID NO: 19062 - DNA, 369 bp, Glycine max
  Peptide Sequence Number=SeqID_110747
atggattcacgcgctaggagtggtcccttcaacgcttcaccaaaaattgaagttcgcggttggtggactcttggtgatagtgtcgggcgaagaggatatgttggcacggttatgagcccggaatgggtctgggcaaggacagccacaggaatgccgatgtggttgacattaggggtaacccgtacaaatatgggttggggtatgaacccgggaaacctggaagaaggaatgcaccatcaagactccggaggtggcggcaataggagaggaggctccacaagatccgccaagtttcgtgcgaccgtgccatcccaatttccaagtggggaactggcacgtgatgagccagtcggaagtctataccgctga

SEQ ID NO: 19063 - DNA, 316 bp, Glycine max
  Peptide Sequence Number=SeqID_110748
atgaaagcgaaagcggtgaaaggaaattggagcttgaggacgaacaagctcagcttcccttacgttttcctcgtctgcatcttcttctttctcgctggattcttcggtttcactctcttctctcactctcaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatcacaaaatcgacgctcaagtcagag

SEQ ID NO: 19064 - DNA, 252 bp, Glycine max
  Peptide Sequence Number=SeqID_110749
atgtgcagcgccaccgattacaaaataaaatcaatcggaggcatgtgcatcttaatccaaatctgggcatgggaacgatgcacgactttggctccaaagaggactcctcccgtgatccaaaataagccactcgaacacaggtggttgcgacgtggaaatcaacatattgggaatgatgatctgattgtatttcgtcgcaagttggatatcatgaaaagacatgagtttctgtgggagccttacacaacaact

SEQ ID NO: 19065 - DNA, 327 bp, Glycine max
  Peptide Sequence Number=SeqID_110750
atggcattaaccgcccccctccatgattggcaagcgggtttgtttttatgttgggcccgtcctcttgaaaagtcaaccatccggcttctatcaagctttggaccttgcttttcaaggccaagcactgttcgaccgagtggcctggggttcccccatgaagttcctcgccgtgttggggcttgtcccaaggtgagcattgttggccgggtgaggccgggttggagccggagcctgaagagcccccccccctgtgggggcgtgggcgtccttggttgggcgagtgctgtatcggaagaggctccggcacgagccgaaaaactcgggtga

SEQ ID NO: 19066 - DNA, 396 bp, Glycine max
  Peptide Sequence Number=SeqID_110751
gggggcggagcctatggaaaaacgccagcaacgcggcctttttacggttcctggccttttgctggccttttgctcacatgttctttcgtgcgttatcccctgattctgtggataaccgtattaccgcctttgagtgagctgataccgctcgccgcagccgaacgaccgagcgcagcgagaaacagctatgaccatgattacgaattcgagctcggtaccatcaatgtctccgtgtgcgtgctgtgctgggaatggggaatagtaaaatggaagtcttaccttctcggcttctccccttctgtggaaaaacagcacagtccaccatatgatgcagggaagatacatccactgctcttaaaacacgcacatcttctaggtgcagtggggatcctctag

SEQ ID NO: 19067 - DNA, 267 bp, Glycine max
  Peptide Sequence Number=SeqID_110752
atgtctttcctgcgttatcccctgattctgtggataaccgtattaccgcctttgagtgagctgataccgctcgccgcagccgaacgaccgagcgcagcgagaaacagctatgaccatgattacgaattcgagctcggtacccaagcattaacattcatgtggctccggaacagggtgagaatggaggattgccttgagggtcctctcttaggcaatcatggaacacaactccaaactcgaaaatggaggacacatgaacagccctaa

SEQ ID NO: 19068 - DNA, 477 bp, Glycine max
  Peptide Sequence Number=SeqID_110753
atgaccggaaggcttcttgtcggttcattggcttttgaaagccgcatccttcattatctaattgttcgcatcttgcttccgagatcttcaaaccttgcacaggtttctgaagaagatctcattgttatgtgggcctttcataaaggtctacaaattgattgggcacatcttgcgcttcagtcattgcatcctttggttatcaaaaagagcatgatggcttcttgggtgaaaaagggtgctcgacatgttgatgaagaaggacatttacatggtggagaagattcctcgcttcttcaaaagattttggataggttcgatggtcttcaaacctttgttggtgaaaggtttgatactttggagttacaagtggacatgcgcttcaatgagatggagtcaagaatcacaaaggtcgaagaagatgtttcttacattcgtacaagctttgatctaccaccaccgctgccaccatcatcttag

SEQ ID NO: 19069 - DNA, 225 bp, Glycine max
  Peptide Sequence Number=SeqID_110754
atgccgacgccatttgcatatcaaagcaataaggttgttccgtggaagtatatccctcccgcatttggagaaagagttgcaaccgaagttgactccctatcagccaaggtaaccaacatcaccggcctcagtggcgtaacccacagtggccgggtgttcgctccccctcactcagcagaattgccctccaaggggaaagcgcccatgctacaagagcccacagac

SEQ ID NO: 19070 - DNA, 454 bp, Glycine max
  Peptide Sequence Number=SeqID_110755
ggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19071 - DNA, 246 bp, Glycine max
  Peptide Sequence Number=SeqID_110756
atgtccttgagaaattcgaatggtcataaattttcacttggatatccgataaaggagcatgatatatcgagacattcgaaattgaacaacggaacctctcgagaaattcaaatggttatagcttattcactcggatgtccgattcggggacataatatatcgagatgctcgaaattgaacaacagataccctcgagaaattccaatggtcataacttttcacactggatgtccattaagtgcataa

SEQ ID NO: 19072 - DNA, 180 bp, Glycine max
  Peptide Sequence Number=SeqID_110757
atgtgcacaaattgtagacccatcaacaacatcaccgtgaggtatagacatcctatcactagacttgatgatatgttggatgaacttcatgtgtttctaggatttgttgtgagtgctaagggagtccaagtggatgatgagaaaattaaagctattagagattggcccataccaaaaaat

SEQ ID NO: 19073 - DNA, 225 bp, Glycine max
  Peptide Sequence Number=SeqID_110758
atgcatgtggtattcttggacgcattttgtgacctgatgcaaagtggaagctatgcatggggagctactgcactggtgcatatgtatgagaatttgaatgatacgtcaaagagcacgactaggcaacttgcaagatatatcacacttttacagcactttcctactgttggttctgctattgttgttgaggattacgatgagaggaaaccacgtgcctgctgttga

SEQ ID NO: 19074 - DNA, 718 bp, Glycine max
  Peptide Sequence Number=SeqID_110759
agctttggtattccatttcgaacgtctcggtatattacgagactcaatccgacatccgagtaaaaagttattgtcgttggaatttgctcagagcttcaacattcaatttcgagcgtctcggatatattacgggactcaatcagacatccgagtaaaaggtttttgtcgtttgaatttgctcagagcttcgtattccatttcgagcgtctcgataaattacgggactcaatcggacatccgaataaaaagttattgtcgtttgaatttgctcagagcttcggtattccatttcgagcgtctcgatatattacgggactcaatcagacatccgagtaaaaggttattgtcgtttgaatttgctcagagcttcggtattccatttgagcgtctagatatattacgggactcaatcagacatccgagtaaaaagttatgtcgtttgaatttgctcagagcttcaacattcaatttcgagcgttccgatatattacgggactcaatcagacatccgaataaaaagttattgtcgtttgaatttgctcaagagtttctgtattcaatttcgagagtctcgatatattacgggactcaatcggacatccgagtaaaaagttattgtcgtttgaatttgttcagagcttcaacatacaattttgagcatctcgatttattacgggactcaatcagacatccgagtaaaaagtgtattgtcgtttga

SEQ ID NO: 19075 - DNA, 283 bp, Glycine max
  Peptide Sequence Number=SeqID_110760
caacaccagtgcgcggaccgatgatgtaggatttacgttggtagacctaaagaaactagcttaccacaatgaccctttcatcatggtagaacaagctaaacaggcccatacctactccacctaccttgcctcctcctcctcctcttcttccagcagtaccatcagtgtctccgtctaccttgaagcggacatgcaaaaccatgcggctatgatccttggccactataccacctggggcagagagaccagtggtccacatcgatcctacgactgggaaggctga

SEQ ID NO: 19076 - DNA, 426 bp, Glycine max
  misc_feature (361)..(361): n is a, c, g, or t
  Peptide Sequence Number=SeqID_110761
atggtatgcgcaggttgcgctagggttataccactttgggaacagaaactggaagatctttcctgggaccaccacggccaattggttggcaatgagagatggcaagagttccccatatgtcattgggattggggcggagatctgtgtccgccttggcgaaaagttccttgccgtgtttgcgccaaagtgagcgttgttggttgggtgaggccgagtcggagctggagtccaaagagctcccccctatgggggtgtgggcgcctttggttgggccatgccggtgttgaagtgacggtatgggcatctccctctttcttctttgcccctgctattccggttctcctactgctggcacctatcnggggagatgtaatcaaactttcccctcttcaaacccacctcgatcctttctccggcgaagactaa

SEQ ID NO: 19077 - DNA, 351 bp, Glycine max
  Peptide Sequence Number=SeqID_110762
atgatcccccatgtgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 19078 - DNA, 548 bp, Glycine max
  Peptide Sequence Number=SeqID_110763
gcgacaatgaccttcatttgcatttcgaagatgacaatatcttcagtcattgcatgcttttaaaaggcgacaatgaccttcatttgcatttcgaagacgatgatgtcttcagtcattgcatgctttcaaaaggcaacaatgaccttcatctacatttcgaagacgacaatgtcttcagtcattgcatgccttcaaaaggcgacaatgaccttcatttgcatttcgaagacgacaatatctttagtcattgcatgctttcaaaaggcgataatgaccttcatttgcatttcgaagacaatgatgtcttcagtcattgcatgctttcaaaaggcaacaatgaccttcatctacatttcgaagacgacaatgtcttcagtcattgcatgccttcaaaaggcgacaatgaatatcatttgcaattcgaagacgacaatgtcttcagtcattgcatgccttcaaaaggcgacaatgccatcatttacgctttcaaagatgacaatgtcttcatctcaaagacttcaaatgtcttttgtccttgtgcttcatag

SEQ ID NO: 19079 - DNA, 165 bp, Glycine max
  Peptide Sequence Number=SeqID_110764
atgtcgactcatcacatcctggggttgaagaaggtcccaagggttcggttgttcgccgattcaagtgggaggggcggcgaggagccaaccctagtacgagaggactgggttgggccaacctatggtgtaccggttgttatgccaatagcagcgccgggctgctaa

SEQ ID NO: 19080 - DNA, 316 bp, Glycine max
  Peptide Sequence Number=SeqID_110765
atggagagaagtatgatagatgctgccagtggtggagcccttggagacatgacccctgctgaagccaggaatttaattgagaagatggcttccgactcccaacagtttagcgccataaatgaggctatagtcattagaggagtgcatgaggtagccacaaactcatctgcatcatctgaaactaagaagcttgaagttaaactagacgccttggttaacctgcctgaagcttatgctgcaaacatctacatagacctcctcaacctcagcagcaaaatcagccacaacagaacaattatgacctctccagcaacag

SEQ ID NO: 19081 - DNA, 544 bp, Glycine max
  Peptide Sequence Number=SeqID_110766
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttctgtttctcctctggcagcttaaacgatgggagcggaaggagtgtaaaccaaacagtcttcctatcttgcacaaaatgcatgttaaacttggagatacggtgcaagtcatatctggacgagaaaggggtaaagttggggagattactaaaatcttcaagcataacagcactgttatagtgaaagatttaaatttgaagacaaagcatgtgaagagtagagaagagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19082 - DNA, 525 bp, Glycine max
  Peptide Sequence Number=SeqID_110767
atgacgaagaaagaaataatagcaaatgatagtagacatattactagtgttctattatggaaaatggtgggttacacaccttcaagctttgcggatttggtctttgctggcgaaatgatcgaagtgggtctaaaaagaggcaaatctgatcatcatgctttgataaatgaaaaaaaaactggggcaaatgaagagggtgagaatgagggagaaacccatgctgtgactgtcattcctatacagccaagtttcccaccaacccaacaatgtcattactcagccaataacaaaccttctccttacccaccacccagttatctacaaaggtcatccctaaatcaaccacaaagcctgtctaccgcacttccaatgacgaataccacctttagcacaaaccaaaacaccaaccaagaaatgaattttgcagcgaaaaagcctatagaattcaccccaattccggtgtcctatgctaacttgctcccatatctacttgataattcaatggtagccataaccccagccaag

SEQ ID NO: 19083 - DNA, 534 bp, Glycine max
  Peptide Sequence Number=SeqID_110768
atggcagaggtctccacagaggccattgcctccctcgcccagtattatgaccggtcgttgaggtgcttcacctttggggacttccagttatcacccatggtggaagagtttgaagagatcctgggatgccctctagggggaaggaaaccatacctcttctcaagattctatccctctttagctagaatttctaagatagtccaaatctcggcacaggaattagaccacagaaagcaagtcgaaaatggggtggttggagtaccgagaagatgtttggaggcaaaagcaagaatcttggcaggtagaggcgaatgggccccattcatagacatcctcgcgtttttgatcttcggaggagtcctctttccaaatgtggatgggttggtggacctagcagcgatcgacgcttttctcgcctttcatgatcgcaaggaaagctcaattgtcgctatcctagccgatctatatgacaccttcgatcgaagatgtgaaaagagcagtacaaggattgtttgttgtactccggccctctac

SEQ ID NO: 19084 - DNA, 457 bp, Glycine max
  Peptide Sequence Number=SeqID_110769
atgaaggccgatctatcggccttaaaagatcaaatggcttccatctcggaggtcatgttaaaactccagaaaaccatagaggataaagccaccgcaaccgcctccaacagaaacacggccgtgttcggtcgaaggtatagtccgcaagcttatccttatggcctgcctccggacttcaccccccgtgccactccgaaagatttaagccaagcccctacttttgaagggcaactcccaccttatgaagactatcccggacaagacgatggggaaggagatacccatcttggccccctgctccacctcaaagatccatccccgcatgaactaccccagccgaacatagtctgccatatcccggcctcacccacacccgtaaaagaatctgttccctttgcagaagataagggaaagattgaggcgcttgaagagaggttgagagcagtcgagggcctcg

SEQ ID NO: 19085 - DNA, 267 bp, Glycine max
  Peptide Sequence Number=SeqID_110770
atgtcttcatctttagaggactacacgtccgcgactttagagggctacacgtcctcgccttcagaggactgcatagtcctcaccttcagaggactgcacgtcctcgccttcagaggactgtacgtcctcgccttcagagggcttcacgtcctcgcctttagaggactgcaggtcctcgccttcagagggttacaggtcctcgcttttagagggctgcatgtccttgccttcacagggttgcatgccctcgcctttagagggctgcat

SEQ ID NO: 19086 - DNA, 628 bp, Glycine max
  Peptide Sequence Number=SeqID_110771
atgtcctggagaaacagtgtgggtaataatttgatgcaggcggatctctccgtttggggtatgtatcatcacgccgatattgtcgttaaggttgtgatgattggcttgattctggcttcggtagtcacctgggctatcttcttcggcaagggcgccgaaatgttgtccagcaagcgtcgcctcaagcgtgagcagcagcagctcagcgaagcgcgttctctcgatcaggctaacactatcgcgaatggattccatgctaaaagcctgaccactcagctgattaacgaagccaataatgagctggaactgtcggcaggcgtggatgataacgaaggtattaaagaacgtaccggtttccgccttgagcgtcgtgtggcgcaggttggccgctatatgggccgcggtaacggttatctggcgactatcggcgctatttccccgttcgtcggcctgttcggtaccgtctggggcatcatgaacagctttatcggtatcgcgcaaacgcagacgactaacctcgcggttgtcgcgccgggtatcgcggaagcgctgctggcaacggcgattggcctgtttgccgcgattccggcggtggttatctataacgtcttcgcccgcatgattgcca

SEQ ID NO: 19087 - DNA, 322 bp, Glycine max
  Peptide Sequence Number=SeqID_110772
atggagatgggaggagatctttatgaccacatcaacaagttcaatcagctagtgactgttgctcttagagaaaatgagagaatgatgagaactgaaaatgttgataatgagcataatgtaatagttatggtggagtctgagcgaaggaggaatcattcaaggagacatgatggtccaagaagaagattaaaattgcaatcacatccacaacaagatatgagtaacattcaatgttactattgtagtgagaatggtcatgtgcaagtgaggtgcaaacaaatgaaggaggacttgaagaaattgagagatatgaacaaagatg

SEQ ID NO: 19088 - DNA, 756 bp, Glycine max
  Peptide Sequence Number=SeqID_110773
atgagttgtacaggttcgctaagtgaaccgcttcatctcactaagcgcaccgcttcagttcatctgctaagcgagaaaggcgtgctaagccaaaaatcactaacgtgcactaagcgggagttttggattgggattcagagctttgcatgtctagggtttctagagagagaaaggttcaagttccagagagttttgagagatttttcttgtggaagaaattacttccaagattattttgatgatgccaaaaaatcaagagttaagcaagtcccaaagaatcagacttcaagaatcaagtctcaaagaatcaagattcaagaacaattaagttttaagattcaagattcaagaacaatcaagatcaagattcaagagaagttgatttcaagattcaagagaagaaatcgagaagcaacagtcaagacttcacaagggaagtattttttcaaaaaatctaaacatagcacaattttgttttacaaaagagttttctcaaaattttctaagttaccagagtatttactctctgggtacatcctttgtggcacaagtagagggtacatctacttggattgttatactgagaacaagagagggtacatctcttgtggatcagttcaagtggagggtacatccacttggcttttcaaagagaacaagggagggtacatcccttgtggatctttggcttgtaaaggattttacaaggctgaaagaaatctcaagaaccgttggttgcttgggggctggatgtag

SEQ ID NO: 19089 - DNA, 252 bp, Glycine max
  Peptide Sequence Number=SeqID_110774
atgatgtttgcctttacttctgctggtattaagttcaagaaatcaattaaccattcaagaggacctcctacaataagaattcaagcggaacgaagaaggaagagagagaggagatgccacttcaaggagaagatgagtctagacgaagctcaccaccataggaggccatggataagagcttggaggaagaaggagatgaatgaagggagaggggagaagagcacgaaattttgtgctctaaaagagctctga

SEQ ID NO: 19090 - DNA, 444 bp, Glycine max
  Peptide Sequence Number=SeqID_110775
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacacatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctaattccttcctttaa

SEQ ID NO: 19091 - DNA, 732 bp, Glycine max
  Peptide Sequence Number=SeqID_110776
atgactaggggcaatccaggtgatttacaaccctttgatactgaaatagatagaacctttcatagattatttaggcatattgtgcatcccgatcattctgtgcattttgagcattctgttgctggtgattctgaatattctgattttgagcattcgactactaatttacatattgagaacatggctctacctccacctcgtgagaggactcttagggagatggttgcacctgatttcacttatgaaagcttgtgcattcatatcctgatgaggtgttccatatgtgaagatcctcataagcatcttaaggagttccatattgtttgttccaccatgaagccccctgatgtccaggaagatcatatctttctaaaggcctttcctcattctctagagggagtggcaaaagattggttgtactaccttgctcccaggtccattttcagctgggatgaccttaagaggcaacatggagaggagtatgagcaacctgaagcttatgctgcaaacatttataatagaccccctcagcagcaaaaccaacaacaggagaataattatgatctttcaagcaatagatacaatccaggttggaggaatcatccaaatctgagatggacaagtcctccacaacaacaacaacctatccctcccttccagaatgatgctggtccaagcaagccatatgttcctcctcccaatgcagcaacaacaaagacaacaagcaactga

SEQ ID NO: 19092 - DNA, 117 bp, Glycine max
  Peptide Sequence Number=SeqID_110777
atgattgtgctcgagaatagagaagtggatagtgagtcatctaagagttctcatagttcctctagtgaaggaaaggatgatggttttcttccatcggaagagggagatcttttgatg

SEQ ID NO: 19093 - DNA, 234 bp, Glycine max
  Peptide Sequence Number=SeqID_110778
atgcccgtttgcgggcgagcgaggcgagggtcacgggtgcgctttccaagggaggaaagatgcgtggagtcgccaccaacatttatttgtggaaaacgtcagaaaaaccgaaggaaaccggtcaaaaagaaaattccaagtttggaagttgtatttgcgtttgaggaaggtcgacaaaagcggggctcttgctcctacgtaccctccatcgaagaggaaatcagacctacgtag

SEQ ID NO: 19094 - DNA, 261 bp, Glycine max
  Peptide Sequence Number=SeqID_110779
atgtacataggactcattaggaataatcaacatgaaaatacagaaaaaggtacgctttattgcattactttccttaattttttaaatagtgatcaaggggttctcacggaccctaagagaataaaggtcattcctgaatggcctactccaccaagtgtcgagggaaggagcccagagtatgaagaccctcaggatttgaggtcaaatcctttccaaggtggaggggatgatgcaatcctaccccccaagggtattggatag

SEQ ID NO: 19095 - DNA, 375 bp, Glycine max
  Peptide Sequence Number=SeqID_110780
atgggtgaagtagaggatgtacaagaaaagatgaaggccaacatggaggccatgatgatcatgaaaaagataatggaagccagtgcggttgcagttgccgctacaagcactgttgctaaggtgaacccgatgctcccatctggcctcaaccaaatgaatcatccaacctcagctatggtaggcaaagatttgggaagtacgggcggcccccatgatgtgcaaattcaaaacgagcacgccttcttgccatatggcttgcctctcaactatacgccacccaatgtggcatacactcccaataagaatgtcaataactccacttctatactcattgaaagccaacaacctcaaacttatcatgcacatgtctcttaa

SEQ ID NO: 19096 - DNA, 904 bp, Glycine max
  Peptide Sequence Number=SeqID_110781
gtcgactctagaggatcccggctgtcgtcgttcgaccgctcccggcagtcgctcgcccggttgaagaacctgacgagcgacttgatcgggcgattcgcccgcgcttcggtctccgcgacgaccgaggcgtatgggacgacggcgctggtccgctacaacgcccatgtggtcgtcccgcgtgtgatcgaggtcgagatcgcggtgctcaagggcatcatgggacaggccatcgtcaccatcgaggctcgcaagggcgtctacaaggagcagcgacgggtgctgaagcgcctcgccgacgctctctggtcgaccgacgcgctgtggtccgctggctccgatgttctcgaacccgccttcgccgcggacttcatcgcggctgaggacgacgccgagcgcgccagggtcgtggtggatcagatcgcgagtctcacggatcagagcgcgatcgactggcacaatcggctggtgggggagatcgacccggccgaggtcggcatctggactccccgtcatgccgacgtggacgaggtgaaggcgcggaccaacatcgccgacatcatcggtgagcgcgtcgccctgaagtctgccggtgtgggctcgctcaaggggctgtgcccgttccacgacgagaagagcccgagcttccatgtgcgccagcaggtggggtattaccactgcttcgggtgtggggagtccggcgacgtctactccttcctgcgcgagatggatcacgtcagcttcaccgaggcggtcgaacgtctcgccggccgcatcggctacaccctgcactacgaagacgggggcgcagcgcccgagacgagcgggcgcagccgtctgtatgcggcgaacacggccgctgccgagttcttccgtgcgcagctgctcacccctgatgcggagggcg

SEQ ID NO: 19097 - DNA, 513 bp, Glycine max
  Peptide Sequence Number=SeqID_110782
atggttgatcactggtgtttgctggtcacgttaaggttagagccaattgttgcacgatccgtaagatttcgcgatgtttcggaaggaaataagccaaaaactcaaaattggggtgaattgatcaatttagggggtgttcttcatccctgggcccatctaggcccattaagaagcttctacatgaagcttaagccaccagctggcctggacgagctgggcggcaagctcctcccctattttggctataaaagggcgtgggaggctgaaggaaagggttcaacaccttgggaaagcatatttcacttaaaattattgaaaagaaggagaaagaagaagaaaatcaaggtcgagggtaacacttctgtaaccaaatccgtgaatgttctttgccattcttcgtccgttcttcatcgttcatcgtccttcgaccggggtccattcttgctttgtatgttttcatcttcatcttgtctactttcggtattctttttcttcgttttaagcgagttttga

SEQ ID NO: 19098 - DNA, 405 bp, Glycine max
  Peptide Sequence Number=SeqID_110783
atgacagaggactttgaatcctatgaagacgaggactttgagtcctctaaaggcgaggactttgagccctctaaggcgaggactttgagtcctacgaaggtgaggactttgagtccaatgaaggcgaggactttgagtcctatgaaagcaaggactttgagtcctatgaaggcgaggactttgagccctccgaaggcgaggactttgagtcctctgaaggctaggactttgagtcctctaaagcaaaggacattgactcctatgaaggcaaggactttgaatcccctaaaggagaggactttgagtcctctaaagcaaaggacgttgagtcctatgaaacaagccaatgggcactataatgccaagggtctgttgatcccactgaaactcgatgacatgggttaa

SEQ ID NO: 19099 - DNA, 171 bp, Glycine max
  Peptide Sequence Number=SeqID_110784
atgtgggctaagcgcacatccaccgctaagcgcagcttcaacgcgacagaagaatctggcagggcatcagcatcaaggccgcacgctaagtgcgagatcagtgtgctaagcacagaagatgtcttcagccaggctcagtgcacgaatggcactaagcccgaatccacttag

SEQ ID NO: 19100 - DNA, 210 bp, Glycine max
  Peptide Sequence Number=SeqID_110785
atggcaacggaatgtgtagaagcaaagcttcatgatgatgacaaaggtgatgacaaaaagctcaaagatcaatcaaagaataactcaagtgaatcaaagatcaatcaaagaacaactcaagtaaatcaagaagaattcaagactcaacaagaaagtttagattcaagaatcaagaatcaagattcaagattcaagatctcaagaatctag

SEQ ID NO: 19101 - DNA, 234 bp, Glycine max
  Peptide Sequence Number=SeqID_110786
atgtgggggaaggtgagggtgtgggcgcgcgtgaagcggtggggtgtggataagttcagtagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19102 - DNA, 1064 bp, Glycine max
  Peptide Sequence Number=SeqID_110787
ccccatcagaggactactcgtcctcgccttcagaggactacacatccttgcctacagagagctgcacgccctcacttcagaggactacacgtcctcgccttcagaggactccatgtcctcaccttcatagggctacacgcactcgccgtcagaggactgcacgtcctcgtcttcagagggctgctcaccctcgctatagaggacaacacatcctcgccatcagagggctacacgccctcagctttagaggaatacacgtcgtcgccttcagaggactgcacgtcctcgtcttcagagggctgctcgcccttgcctttagaggactacacgtcctcaccatcagagcgctatacgccctcgccttcagaggactccacatcctcacttcagaggatgctatacgccctcactgtctgcatgccctcccctttagaggactacacgtcctcgccattagagggctgtacgccctcaccttcagagtgattacgcgtcctcaccatcagagggactgcacgccctcacctttagaggactgcatgtcctcaccttcagaggagctgcatgccctcaccttcagaggatacagccttgcctcagaggctgcatgccctcgcctttcagaggtactgcacgtcctcaccttcaaggagcacgtcctcaccttcagaggactagcacgccctcaccttagaggactgctacccgtcctcactttcaaaggggcttcatatccacactccttaagaggacatttaaggtcctctgcccttaaatgcttaaccgagacttgcgctcccgttgttgggccacctcctgatattggagagcgtccaactatgcgagcacaactagaaagggaggctatcacgcagctactatgcataccggggcaagatttcacccgtgcggctgcaaagagacgagggcggatcatgctcatcaacatgaccactcttacacaaatatggatgacaatgctacttagcaacattctgcccaacgaccacaatgcggatctccccctacggaagtatcagttggtctgtgccgtcatgacatag

SEQ ID NO: 19103 - DNA, 678 bp, Glycine max
  Peptide Sequence Number=SeqID_110788
atgggacctctccaaaggcaagccttccgcaaagtgtacgggatgattctagatttgaccgcagcggaggtatttacggaagctgtcatatccctcgcgcaatactatgaccagccgttgaggtgtttcacgtttggggacttccaaatggtaccaactattgaagagtttgaggaaatattaggatgccctcttggggggagaaaaccgtatcttttctccggctttcttccttccttgagcaagattgcagctgtggttggagattcagcaaaagagttggatcacatgaagcaaactcggaacggcatagtgggcctgcctcggaaatacttggaaggcaaggcaagggatatggcgagccaagagaagtggggcccgtttgcggatattttagctttgttgatttttggggttgtcctctttccgaacgtggacggtttggtggacttagccgccattgacgccttcctcacgtatcaccacaacaaggagagtccagtggtggctatcttggcagatttgtttgataccttagatcggagatgtgagaaaaacagtgcacggattgtctgttgtttacctgctctctgtgtgtggttggtttcacacttattccaacaagacacaagacacccgtgtccgcttcaaagctatcgctcatgcgccgaaaaatga

SEQ ID NO: 19104 - DNA, 492 bp, Glycine max
  Peptide Sequence Number=SeqID_110789
atggttaaggaggagtgtaaggaggtaagtgtctcctccaagaggttaactaagaaggaaagacattttgaaataaagacaaatattaaagaaatttcccctcttaaacaacctccacattttctcctttgtaaaaagacacttgttagcattgccacacctcttaggcttgatttcattcctcaagtaaaggagttgttggatgagggtttggttcgcaagagcttaaatccttgtgctttgttggtgcccaaaataggtattattaggcaccaaatccctaaaataggtggtatgatgaatgctttgggtggtgcaacactcttttgtaaaatcactcgtgcacccaacatcttcatgatttgtgtacatagggactcattaggtagggtttccatgaatcctaagagaataaaggtcattcctgagtggcccgctccaccaagtgtgttgaggaaaaaagcccagagtttcaagaacctcgggatttga

SEQ ID NO: 19105 - DNA, 691 bp, Glycine max
  Peptide Sequence Number=SeqID_110790
tctcacaagctatccagaactacgtaggtctgagttcctcattggaggatacgtaggagcaagagcctcgcttttgtcgaccacaccgccttttgttgccatgacccaagagctggtagcccgcggaggcaccttacggttatccgcacctcgtcattcagtgaccccaagtgtgattgatgagcagaggccaatgtggtcatctgcgcctctttccggagatgtcagcattttcggatggagacttttcaagtctcacaaaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttatggttattcgcacccttttgtcatccagaggcggcgggcccgatgacaagcagagaccaaagactgacatagtcttctgcaccttttgttcctccgggaacaacaagtcatttacatgtggaaatttcatggtcgcccgcgactctcgtcaaccgagaggagcgaaattagtgtcatacactgattttcggggacctttgcttgatgacatgcgaccattctttggtccttgtgag

SEQ ID NO: 19106 - DNA, 199 bp, Glycine max
  Peptide Sequence Number=SeqID_110791
agggagcctgagaaacggctaccacagtccaaggaaggcagcaggcgcgcaaattacccaatcctgacacggggagttaaaaagctcgtagttggaccttgggttgggtcgatcggtccgcctccggtgtgcaccggtcggctcgtcccttctgccggcgatgcgctcctgtccttaactgggccgggtcgtgcctccg

SEQ ID NO: 19107 - DNA, 306 bp, Glycine max
  Peptide Sequence Number=SeqID_110792
atggacattgaggaagatgcagatattcccttaattttgggacgtccatttatgtctattgcaagctgtgtagtggacatggggaagaaaaagttagaaataggtattgaagaccagcagatcaactttgatctatttaatgaagaaagaaaattgatggaccaaaatgtttgtttacagatgaaggagtttgatgagaagtgcatccctcgcactaagcgccatttccttcacgcgttaagcgagctgttgttcatgctaagtgccttgacccctgatcaatggctggatggtcccgctaagcaa

SEQ ID NO: 19108 - DNA, 189 bp, Glycine max
  Peptide Sequence Number=SeqID_110793
atggagaagtctgaaaagaaaaatattaatgaaaagaaattgaagaaagcatacattacatgggatgaaaacgatatggaatcttctgaagattcaggaaatgaagaaataaacctctgccttatggcaaaaagttatgaaagtgatgaagaggaaaacaaagacatgcctccaataaggctggactag

SEQ ID NO: 19109 - DNA, 228 bp, Glycine max
  Peptide Sequence Number=SeqID_110794
atggcggagcgtggccatggaatgtattacacaccaccaacattttctcagtatccaacacagatgtatcaatatccttttgaaggtcatcacactgatacttctgcaagcgaacattcattcgatggtgttgcggaaacacatcctaatttttcatggcctactatgaccccttcacagcaacatgatgccccaattccaacacctaatgccctcattaggtgttga

SEQ ID NO: 19110 - DNA, 246 bp, Glycine max
  Peptide Sequence Number=SeqID_110795
atggatcagggagccaagaaacctgtatcttccaaaagagatagagcatacttccattgggatacttgtacagaggcaagattgggtcctgacaggatgatgtcatctacatatactagtaaaatgactaaggaatttcctgagccaatagtgaaaaagggagtaatcatgcttggattaatggaatccatgactaagaagagtagtggagaacttacagcaccattgtctagaggcttgttttag

SEQ ID NO: 19111 - DNA, 245 bp, Glycine max
  Peptide Sequence Number=SeqID_110796
agccccatgaattgattgtctttcatgcgtcctccaccatcaagtccggagtcccacaaattgattgcctagcgctattcgtgtatcctccaccgtcctatttggagccccatgtgtccttcgttatcaagcgcgaagcctccgagaaagaagaaggagagacggaagtcgagcaactgtcataccctaatttcgtccggggactattgtttgatggcttgcaacctttggttgaccgcttcgag

SEQ ID NO: 19112 - DNA, 270 bp, Glycine max
  Peptide Sequence Number=SeqID_110797
atgactaaccgcctgagatatcttttgtttccccttacaaagattcaaaggactaactgcctgagaattctttgtctcaacacattggagggtacatcctttatgagagggtacatctcttgtggatcagttcaagtggagggtacatccacttggtttttcaaagagaacaagggagggtacatcccttgtggatctttggcttgtaaaggattttacaaggtcgaaagaaatctcaagaaccgcaagttgcttggggactggatgtag

SEQ ID NO: 19113 - DNA, 138 bp, Glycine max
  Peptide Sequence Number=SeqID_110798
atgcatcaaacaggaatcttctatgtgcctaccgtggggaattacgcctcccttttgttccgtcagggccgtaccactttgggaagggaggctggtagatcttcccgggagatatcacagccatctggttggcgatga

SEQ ID NO: 19114 - DNA, 417 bp, Glycine max
  Peptide Sequence Number=SeqID_110799
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctaacttgcaagatttcaatcatgtcaattcaattcaagtcgggaaacctgtcgtgccagctgcattaatgaatcggccaacgcgcggggagaggcggtttgcgtattgggcgctcttccgcttcctcgctcactga

SEQ ID NO: 19115 - DNA, 531 bp, Glycine max
  Peptide Sequence Number=SeqID_110800
atggggacgaatcaaaacaacaaaaggttttatcaagtcaaggttaaaagtctagatgtcagtagcctcaaggaattgggacgattgatgggacctctccaaaggcaagccttccgcaaagtgtatggaaagattctagatttgaccgcggcagaggtatttacagaagttgtcatatccctcgcccaatactatgaccagccgttgaggtgcttcacgtttggggacttccaaatggtaccgactattgaagagtttgaggagatactaggatgccctcttggggggagaaaaccgtatcttttctccgggtttcttccctccttgagcaagatcgcaactgtggtcggggattcggcaaatgagttggatcgcatgaagcaaactcgcaacggcgtagtaggcctgccacagaaatacttggaaggcaaggcaagggatatggcgagccaagagaagtggggcccgtttgcggatatactagctttgttgatttttggggttgtcctctttccaaacgtggacagtttg

SEQ ID NO: 19116 - DNA, 96 bp, Glycine max
  Peptide Sequence Number=SeqID_110801
atgatgcatgcacctgacctcaactttcagatgcaatgcgtatttgtcgaggccacccagtcatgcaccgtaactcccccccccccccgtaggtga

SEQ ID NO: 19117 - DNA, 106 bp, Glycine max
  Peptide Sequence Number=SeqID_110802
cgctaggctaatcacttcgtggggctccagactcatggtggaggatgcatcagcgctagacaatcaattcatggggctccggataagacttgagggtggaggatag

SEQ ID NO: 19118 - DNA, 513 bp, Glycine max
  Peptide Sequence Number=SeqID_110803
atgcgcggcgtcgtgacgctggcacttgcgctcagcctgccggaggattttcccggacgtgacttcattctggtcatggcattcgcggttatcgtgggaaccgttctcatacagggaacgacgcttgggtggattatcgcctgggcggggctcggcaatatcgaaccggagcgcgcaccgatgacgatgagtgaggctgaagccgccatggcgcaggtccagctcgcagccgttcaggggcttgcctacgacgaaagtggggaactcatccatccccaactcctgaagagatacgaacaccggctggcggcaagtgtcagatacgccgaaagtaccgagaaatattcgccacttcttcatgcccacttcgatgtcgttcttcaggctgtcgccgccggcagaaaggaacttattcgtctgcgacgcgaagggaagatcgatgatgaaactctaagggagcttgagcatgatctcgatcttgaagagctcggcgcaatttctgcgaaggcgtga

SEQ ID NO: 19119 - DNA, 462 bp, Glycine max
  Peptide Sequence Number=SeqID_110804
atgaccatgattacgccaagctcgaaattaaccctcactaaagggaacaaaagctgtattaaaatcattaaatcagagtttagtaagtatgtgtggttaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19120 - DNA, 735 bp, Glycine max
  Peptide Sequence Number=SeqID_110805
atggcagaaccatcgaagaagagaaagggatcatcctccaccgccgctgttgctgtccatcgccaccacggaccatccggagcacccacaacacctattcatccctctttgtcatctccaagatcatccacattgttttcatccgatgatcagcatctacgtcaaggtgcaccttttgagggcaccattgttgatgactggaaatttgattattctagtcatgatgctcgtcgtatggaggatttgattctgatgtgggctttccttactggtcgtcagatcgactgggcccacttggttcggtaccgaatgcttaaggcattacgggccaatgcacttctcccttacccacaattgataactttgtttctgcgtcattttcaaattctgcttgatgatgaaccatttgttcaagtcaagcattcctttgcaattggtgctggtgcagtgacttcctttggataccgtaaggatcggaatggtcaatggctgaagaaagacgcactccctcctcaagatgagcgtactccttcacctcctcctcagcgagatgattcagcactcatgactgaagttctttctgaattacagggtcttcgttcttatgttggtgaacattttgactcactggatactcattttgccggaatggatatccgcctcacacagcttgaagaggatgtgggttacattcgtcagagtttcgatcttccaccaccacctccaccttcttag

SEQ ID NO: 19121 - DNA, 522 bp, Glycine max
  Peptide Sequence Number=SeqID_110806
atgtctccggcaaacacctctaagcctgatcgcagagctttcttgaggccttatcaggttacatgggatgccaccatgttcggggtcttcaatccagatttcccactctacataaagcacaaagacctctctgaaatcgcacacggtggtcaatgtctcagcatatcagtgttacagttgtggattctacatctcactgaaacaagtatgcgagcggagaattctgatatctatggattcctcgagccacagtccattcagaggtctgggcaatcacagtttgagtttgaaagttacataaagacttggatgcagagttcaaaacgcgatgtctatcttggagcctacctaaatggtgctttaaaaggtcttgatgatactccacagcctaaatcaaaggctcctgctaggtggattgtcgtcaagtattttaacgatcctagaccattggagccagagagattaaaggcgttgcggatccagtggacacagtattatctccgagttagagatcaaacctag

SEQ ID NO: 19122 - DNA, 192 bp, Glycine max
  Peptide Sequence Number=SeqID_110807
atggcaaagtattccatcaaagtttctcccatttgcgggccatctccattggagcttgtaggcctaggatcttcttcatcaatggattcctttgcttcttggaagatgaatgtcagcggaatggagaaggaagagagagaggagatgccacttcaaggagaagatgactctagaagaagctcaccaccatag

SEQ ID NO: 19123 - DNA, 525 bp, Glycine max
  Peptide Sequence Number=SeqID_110808
atggtggtctttccgtttccaggtgaccccaccccatgtcccagaacctccaaggccaagcgcgacaagcgcaagaagcagcaggccaagcgtccgttcctgcgcctgaacgcccagcagcaggtgcagaaccatgccgtgctgaccaacgaagacggccaggtggttgcggccatcggcctgcagggcggtgagtggctgctggccatcggcggccggaccatgggcaacgccgaaaacccggtgccgatgctggccatgctcaagcacctgtccaacgtgcaggaaaaggaaggccgcaaggtcaacctggagtactccgagctgctgcagaagctgctggacaccctggcagccgaatccgagcagaccgcagacgagtacctggacaagctggtcgccgagttcgagaccgtggaagccgaagaaggcgaagaagccgctgaggccgccgaaggcgaagtggttgaagctgctgccgaggccaccccggccgctgacagcgacagcaagccgcaggcctga

SEQ ID NO: 19124 - DNA, 479 bp, Glycine max
  Peptide Sequence Number=SeqID_110809
ttaccctcaccgtcagaggactacacgtcctcgccttgagaggactacacgtcctcaccatcagagggctgcacgccctcacctccagaggactacatgtcctcgccttgagagggctacacgccctcaccttgggtactagttaccctcactgtcagaggactacacgtcctcgccttgagaggactacacgtcctcaccatcagagggctgcacgccctcacctccagaggactacatttaccctcaccgttgagaggactacacgtcctcgccttgagaggactacacgtcctcaccatcagagggtgcacgccctcacctccagaggactacatgtcctcgccttgagagggctacacgtcctcaccttgggtactagttaccctcaccgattcagaggactgcactgccctcaccttcagaggactacacgtcctcgccttgagagggctacacgccctcatcttgggtactag

SEQ ID NO: 19125 - DNA, 291 bp, Glycine max
  Peptide Sequence Number=SeqID_110810
atggaacttagtaatggaaagggcccatcaagggtgaatcttggttgtgtcgaggcttaccaaggacgggccttggattttgtaaacccttatggatcagcaagcgcgaaggttgggtttgatgagtcttgcgtgcagtgcaagtattgtgctcttacatacacgcctcttacaaagtggcaggtactggagacatggtggtgtctatcagtgggactcaccaaaggaggaccttgggtttcgcaagccctttggaggattgaccagggaatttttcgacttgggttttga

SEQ ID NO: 19126 - DNA, 393 bp, Glycine max
  Peptide Sequence Number=SeqID_110811
atgaagaacgtcgaagaacggttcaaacctttgcgagattcctcacggaaacgttacggaaacgtttcggaagcgcctcggcttagattttcttcacggaaacaatttttccaagcaaattccaaagagagagaagtgcctaaggggctgggatcccttttcttcttgcattcctcccctatttatagcaaaataggggaggtggttgccgcccagctcgcccaggcgagctcagctcgcccaggcgagcagggttgcttcctccagaagcaaccgccttctggaggaatcttctggagggcccaaatgggcctggttacggaaacttacgaatttcgtccccgatacttgttttctttcccccccccttacggaaccttgcggattacataa

SEQ ID NO: 19127 - DNA, 652 bp, Glycine max
  Peptide Sequence Number=SeqID_110812
cgggtcgtcgcgtgccgtcggggacggattgggaacgggcccttcggggcctcttccccgggcgtcgaacagtcaactcagaactggggtggtctggaagtcaagaaatccgcgctaagggagtgtgtaacaactctcttaaggaccacagccccatgagtaggacgggctgcggcggatcagctgcgggaaagacccaggcgagcccggagcttgacggtctagtccgctttgtgcaaatgatcttgagatgcgttatcctaatggaagcggggcgaactgccccgtcttttggatcccaaggtcggctctcgtgccgtgactccgaaggaatcgggagtcctaagatgagctcagagacagaaatctcggggaacccgaaagagggtaaaagctcgttttctgatttccatcctggaattaacgctagaggtagaaaagttccacaggctggaagagcaccgcacgtcgcgtggtgtccggtctccaaggtgaacagcctctggtcgatggaacaatgtatgcaagggaagtcggcaaaatggatccgtaacctcgggaaaaggattggctctgagggctgggcacgggggtcccagtcccgaacccgtcggctgtcgtggactgctcgagctgcttcgcgcgagagcgg

SEQ ID NO: 19128 - DNA, 348 bp, Glycine max
  Peptide Sequence Number=SeqID_110813
atggtcatcattgtcaatgcggaagcttgtggttacgtgagcatgaactactaccaatatatagatgttgtttacacaaatgagcacatcttaaaagcctactccgcacaatggtggcctcttgagaatgaagcggctattcctccttctgatgacgcatggacacttatccctgacccaactacaattcacgcgaaaggtcggccaaaatcagcaaggataaggaatgagatggattggctagaaccatctaagcaccgacaaaaatgtagtagatgtggagtagaagggcacaacaggcgtcgatgtccaatacaatctgaccatgggagttgttcatttaattga

SEQ ID NO: 19129 - DNA, 360 bp, Glycine max
  Peptide Sequence Number=SeqID_110814
atggatggcctcaaaagttacgatgatggcatggcccagcaaatcatggaccagatgtttgtgtttgacaacatcatggaaattgacgacaggggcatccaggtgctattgcgtgaagtacagtcagacatgctgattgtcgccctgaaaggtacctcggatgaaatgaaagaaaaattcttccgcaatatgtcttcaagggcagcagacatgatgcgcgaagacctggaaagccgtggcccggtcaagctgtctgaagtcgaaggccagcaaaaacaaattctgcagattgtgcgccgccttgctgatgaaggccagattatgctggcaggcaagggtgacagcgaacaatatgtttaa

SEQ ID NO: 19130 - DNA, 753 bp, Glycine max
  Peptide Sequence Number=SeqID_110815
atgggggctggcgggcttctccagcaccaccgtctggctggtgttcggcgcctttatcttcgcgatgggctacgaggccaccggactggggcggcgcatcgcactgttcctggtgaagtttatgggcaagcgcacgctgacgctgggctatgcggtggtgatcatcgatatcctgctggcgccgttcacgccgtccaacaccgcgcgcaccggcggcacggtgttcccggtggtgaaaaacctgccgccgctgttcgattctttccccaacgatccctcttcacgccgcatcggcggttacctgatgtggatgatggtggtcggcaccagcatcagctcctcgatgttcgtcaccggcgccgcgccgaacgtactgggcatcgagttcgtcggcaagatcgccggggtgcacatcagctggatgcagtggttcctggcgttcctgccggtcggcctgctgctgttgatcgttgcgccgctgatctcctactacctgtacaaaccgggcgtgacccacagcagcgaagtggccgcctgggcggataccgcgctgggggaaatgggcaagctgacgcgcaaggaatacaccctgatcggcctggtgctgctcagcctgtgcctgtgggtgttcggcggcaaaatgctggatgccaccgcggtgtgcctgctggcggtgtcgctgatgctggcgctgcacgtggtgtcgtggaaagagatcaccaaatattccagcgcctggaatacgctggttaa

SEQ ID NO: 19131 - DNA, 660 bp, Glycine max
  Peptide Sequence Number=SeqID_110816
atggtgaggttcatgaaacaggccaatgtatttccatcgaagaaaacgctcaagaaattcattttatggggaatcaacaacgacaagggtatactcaaggaggattttcaggctttcagtagagtccctataatcaacaaggacagtggaggacacaccctggtaacaatgtcaaatcataaaatcactgagttagcactgaagaaccttgaggtccaggtggaacaactggccaagcaaatagttgacaagtcatccaacagttttgtggcaaatacagaacaaaatcccaaggaggaatgcaaagatgtaatgacaaggagtaagaggtttgtggaagctgaggatgaagaaagtgtggtgtacaatgagaaagtggctgaaaaggaaagtactgaagttaagaaaaatgatgggagaggtgaagggaatcaggaaaaagagaaacaaataatggtccaaaaaaaagaaatggaggaccaagaaaaagaaaaagaagtagaaaaagaaatagaaaatgaaaaaaaatgcaaaagaagaaaaaaaataaggttgcaaagaagggtagaggtgaaaaagctgtggacgaaggtgtggaagtaccatatcttgtggtaccttccaagaaggagaaagatcgtcatctggcaagatttttag

SEQ ID NO: 19132 - DNA, 327 bp, Glycine max
  Peptide Sequence Number=SeqID_110817
atgacgttaatctccgcgtgtcaacgggcttgtcggccgcgattgacgaagggcacagaagacgacgttagtatctgcgtgctatcaggcttttcgtcttacagacaacaaaaagtttatacggataaccactcgggtatttccgcccgtcagcgtgactcaaaaactagcaaaaagtttatacggataaccactcgggtatttccgcccgtcaacgtgactcaaaaacagcaaaaagtttatacggataaccactcgggtatttccgcccgtcagcgtgactcaaaagtcagtatgacagatcttgtgagcgcggaagatgactaa

SEQ ID NO: 19133 - DNA, 279 bp, Glycine max
  Peptide Sequence Number=SeqID_110818
atgttcgaatcgacaagtactttcaaggacacagaacttgctcactatacttttgcaaatactgctttcatgggtaaaaagcaaccaagcatgttaagagtcaagaaagcactatgtcaatatgaagctgagtatgacggccatcatgcgtttggctcatggcaatttcggctaaggaacttgtgcaaagagttaaaaatgccacaagaagaacctaggaaagatatgtgttgcaataaatcagcactcagacttggcaaagaatccagtcttttatga

SEQ ID NO: 19134 - DNA, 555 bp, Glycine max
  Peptide Sequence Number=SeqID_110819
atcatggccagaacacgaggtttaggtcgtgccataggtagatttgtaggcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacagctgacactgattgggaggccagtgcctgagattgaaggcctggtggctgccacaggattaagtccactgatagattgttcagttattactggcgatcctggacttatatccgcatttgtggagaggtggcacagtgagactagcaccttccaccttccagtaggagagctgacgatcacattggatgat

SEQ ID NO: 19135 - DNA, 378 bp, Glycine max
  Peptide Sequence Number=SeqID_110820
atggtagccataacccctgctaggtttcgtcaatctccattttttcgaggatacgactcgaacgcaacgtgtgcttgtcatggagaagccccgaggcgttccattgagcattgtagggccctcaagagtaaggattttcaagtgcaagccattggtcaatttgctcaagcgacctgtgctcctgagtttggacttccaagaccgttcaatcagagattactcgtcttgcacgttggtggggttgccgtaaaacaacgaggacaacccttcccttgtgttcaagaatcctctacaacaagagacccacggtctcttaatcctttttcagaaataagaagaagagaagaagagaagaagagatctctcttaaagagatag

SEQ ID NO: 19136 - DNA, 681 bp, Glycine max
  Peptide Sequence Number=SeqID_110821
cctgagcctgatcctcgcgatcggcgcccagaacgccttcgtgctgcggcaaggcttgcgccaggaacacgtcttcgccgtctgcctggtatgcgccgtctcggacgcgatcctcattgccgccggcgtggccggcttcggcctggcatcgcatgccctgccctggctggaaccggtgctgcgctatggcggggcgctgttcctgctggcgtacgcggcgcgcagcctgcgttccgccctgcgcaaccacggcagcctgacgccatcgggtcggcaagcggccgggctgggcgcgaccctggccacctgcctggccttcacctggctcaatccccatgtctatctcgacacggtggtgctgctcggttcgatctccagccagtacgacggacacaaggctgccttcgcgctgggcgcgatggcggcttcgttcacgttcttcttcacactggggttcggcgcccgcctgttgcggccggtgttcgccagccagacggcgtggcgggtgctggacgtcctggtcggcatcgccatgctggcgatcgcgttgaagctggtctggccgtgattctgtcgcgccgccggcctcattggcccgacgtggctttgcgcacggcggccggcgtattgcggaacgtgacgcccaggcgattgaacgcgttcatcagtccgattgcatag

SEQ ID NO: 19137 - DNA, 598 bp, Glycine max
  Peptide Sequence Number=SeqID_110822
aggacagcacgtcctcaccataaaaggactacatgtcctcacctacagcgggctgctcgccctcgccttcagaggactacacgtcctcgccataagagggttgcacgccctcaacttcagaaaactacgcgtcctcacctttagaggaatacacgtcctcgcctttagagggctgcatgtcctcgtctttagaggactacaggtcctcgccttcaaaggactacacgtcctcgccatcagaagactacacgcccttgccttcagaggactacgcgtcctcaaaatcagagggttgcacgccctcaccttcagaggactacacgtcttcgccatcagagggctgcacgccctcaccatcagaggactacatgtcctcgccttcaaaggactgcacgtcttcaccttcagtgggctgcaagtcctcgccattagagggccgcacgccctcaccttcagagggctacacgccctcgccatcagaggactgcacgtcctcaccttaagaggactgcatgtcctcaccttcaggggctacttgcccttcccttcagaggactacacatcctcgccatcagaggactgcacgtcctcaccataa

SEQ ID NO: 19138 - DNA, 111 bp, Glycine max
  Peptide Sequence Number=SeqID_110823
atgttggggtcagggaacctaattgtgaggatgtatgcttgtccctgttgcatgctagttttcaagaaaaataatgttttgactaatgagatgcgatatgtctattattga

SEQ ID NO: 19139 - DNA, 144 bp, Glycine max
  Peptide Sequence Number=SeqID_110824
atgacccaagtgaaggcaagagccatttctaggcttgggaggattgatggggacccggcgttgagaggaacgacgataagggctacgtgggagtacgtgagctcagttgaaggtgggcaacaggggatggtgggttatacgtga

SEQ ID NO: 19140 - DNA, 294 bp, Glycine max
  Peptide Sequence Number=SeqID_110825
atgagggttcactgtaatcaagcaagtcggagacctagcatgaccacagattcacctccactccttatgttcccatggacccggtccccagtggagtcgccaactgtcgcaaccaaccctacaacggaagggcgacgcgagggctcacgggtgcgtcttccatgggaggaagatgcgcggagtcgcaaccaacgtttattcgaggaaaatgtcggaaaaaatggaaaggtgtggtctacgaactttaagtgtgaaaggttcgggagttgtatttacgcacggggaaggtattag

SEQ ID NO: 19141 - DNA, 357 bp, Glycine max
  Peptide Sequence Number=SeqID_110826
atggttacctcaaggaaaaccatgaaggtcagatcgggcttcgttctcaaccgaaaccgcgaggcaagtttggaagattccgcttcgcttgaagggtcttctcggtgtggggtttcaacggagaacaatggcggtttgtgggggctactggtggttgtgggtgatggagaagaagctttggacgttggaaatggttttggaagaaagaaggagaagaaatggcgtttttccaaagctacttggactacaaggctcaaaacgcacaaacatattctaaaagatcccaacggtcagatcttggacatccgtcctatgaacctccagaccaaatttcaagaagatccaacggttaactaa

SEQ ID NO: 19142 - DNA, 1054 bp, Glycine max
  Peptide Sequence Number=SeqID_110827
cgccttggccaggaactggtggtggccgcggtgcgagccgttgatctggtcgccggcgcccagcgccagcaccgagccgacggcgccgccttcctggcccaccgacgagtgggcggggccgtgcaccaggccttcggcggccaggtccagcaccgcttcctcgaaggcgcggatccagtgcagctgcgtcagcatggtggccagcagcgcggggtcggcctgttgccagtccgaggcctcgaccgtcagttgccgccagggcgcctgggaaccaagcggttggtagctgtagcggctccagccgccatcggccaccagggtgtgtccggtgatgtaggcggcctggctggacgccaggaacaccgccaggtcggccatttcggccggctgcgccaggcgccgcagcggcgtgcgctgcttgaggcgttcggggtcgaggcggccgcgcgcggccaggtcgcgcaccaggtcggtctcgacgtagccgggcgccagcgcgttcacgcgcacgcccgccgggccccattccaccgccagggtctcggtcagcagtaccaccgcgcccttggtggcgcagtaggcggcgcggtcgggcgccgccaccacgccatacatggaggccaggttgatgatgcagccctcgcccttgggcaccatgcggcggccggcggcctgggcgcacagaaacacgccggtcaggttgatgtcgacggcgcggcgccattcctcgggggtgacgtccagcgacggcttgttggccgagatgccggcgttgttgaccagcacgtcgatgccgccccaggcctgttcgacctgggcgaagacgcgctcgaccgcgtcggcgtcggtgaccgaggcctgcgcggccagcgcttggccgccggccgcgcgcagcccggccacggccgcgtccagcgctaccgggtccatgtccagcagcgccacccgcgcgccctggcgcacgaacgcctcggccgtggcgtagccgatgcctttggcgccgccggtgatcaccacgttcttgccgcgcaggtcggcgtggcgtacttcaggg

SEQ ID NO: 19143 - DNA, 693 bp, Glycine max
  Peptide Sequence Number=SeqID_110828
atggacacatttaaaggacaaatacaagaagctatcaagttggagttgtcacaaattgcatcacaacattcagccccacttcagccaaatgatatacaagtattagcagcaagggtaagcacgaagggaagctgtgcagcagcagagacaaatgcattagctaaaaaaccctctgagttgaatggtgacaatgtcggcctgcatgtaaccgttgagaactccaacaaattagtggcagtgggcaaacggtgcgacagttttggcaccatccacaacgtgccctatgctgatgatgttgttcgcgtgagtatggtggaagttattttcgatgatgcggaggttccaatccctacatcagaaataaagtttgtcaaagaagctttaggtagttttgttccatggccaacacatttggtcaaacccatcttgcctgaggaagcagagaaggatgtgagctcaccattgaagactattgaggaggaaaaggtagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtgtttaaacatctccattctacagctatggcttatgtaa

SEQ ID NO: 19144 - DNA, 308 bp, Glycine max
  Peptide Sequence Number=SeqID_110829
tgatccgaccgtcgatcacctgggccttcatcgagaagtattgcacgcctaggcaggcgcagggtgatgcacatcaggccacagacgcactgccaccacctcggcaggccgatcccgctggatcactaggcatggagcgttatctacagcacttggttctccagcaggcgaccaaccaccgtgggcaggtgcagatacatgagtgtctctaccggttcagcctcagtcagctggggcagggttccgctccttttgcatgccctactccggagcagtttggggaggaggtcgcatggcccggagactag

SEQ ID NO: 19145 - DNA, 740 bp, Glycine max
  Peptide Sequence Number=SeqID_110830
atggctacctcaccaaaagaaacttcagctcctggttcaccctctgtaccatcatctccatcatccaccaaagcaccatcaaaccaggaacaacctgaattccatatccaacccatacaaatgattcctggtcaagcccctgttcctgagaaactggtccccaaaagacaacagggagtgaagatttctgaaaaccctagccgtgcaacaagtcctagggaagtagacccggagatggataagaagatccacagtattgtgagtagcattttgaaaaatgctcctgtccctgatgctgataaagatgactcaacagaggaagaggatcaagccacagaggagacccctgcaccaagggcaccagaacctgctccaggtgacctcattgacctagaagaagtagaatctgatgaggaacccattgccaacaagttggcacccggcatcgcagaaagattacaaagcagaaagggaaaaacccccattactaggtctggacgaatcaaaactatggcacagaagaaaagcacaccaatcactcctaccacatccagatggagcaaagttgcaatcccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgttgaaag

SEQ ID NO: 19146 - DNA, 480 bp, Glycine max
  Peptide Sequence Number=SeqID_110831
atggggcactacgacaacggtgagcacggctcgaacgcaccgggtgacgtggagatggcgcgcagcctgcctgcgggctcgctggcgatgattgtgggtggtcactcacaagatccggtgtgtatggcctcggagaacaaaaagcaggtggattacgttccgggtacgccgtgtgcgccagaccgtcagaacggtatctggattgtgcaggcgcacgagtggggcaaatacgtgggccgggcggacttcgagttccgtaacggtgagatgaagctggtgcattatcagctcattccggtcaacctgaagaaaaaggtcacctacccggacgggaaaagtgagcgcgtactatacacgccagagatcgccgaaaaccagcaaatgctctccctgctgacaccgttccagaacaaaggtcaaggcgcagctggatgtgaaaatcggcacgctgaacgggcgtctggaaggggaccgcagtaa

SEQ ID NO: 19147 - DNA, 174 bp, Glycine max
  Peptide Sequence Number=SeqID_110832
atggcaaaggggtgcggaatgaccaaattttgtcttcgcatgtcatcgggccctccgcctctggatgacaaaaggggtcagtatgacagagcttgtggggcggccgacaaaagcaaggctcttgctcctacgtatcctccaatgaggaactcagacctacgtagttctggataa

SEQ ID NO: 19148 - DNA, 327 bp, Glycine max
  Peptide Sequence Number=SeqID_110833
atgtatgaaacagttcttaataaaaaacaatctgatcaggcaggaaaatttattgatgaacggtatatagtagaattcaataaccagaataaacctttattcgatgcatttccagatatacacttcactctaaaagatatttttgaaggaggaaataaagtgatcactgtgtatggagtgggaaaggaacccatcttcatcaatacaaaaatatcgctgctacacaaaaaacgggatggaaaaatcgttagcagcacagcaagtccagataaactgtcattttatcagcaattgggagtaggtccggatttgctggtaacgaaggag

SEQ ID NO: 19149 - DNA, 389 bp, Glycine max
  Peptide Sequence Number=SeqID_110834
atggttaaggaggagtgtaaggaggtaagtgtctcctccaagaggttacctaagaaggaaaggcattttgaaataaagacaaatattaaagaaatttctcctcttagacaacctccacattttctcctttgtaaaaagacacttgctagcattgccacacctcttgggcttgagtttattcctcaagtaaaggagttattggatgagggtttggttcataagagcttaaatccttgtgctttgttggtgcctaaaataggtattattaggcaccaaatccctaaaataggtgatatgatgagtgtgttgagcggtgcaaccctcttttgtaaaatcactcatgcgcccaacatcttcaagattcgtgtagatagggactcattaggtag

SEQ ID NO: 19150 - DNA, 582 bp, Glycine max
  Peptide Sequence Number=SeqID_110835
atggcgcgaggccagcaccacgtcaccgtgcagcagcagcaccgccacgcggatgaattcctcgatttccgacagggcttcgtcgtcatcatcgccgccggcctcgaaatcctcgctggaggcgcgggccaggctggccatgtcggtcagcgcttcctcgccctcttcggacagggctggccggttgccaccactacccagaccgaagccgcccaggaacgagcgggtccagctgaacatggcatcggcctgcgcggacacgtcatcgttgtcggtcagcagcagttcgaaggcgaagtcacggtcttccagctgcttgatggtgacctgcagcagctgcgccagcacgctgtcggcggccaccggcgccaggttgtcgtcggccagcacgcgcgccggccagtcgttgccgggggcgccgccggcggccagccagccacacagcgcgccgtgcagctcggcagcggtggcgcccaggcccagttcctggctggcgcggtaacgtcgtcgacggagggaagttcggtcatcgtgcggctcgttcggaaaggaaacccggggcgcgcacgcgcgcgcccgtga

SEQ ID NO: 19151 - DNA, 410 bp, Glycine max
  Peptide Sequence Number=SeqID_110836
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgtatggccgc

SEQ ID NO: 19152 - DNA, 303 bp, Glycine max
  Peptide Sequence Number=SeqID_110837
atgttcctccagaaggtggttgcttctggaggaagcaacctagcttgcctaggcaagctgggtggcaagcatctccttccttttcctataaataggggaaggagggaagaacaaaaaggttcaaccctcctggtatctgagattcacttaaaattagtaagaaaaattgtttccgtgaagaaaatccatagccgaggcgcttccgtaacgtttctgtgggtgatttcgcgaagattttcaaccgttcttcgacgttcttcgttcgttcttcggtcttcaaccgcatccgttaatttctgttaa

SEQ ID NO: 19153 - DNA, 522 bp, Glycine max
  Peptide Sequence Number=SeqID_110838
atgaccggccctctcgatgagtcaatctcttgctttctcataagggtggacccttgggtactagtacctattgcctttattagagggctgcacgcccaagccttcagaggattgcacatcctcgccttaagagggctacatgtcctcgccttcagagggctgcacaccctcgccttcagagggctacacgccctcgccttcagagggctgcacgtcctcccctacagagggctacacgccctcaccttgagaggactgcacgtcctcaccttcagagggctacacgtcctcgcctttagagggctacacgtccttccctttagagggctgcacgcccttgccttcagagggctgcacgccctcgccttcagagggctacacgccctcgccttcagagggctacacgtcctcgcctttagagggttacacgtccttgcctttagagggctgcacgccctcgccttcagaggactgcacgtcctcgccttcagagggctacgcaccctcgccttcagagggtga

SEQ ID NO: 19154 - DNA, 478 bp, Glycine max
  Peptide Sequence Number=SeqID_110839
gactgttctcatagccaacaacgtttctcttctcaacaaagaggataatgcaccaatctacagtgttgaagatgtcaaaaacattaaagagatagctgcaagagatgatgcatttgatctgctaagtgattcacttgcaccttctatatatgggcattcttggataaagaaaggagtgttactcaatcccacaaaatttttagggaacattgtggttgaacatgattatgctgagtgcactggatctgctattcaagctttagttttgtttaagaagctatatccaaggcatagggagacagagataaagaattccattgccaatgcagttcatgcagcgagtaaaacttacactaattgtgctgccattcgcaaaaccattaaatttctactttcaacactgaaagaggatggtgtgttctgggagaaagctatctttcatgcccaaaacaggtttgtcattgaatggtcatggtaa

SEQ ID NO: 19155 - DNA, 782 bp, Glycine max
  Peptide Sequence Number=SeqID_110840
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacgtggtggcgctgtcgcaacatggcttgcacaatgccgtagcgaccttgggcaccgcgacaaccgaataccacatcaccaaattgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 19156 - DNA, 531 bp, Glycine max
  Peptide Sequence Number=SeqID_110841
atggtagaacaacaacttaaaaggaagtctacttcaaaatcttatggctctcactcttatccaaagaaagaccaatgtcaaggaatcttaggggtgagaccttctaagcccaaagatgataaggggaagacaatagaaaagcaaccccttaaggctagtatgcaagagaagactaggtccatgaagtgctttaaatgtcttggaagaggacacattacttctcaatgcctcacccagaaaaccatgattatgaggggccaagacatttatagtagccaatatgaggctactacttcaccttcctctagtaaaagtgaagaagcaaaaggggaagaatctagtaaagagatctacccccaagaagaaggacaacctttaatggttaaggaggagtgtattattaggcaccaaatccctaaaataggtggtgtgatgaatgctttgggtggtgcaacactcttttgtaaaatcactcgtgcacccaaaggtgttgaggaaaaaagcccagagtttcaagaacctcgggattga

SEQ ID NO: 19157 - DNA, 319 bp, Glycine max
  Peptide Sequence Number=SeqID_110842
atggcctctaatgcacttttaacgaatgatcagaggcttgctaggcacttgaacatggatgcaacttgcttgaggtggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 19158 - DNA, 645 bp, Glycine max
  Peptide Sequence Number=SeqID_110843
atggggttcaaggggatagaggttagggtctctgagactggttggccatcaaagggagatgctaatgaggttggcgccacaccaatgaatgctgcaacttacaacaggaacttgctgagaaggcaaatggccggtgaagggacacctttgaatcctagaatgaggttggaagtgtacttgtttgcgttgttcaatgaagacttgaagcctggaccaacctcagagagaaactatggtctctttaggcctgatgaatccatgacttacaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19159 - DNA, 308 bp, Glycine max
  Peptide Sequence Number=SeqID_110844
aaaatcgaagccgaggtacttccataacgcttccgagacgtttccgtgaagaaaattgtttgccgtcgttcttcaccgttcttcattcattcttcgttcttcaaccggaagagaaaaaaccagaggaaaacaaagtggaggagaaaaaagcaaatgaagaagaaaagaaagaagaagagaaaaaatcagaggaatcaaaagatgacaaggaacccaaggaggaatatatgccgccagaaatcgtgcaaggcacaacctttggaatgcatggacactttaagcatgatttctggcatcttttaagttaa

SEQ ID NO: 19160 - DNA, 195 bp, Glycine max
  Peptide Sequence Number=SeqID_110845
atgttggtagatctaaagaaactcgcttaccagaatgaccctttcatcatgacagaacaagctaaacatatgatgattcatacattgatacttatgttagtcctttgtccacacaaatgtcgcctaacgtcatcggagaagaagaagctaacgacgttcatgctaatcgtaatgatcatgatgaatgagaattaa

SEQ ID NO: 19161 - DNA, 70 bp, Glycine max
  Peptide Sequence Number=SeqID_110846
atgcctgacatttccttacatgagcgcaacatcaagcttatcgataccgtcgacctcgagggggggcccg

SEQ ID NO: 19162 - DNA, 849 bp, Glycine max
  Peptide Sequence Number=SeqID_110847
atggggctggggtgcatgggcatggaccatggctatggctattcagttgaaatccgtgagcgaacaaagctgatagacaaggctgtagaactgggctgcaacctttttcgacactgccccccatttacggatttgaaaacgaagaactgctgggtgttgcgctcagcaaacacagggacaacccgtccggcgtctgtcagagagcaactggaaggttcactcagtcgcctgcaaaccgaccatatcgacctgttttatcagcatcgtgtcgatccaaaagttgagccggaagtggtggcgggattaatgaaagagctgatcgcggagggaaaaataaagtactggggcttatccaatgcgcccgtatcttacatacgccgggctcatgccgtctgcccagtcaccgcggttgaagaccagtattcaatgatgtggcgtaaacctgagcaggatttgttcaaagtctgcgatgaacttgatattggctttatggcctacagcccgctgggtaatggattcctgagtggccaggtgaccgctgatacaacctacggggaaggcgattaccggggcatgatggggcgctttaaacctgaagtaatggaaaataaccaggcgctactggatttgattgctcaaatcgcggaaagaaacaacgcaacttcagcacaaattgttcttgcctgggagctggctcagaagccttacatcgtaccgatcccgggaacaacgaaattacaccggctcgaagagaattttcacgccgcaaatgttcagctcagtgacgctgaattaaatgatatcaatgaagctttatcccggcttgaaattgacgaaacattcttctga

SEQ ID NO: 19163 - DNA, 138 bp, Glycine max
  Peptide Sequence Number=SeqID_110848
atgcaaagaatagcaaaggtgccggaatacagggagatgaagcaagagaagattttggccttagcgcgcaaggtcgcgctaagtgggtactacaactttgattggtcctgcatgttggatcaagtggcctcagaataa

SEQ ID NO: 19164 - DNA, 402 bp, Glycine max
  Peptide Sequence Number=SeqID_110849
atggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattacgagggatatgaggcgattgcacagaggttggagcccctgctcaaccttaggatagtcactgcaggcacagagttatatgacattatgcaggactgcctgacgatcgcgagagggggacccagtgctgatgggacggtcagggctcgtcagagacgccgcacggaccattga

SEQ ID NO: 19165 - DNA, 162 bp, Glycine max
  Peptide Sequence Number=SeqID_110850
atggcctcctatggtgtggcatctcctctctctcttcctttctccattccactggcattcatcttccaagaagcaaaggaatccattgatgaagaagatcctaggcctacaagctccaatggagcttgcatcagcgactcaagtccccggcaatggcgctag

SEQ ID NO: 19166 - DNA, 535 bp, Glycine max
  Peptide Sequence Number=SeqID_110851
aggactacacgtcctcgccttgagaggagtacatgtgctccacttcagaggactacacgtcctccccttcagaggactacacgtcctcgccttcagaggacaacacgtcatcccctttagaggactacatgtcctcaccttaagagggttacatgtcctcgcctttagaggactacacatcctcgcctttagagggctatgcgcactcacctttagaggactacacgttctcaccttcagaggactacccgtcctcacctttagaggactacatgtcctcgccttcaaagggatacactccctcaccttcagagggttacacgtcctcaccatccgagggctacacgccgtcacctttagaggactacacgtcctcgccatcagagggctacacgccctcgacatcagagggctacacgccctcgtctttttagggctacacgtcctcaccttcagagggctacatgccctcaccatcaaaggactacacgtcctcgccttcaaaggactacacgttctcgccattaaaatttga

SEQ ID NO: 19167 - DNA, 351 bp, Glycine max
  Peptide Sequence Number=SeqID_110852
atggaggttgtcaaatggcaggctactactcgcacagtttggagacaagagtgccctaaggtagctaacaccaacgttgcctttgcagaagctataaggtcaaaccaccaactgtcttccaaggaagagaaaaaggacttggctggcaaggtggaaggcattacggtggagaggggcgagcttgccaaggcagccaagataaaggagcttgaagagaagctgataatgtacaagaaggaagccgggttcttcaccaaagtccttgacttgggtctttttgaccctttcaaggacgtgaaggatggtgttctgcttgacaaagaagaaattgctacgaaggaagaggagtga

SEQ ID NO: 19168 - DNA, 243 bp, Glycine max
  Peptide Sequence Number=SeqID_110853
atggggaataagggggaagtaaaaaaaagtggtaacccccaaaacaaaaattacaaattaagttttaaaaagctcatttggctagaggcttataagaacaaaatgcctaaatcatctcccaacatgcatgtgaagcaagaagtatcaacaagagtcaagccaaggctattgtgtaagcaatcaatggggcaaaacacaccgaataaaaaagatgatgatggctcaaattctcaccaagggtaa

SEQ ID NO: 19169 - DNA, 402 bp, Glycine max
  Peptide Sequence Number=SeqID_110854
atgttggggaagtttgggaggattgatggggacccggtgttgagagaaacgaggatatgggctacgtgggagtacgtgagctcagttggaggtgggctacaggggatgagtggtaccttggagatatgtcgcgggggtcaggagaccttggggacgtcaggtggggtgctattgcccaaaaccaagcttgaccaatcccgacccaacccgggtgtcgcaacctaccctttggcgggagggcgacgcgtgacttgcgggatgcgtgttccacggaaggaatacgcgcggagtcgccaccaacgtttatttgaggaaaacgtcggaaaaaccggaaaagacgcgatctacgaactttttagtgaaaggttcgggagttgtatttacgcgcggggaaggtattag

SEQ ID NO: 19170 - DNA, 113 bp, Glycine max
  Peptide Sequence Number=SeqID_110855
gtgtcgagggaaggaccccagagtatcaagaacctcgggatttgaggtcaaatccttttgaaaggggaggggatgatgcaatcctacccccccccccccccccccccccatag

SEQ ID NO: 19171 - DNA, 356 bp, Glycine max
  Peptide Sequence Number=SeqID_110856
gagcaggtaatcacagactagttggggaaacaagcaggacatcgtgtcgtaccaacaacaaaaagctctcgtcctatcccactagtagctttgaggatctgctataccccccccatctgttcccacatcacgttcgtatcgcttctaccattgcgctctttcttcttcgggcatgttcggctgacctttggggcaccgtcgttctcgatccggggctgctaataagcatttggcatcttctacttgcccgtgcttccactacgaccggaaacgactggactcatcacccccttgctatcgagagcatttcatggtgtaccgagctggggactgaagaaactgtacgcgttcactga

SEQ ID NO: 19172 - DNA, 231 bp, Glycine max
  Peptide Sequence Number=SeqID_110857
atgtgggtgcaagccattggtctgtttgctcaagcgacctgtgctcctgagttcggacttccaagaccgttcaatcagagattactcgtcttgcacgttgggggggttgccgtaaaacaacaaagggataaccccttcccttgtgttcaggaatcctctacaacaagagacccacggtctcttaatcccttttcagaaataagaagaagagaagaagaggtctctccgtaa

SEQ ID NO: 19173 - DNA, 201 bp, Glycine max
  Peptide Sequence Number=SeqID_110858
atgaaaattctaagttcgggagttgtatttacgtttgaggaagtcgacaaaagcggggctcttgctcctacgtaccctccatcgaagaggaaatcagacctacgtagttctttcttaagggtgaatcacacgatttctttttacttgaaaggtgatcatttaaaggtgttggaccttaaaaatgatccattaacttggtaa

SEQ ID NO: 19174 - DNA, 678 bp, Glycine max
  Peptide Sequence Number=SeqID_110859
atgcctctatcagcagcagctgacagcttggcggtggattgcgacgaagaagaccgtgaagagcatacgtacaccgacgtacagggagcgcctggaccgactccggattccggatgtctgttggatcccgtatggggagcaccgaccggtctgagacttccatgtgatatcatgttattccggtctcttgcgctgggggcctgttgctgtttattatcgaccagagagggtcgcgcggcagtttgggatacacgcagaccattcccactcctcttgtcgattcatgggtgtcgtactgatgatatacacgatagtgactacatggactggttcttccacatctcgcatcctttcatgacaccaggccacacatcagatcctctgcctcatggtcacgccccacagtcccgagtcatccctcaggccccgcagacggatatctctcacgtgctgaagccaggagcatcatcgacatctgtggaggagcctaaacatgcagtggaaatttatgatgacattgttgagaggttggagcgccatctgagtcaaggggcggtcacgccagactcatcgacacatgaggtgatcgaagaacgcctcaggttggctaagagtgtgacacaggatcatctagtatatgttaggtctagacgcaggcggcgcacgaatcaggcatag

SEQ ID NO: 19175 - DNA, 189 bp, Glycine max
  Peptide Sequence Number=SeqID_110860
atgacagcagagactgacatagtcttctgcaccttttgttcatccagagcggcgggcaacaagcatttacgcggaaatttcatggtcacccgcgactctcgtcaaccgagaggagcgaaattagtgtcatacactgattttcggggacctttgcttgatgacatgcgaccattctttggtccttgtgag

SEQ ID NO: 19176 - DNA, 472 bp, Glycine max
  Peptide Sequence Number=SeqID_110861
gcttttcgtgttacagatagcaaaaaggaatgttaatacggataaccactcgggtatttccgccagtcagcgcgactcaaatgtcagtatgacagatcttgtgagcacggaagatgacgcttttcgtcttacagacatcaaaagaaagtttatacggataaccactcgggtatttccgcctgttagcatgactcaaatgtcaatagcaaaaaggaatgtttatacggataaccactcgggtatttccgcccgtcaacgtgactcaaatgtcagtatgatagatcttgtgagcgcggatgatgacgtaaatctcggcgtgttaatgggcttgtcggccgcgattgacaaagggcgcagaagacgagataaccatttgggtatttccgcccgtcagcgtgactataatgtcaatatgacagatcttgtgagcgcggaagatgacataaatctccgcgtgtcaccaagcttgtag

SEQ ID NO: 19177 - DNA, 144 bp, Glycine max
  Peptide Sequence Number=SeqID_110862
atgccaccccgattcccaagtggggaactggaacctaacaacgagggtttgacaatcgatttcgatcgtgatataagccccacggtaaacgaggaagaggaagaggacgtcctgtcaccagagttggagaggttggtcgcttag

SEQ ID NO: 19178 - DNA, 447 bp, Glycine max
  Peptide Sequence Number=SeqID_110863
atgggtgaagtagaggaggtgcaagagcagatgaaggccgacatggaggccatgaaagagaagatggccataatgatggaggccatgatgagtatgaagaagataatggaagccaatgcggttacagttgccgttactagcgctgttgctcaggtgaacccgatggccccatctgacctcaaccaaatgaatcatccaacctcagctatggtaggcaaagatttgggaagtaagggcggcccctattatgtgcaaattcaaaacaagcacgccttcccgccatatggcttgcctcccaacttacaccacccaatgtggtgtacactcccaatgagaatgttagtaactccgcttctatactcattgagagccaacaacctcaatctgatcatgcacatatctctcaacccatgggggagacacatgaaatgccccaccataatctag

SEQ ID NO: 19179 - DNA, 219 bp, Glycine max
  Peptide Sequence Number=SeqID_110864
atggctacctcaccaaaagaaacttcagctcctggttcaccctctgtaccatcatctccgcaccagggacaacctgaattcaacatccaacccatacaaataattcctggtcaagcccctgttcctgaaaaactggttcccagaagacaacagggagtgaagattgctgaaaaccctagccttgtaacaagtcctagggaagtaggtgggatcctctag

SEQ ID NO: 19180 - DNA, 147 bp, Glycine max
  Peptide Sequence Number=SeqID_110865
atgaatgttcattgcctagtcgctgttcatatgtcctccaccttcgagtttggagctatgcttcatgattgcctaagtgcggaccctcaagcgctgttcatgtgtcctccaccttcgagtttggagctatgcttcatgattgcctaa

SEQ ID NO: 19181 - DNA, 207 bp, Glycine max
  Peptide Sequence Number=SeqID_110866
atgataacaaccaagaagttgtacccacttcttgcaatgaacccaaaagcggttattcttttggatccagtgatcaaccaagaagcaaatccacttcttgcaatgaacccaaaagcggttagtcttttgagtccagtgtttaaccaagaagacctttttcttgaaaaacagtcaccaagagtaggtctcttgaaaagctttttgtaa

SEQ ID NO: 19182 - DNA, 249 bp, Glycine max
  Peptide Sequence Number=SeqID_110867
atggaagggttagtggacctagcagcgattgatgctttcctcgcctttcatcatggcaaggaaatcccggtcgtcgccattttggccaggcatgacacgttcgatcagagaggggaaaagagcggcgcaagaattgtttgttgtacaccggctctctatgtgtggctggtaggctcgtctatccgctacaaggtcaccgcctcgtgcgtcgaaaaaaagaaagacgaattgggaccaactcttggctag

SEQ ID NO: 19183 - DNA, 894 bp, Glycine max
  Peptide Sequence Number=SeqID_110868
agtggcaccaaccggatagagttgatgcgacaatttggaatgcaacaacctattccggagtctccttcgcaaccatggaatgtccacgggctaacactgaaaggcaaaatggatgaaaattggttccagctgttggccccatttatcagtcagtggaataatcgagctgagtttagggtcgacgtttatgctcgacaagagggcctattgagttttaactcggattacatgctgtggtataggcgcataacagaaatgtttatcgacccaaacaatgcaaacacggctacattgggtgaagttaccgagacattgcagtatatggtgtcaccacaagggcgaaacacatggacagttgatgatctcgtgccatatgtggaaaagttagcgattttatcccaagagcaagagaggatcactgagcctgtggcacatggtccagcatcagagcgtcgatttcccccacaacagtttcacatgcttcagtcaagtgttgaaactcgaggttttgacaaacgaagggagattgttcaagcggaagatttttcccaacatatggagcagcgtggccatggaatggggatgtatcggtatcctttcgaaggccatgacactgatatgtctgcaagcgaacattcgtttggtggtgttgcggaaacacaacctcatttttcatggcccaccatgaccccttcgcagcaacatgatgccccaatggcaacacctaataccccattaggtcagcaatgggatgtacccggagcaatccctaggctgaggaacaagggcggagacagcgcgcaagaagaaatccggatcgtcaagcccgaaggtgggatcgaccatgtggcacatcctcgcgccatcacggacaccacgatgactgattttgat

SEQ ID NO: 19184 - DNA, 464 bp, Glycine max
  Peptide Sequence Number=SeqID_110869
gtatgccgcctaccaggcatcctctagacccagataagtctaactgggccctggggtttccagtgttgatcatgggtctctgccagtcgtttggggttcccgtcacacctagcaaggccactgacgcaccgcccccacctcatcaggctgatccagctgggtcattcggcatggagcggtatttccagcacttggttcgccagcaagcggccaaccacagggggcaggtgcagatccatgagtgtctctaccagctcagcctcagtcagcagagccagggcttcgctccttttgcgtgccctactccagatcagtttagggatgaggtctcatggcccagagattggcccgaggaccagacagaggaggcacctgcaggagctcccgacggtgcagaggacgcccgcatggatgaggagatgacatatttactcgatttcttgggaggaagcgaagccacgtga

SEQ ID NO: 19185 - DNA, 144 bp, Glycine max
  Peptide Sequence Number=SeqID_110870
atgggattatcagcgacaatgcatcgccaaaagaggaaaactctagatgagggttcattgttatcaagcgagtcaacgacccaacatgactacagatcaacccccactccctatgactcacacagacccgggtatagggcctaa

SEQ ID NO: 19186 - DNA, 108 bp, Glycine max
  Peptide Sequence Number=SeqID_110871
atgagtcttcattcttcatctagtgttaatggtgagggttctactcctaaggacccctttggacttcccttgttagggaatgaaggattcatggggatcctccagtag

SEQ ID NO: 19187 - DNA, 315 bp, Glycine max
  Peptide Sequence Number=SeqID_110872
atgaattttgatgatgccaaagaagaatcaaacagggctgcttcaaaggatacgcattgcttcaagattaatacaatattgcttcaacaaacaaagtcttgcttcaagattactttaagatcaagccttgcctcaaaacaaagtgattccaagatatgcaaggctctagtaatcgattaccagacagttcgattaccagttgtttgtaatcgattaccagcaacgaaactcttgaaattcaaattcaaaagtcatgacccttcaaaatttaactgtgtaaccgattaccagaaacttgtaatcgcttaccagtga

SEQ ID NO: 19188 - DNA, 495 bp, Glycine max
  Peptide Sequence Number=SeqID_110873
atggctctagttaaggaattctatgctaatttatacaccacagaggaccaagctcctaagcaagccagagtaagaggacacctgatcaaaatagatgcagacaagctgaatgaatttcttcagactccggtggtgttaaaggagggggaatctttacccacctactttagattttgcaggttgaggactaaacaccaggagattgatgccaggctttgtattccccgcaagggaaaagatctaacagcactggcccagacctggagtgtcttctcttactccaacctagctcccacatcctacacctcagatttgaatatggatagagctaggttggtctatggcttggtgactaacatagacatgaacatcggagcccttatctcaggtcatatttcttctattgctcagagtaactcctctaggctcagatttccagccttgatcactgccgtatgcagagctagaggagttacttctgacaatctgacttag

SEQ ID NO: 19189 - DNA, 330 bp, Glycine max
  Peptide Sequence Number=SeqID_110874
ggatcgtgcccacaaaacacccagtggacccgaagaactccaatagggacctagggtttccagctctgattacgggcctctatcagttctacggagtgcccgtcgcccccagtaaggtcattaggccccctattaacagggctttcatcgaaaagtactacacccctaggcaggcgcagggcgaggcaccacagcagcctggggacggccagcagtgggcaatagacgcactggcaccacctcaagggtccacctcagctcatctacaaaggctggagtgttgcctacgacccgtggtcgaccagcaggcgaacaagtccaaagctaaag

SEQ ID NO: 19190 - DNA, 333 bp, Glycine max
  Peptide Sequence Number=SeqID_110875
atgacttccaagattattttgatgatgtcaaataatcaagagttaagcaagttccaaagaatcaggcttcaagaatcaaggtacatcctttgtggtacaagtagagggtacatctacttgggttgttatactgagaacaaaagagggtacatctcttgtggatcagttcaagtggagggtacatccacttggttgttcaaagataacaagggagggtacatcccttgtggatctttggcttgtaaaggattttacaaggttgaaagaaatctcaagaaccgttggttgcttggggactggatgaaggcacggattgtggccgaaccagtataa

SEQ ID NO: 19191 - DNA, 489 bp, Glycine max
  Peptide Sequence Number=SeqID_110876
atggcctgtggaggaagtgtcgagttggcagcccatgtcgctaacacggctgcgggaattgtcgttggcaagcgaggaaccgcaacaaccacgcgatcggaacttatggaggagtttgctaaggaaagcgatacaggacacgcgccttcggcggtaaaagtgctctcttgggaggaggcaaaagtcgtatcgcggtcttggctaaatgacgggctcaaggtaggcttcacaaatggatgtttcgacattcttcatgtgggtcacacttcaatcttggatttcgcaagatcccactgcgaccgcctgattgttggcgtaaacgcggacgcgtcgatacgcagattgaaagggccggagcgccctataaactctcaagatgatcgtgcgaacctgttgtctgcattggccgtggttgatgctgttgtgatctttgataacgataccccgaaagagcttctccactcttctcgagccgtcgttgcttgttaa

SEQ ID NO: 19192 - DNA, 291 bp, Glycine max
  Peptide Sequence Number=SeqID_110877
atgtcaggacttacacgcgattctcctcaaatttcagtcagcccgcatcaattagaccttgcaccttacgcttcagggccctacaatgctcaatggaacgccccggggcttctccatgacaagcacacgttgcgttcgagtcatattctcggagaaatggaggttgatgaaccttggctggggttatggcttctccatgacaccgaaatttggggtgaatcctacaggcttttttgctgcacaattcatttcttggttggtgttttggctcgtgctaaaggtggtgtttag

SEQ ID NO: 19193 - DNA, 252 bp, Glycine max
  Peptide Sequence Number=SeqID_110878
atgagtctcgcgtcgccctcccgccgaagggtaggttgcgacaaagggcatagtgcctcaacaggttatattaggaagaatggtaatagcattggaaaaatggtatgggttccaaaaggatcttttgtcaaaactaacattcaaggacccaagaaaaattgggactccttgaagcaaagttggtacattgatagtggttgctccaaacacatgacgggagatgcatcaaagtttagtcatatttctccctag

SEQ ID NO: 19194 - DNA, 459 bp, Glycine max
  Peptide Sequence Number=SeqID_110879
atgtcttcagaggttacttcctcgttgacatcttttgtcttgaatggaattgtcatgacaggtatgctagaagtagtgtctaatccttggaggtttatagtagggaactggttatgtgactcagatctggttagtcctactggaattgaacgggttctaaccgaaaaagaccttctagctgactcatattcagacctagaggcttatatccttgatgaaaaagaatttctcctattgaaggttatctctacctttccggagttatcttgcttaatatgctctatggttggagcgggtcagggaaaagacggtgtggccttatccataacccatctttcgggaagagttacttcatcccattttatttttctcgggagagaaacgttagcctttgtcatatccgtgataaacaaagttgtttctcctttccgaggttttaacaggactctagatgcacaa

SEQ ID NO: 19195 - DNA, 861 bp, Glycine max
  Peptide Sequence Number=SeqID_110880
ggtggacccttgggtactagtaccctcacctttcgaggactacacgtcctcaccttcagagggctgcacgccctcaccttcagagggctgcacaccctcgccttcagaggacaacacgtcctcgccttcagaggactacacgtcctctccattagaggaaaacacgtcctcgctttcaaaggactacacgtcctcgccattagaggactacacgtcctcgccatcagaggactacacgtcctcgccatcagagggctacacgccctcgccttcagagggctacgcggctacatgcacgccctcagaggactacgcgtcctcaccttcagagggctacatgccctcgccttcagagggctacacgccctcaccttcagaggactacacgccctcacctttagaggactacatgtcctcaccattagaggactacacgtcctcgccttcagagggctacacgccctcacctttagaggactacacgtcctcacctttagagggttacacgtcctcgccttcaaagggatgcacaccctctcctttaatgggcttcacgctgttgcttttagagggctggacgccctcgcctttaaagggtcctctgcccttaatgctcaaccgagacttgcgctccgggttacgggggccagtagtttccttttattagtgggagttcctgggccaccccctgatcctggaggagggccaactgtgcgagcacaactagaggaggaggctatcgtacaaccactatgcatactggggcaagatttcacccgtgcccgttacaaagagacgagtgcggaccatatgcaccaacatgaccactcttacacagatatggatgacgttgcgacttag

SEQ ID NO: 19196 - DNA, 501 bp, Glycine max
  Peptide Sequence Number=SeqID_110881
atgatagctttacttgccagccacgccacccttgccgccgacggtcaaatcacgttcgtcggcgcgatcgttgaaccctcctgtgaatatgccgtgacgcgcagcgtctcgctgaactgcacgcgcgaagggattaaaaagagcgaaaccctgcaggttaatggtgccgcgcgtgaattaccttacgcgctgggcatcgcgcacattacccgtgagcgtggtttgacttttctgcaggccggtgccgaccagcgcctgtacggtgctgccggaagcgccccgtacattttacgccatgaaaacctttctgattattgtcccggacggcggcatgctgttcgaggcggcgggtatcgccgacatcctgatgcacgccaacctgcacctgccggtgggcgtcgctggcgcacgctatcgcatcagcattgcgaccacgcagccgcaccaggtgatccacggccagtccggcctcaatctgctcgccgatctcaaactggctga

SEQ ID NO: 19197 - DNA, 255 bp, Glycine max
  Peptide Sequence Number=SeqID_110882
atgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgctgacgattggttcctgtgtgcctacctaccaaacggtattcgtgtggctagtcagacccattccatccaggcctctttgttgggggacgctggaggatttcaaagtcccacaacgtga

SEQ ID NO: 19198 - DNA, 161 bp, Glycine max
  Peptide Sequence Number=SeqID_110883
aacttgaagagattaatgaggaagctgaagatgataaggaagaaagaaaaagaaaaaaagttgaaaatgaaaaacaaaaagagaaagttgttgatgatgagatgaggagaggcaagagtgaggcatacactgaaaaagaagaaggatactactccaaatga

SEQ ID NO: 19199 - DNA, 255 bp, Glycine max
  Peptide Sequence Number=SeqID_110884
atgcccttttgcgggcgagcgaggcgaggctcacgggtgcgctttccaaaggaggaaagatgcgcggagttgccaccaacgtttatttgtggcaaacgtcggaaaaaccgaaggaaaccggtcaaaatgaaaattctaagttcgggagttgtatttacgtttgaggaagctcagctcgcccaggcgagcaaggttgcttcctccagaagcaaccgccttctggaggaagaaattggaaggcccaagtgggcctga

SEQ ID NO: 19200 - DNA, 501 bp, Glycine max
  Peptide Sequence Number=SeqID_110885
atggataaaggcctaattgaagtttatagcgcaagaaaaggggaaggggatgtgtgcatgcatttggttgataagagcccgggcaagcccaagccattggtgatccacttcactagggacgttgccacacagaagccccaaggtttccagcccgtcctggttacgaagcctacgcctttcccttacaaaagtgataaggtggtaccatggaagtacgccgcacaagggctcaacagaaggaaggacacatccgtcgtacttgttaaggatgatctatcctccactaaggtcaaaacatatccgatctttgcaccacccgaactaccagtgcgatccaaagacccaaaggggaaagcaaaggcggatgtggtagagagcgataaggcggacgaggtcctagttggaaggtttgccaaggaagaggacgacttcagaaaaaatggcatatccgctaaagaagcaactgagttcctaaaaatcatccaacagagcaagttcaag

SEQ ID NO: 19201 - DNA, 483 bp, Glycine max
  Peptide Sequence Number=SeqID_110886
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacgattatccgcacccttttgtcatccagaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccacaggcggcgggcccgatgacaagcagagaccaagtttggtcattctgcacccttgtatcatccagaggcggcgggcccgatgatacgcggagataccttacggttatccgcacccttttgtcatccaaaggcggtgggcccgatgactag

SEQ ID NO: 19202 - DNA, 480 bp, Glycine max
  Peptide Sequence Number=SeqID_110887
atgtggagagccataaaagaagcaaggcaactagtggaagggaatgggaggaaacaatatgccaaattaagatcaacacagtgccaagtccagaaggtccaccacaatttcagaggctatatatttgtcttgctggctgtaagaagggaatgggtggaatgtcatgagtggttgtcaatagaggcttataacaagacataccaacattttattgaaccagtccaaggaccacaatatttggccagacacagtatacacatcctgttcccaccacataaaagggtccaaagaggaaggcctaagaaaaatagaagtagatctgtagatgaggacaatgtcacaggacataggctaaagaggaaattggctgactttacatgtggaaggtgtggccaaacaaatcataacatcagaagctgtaaaaaatattggagttcctattatgccaaagaaatatgttgcaccaccaacttcaaatga

SEQ ID NO: 19203 - DNA, 177 bp, Glycine max
  Peptide Sequence Number=SeqID_110888
atggcccgcatgaaaaaaactggtcaaatgacatctgaggctgcaaaggaaattgcagacaggattatgagtaaaccaattttgttccgtctgttgacaacaggattccctggaggagtaggcctcacaaggaagctttgtcgtccatggatgtcaggatgtactgattgctactaa

SEQ ID NO: 19204 - DNA, 127 bp, Glycine max
  Peptide Sequence Number=SeqID_110889
agagataaatgaatcacacaaagacagtaaaaatggaggcttcaatcccttctccgtctctttgacgtttgggaactctatcggagcagttggaggaaaaactggaggaatctcagggaaccgctag

SEQ ID NO: 19205 - DNA, 502 bp, Glycine max
  Peptide Sequence Number=SeqID_110890
gtcgactctagaggatcccacatgtttaaccgagacttgtgctcccggtgaaggggccagtagtttccttttatcagttcctgggccatcccctgatattggagggcaaccaactgtgcgagcacatccagagaaggaggctatcacgcatctagaatcagactcacaaagacactcagtggacccaaagaagtccaacagggccctggggtttctagctctaggatcgcgcctgcaagacacccagtggacccgaagaagtccaatagggtcttggagttgtcaagctctaattacgggtctctgtcagttctacgaagtgcctgtcacctccagcaagggcatcaggccccctactaatcgagctttcatcaagaagtactgcgtccccaggcaggcgcagggcgaaacaccacagcagcctggggatggccggcagcgggcaacagacgcaccgccatcacctctagagttcacctcagctcatccacaaaaaggttag

SEQ ID NO: 19206 - DNA, 375 bp, Glycine max
  Peptide Sequence Number=SeqID_110891
atgatttacatctccctctttctcaagcaaattcttcttgatatcatcaaaatcttcatgatttacaaaagtgctaaagttgatgtctcgctaagcgagctcaatgcgcttagcgagtgtcatttgctaagcgaggcatcaacacgcttagcggataggaggaatctggaagggaatctgtcacgcaggcacgcgcttagtgtgtcatcagctcactcagcgagtcatttgtcacctttagggcttagcgcgagtttggcgctgtgcaaaagttcacttactcgcgctaagcgcaagaatggcgctaagcgcgacgtcgaggagcttccttgctatggaaggctaaaccctcagttggggattcttgctgagtaa

SEQ ID NO: 19207 - DNA, 60 bp, Glycine max
  Peptide Sequence Number=SeqID_110892
gctgaaatcgctggtgctggcagcttgaacatacaaactggtattaattactgggaattg

SEQ ID NO: 19208 - DNA, 336 bp, Glycine max
  Peptide Sequence Number=SeqID_110893
atgagggggactgggtttggctccatgttaggaaggaaagattccctacgggaaggaaatccaagcttagcccaagaggggatggaccttttcaggtcttggagaggatcaataataatgcctataggttggacctcccaagagagtgaagctgatatagaggaggaggaaccaacagatttgaggtcaaatcttcttcaagggggaggggatgatgcaatcctccctaggaaaggaccagttaccagagccatgagcaagaggctccaagaggattgggctagagttgataaagaaggccttagggttctcatgaaccttagggtagatttttga

SEQ ID NO: 19209 - DNA, 216 bp, Glycine max
  Peptide Sequence Number=SeqID_110894
atggagtatcagaagattcatgcttgccccaatgattgcatgctctacaggcatgaattccaagaatactgtcaatctgtctgtgggacttcacggtacaaagtgaaggatgaagaggaaaaaaaatgttctgatggaatgctgtattggacgctcccagtggcaagacgaagtgatggcttgggaatgagccaagaaatcaagatgctagcgtga

SEQ ID NO: 19210 - DNA, 180 bp, Glycine max
  Peptide Sequence Number=SeqID_110895
atgggtagaatcgtcttagacaacggtcagaggtcgagacaaggtcaaaggcagaaatcaatcaaggtacttatggacggacgcaaggagaggctagggtcacgaccaataggtcgtcatcctttgcctagcccgggacaagcggaaaacgccactgcaaggctgcctagtatcctttaa

SEQ ID NO: 19211 - DNA, 612 bp, Glycine max
  Peptide Sequence Number=SeqID_110896
atgggatcaagtcaaaagccttcgcttaaaaagaggttctatcaagtcaaaatcaagagcttagaggtcactagtttaggagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttaaagaaatcctgggatgcccactgggaggaaggaagccatatcttttctctgggttctatccctccacgacaagagttgccaaggtggtgaaaatctcagcacaagagttggaccgtgcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcggcgcaagaattgtttgttgtgcaccaactcttggctag

SEQ ID NO: 19212 - DNA, 705 bp, Glycine max
  Peptide Sequence Number=SeqID_110897
atgaatcacagcgataaacctaagcactttccaactcaaccctcggatctccaccttctcttcccttgttcgcgccacaccgaatcccttctcgcaactctccagtgcctcgccattcgcatcctcgccgccgccgtcgctcgacaaagcacgtttcccgaacgccatgaactgcttcgcgagatccgcatagtgctcgcacgtgccgaagaggaagctcttgctccggttcagcagcgccaccgccaggttcgggaccgagccaggttcagatcaagaagaagtttcctctctccggaggctgtgccatatctggccagtcttgtggtagaacgacgccgattttatcgccgtagagggaatgccgacgacgtcgccggcgatagagaggaggtccgcggcgatgtgccggagttcggcctggctttcggtggcggcggtggttgcggaggaggaggagcggatggcggtggtgttcgagatatcgacgcacgcgttccagaggcggtagctgagcttccaaatctgaagcttcaacaagttcggaaacggaacgagttgactcagctgagccaagcactgccggagatcggaggcagcagtctccggcgggggtttgtcggcggagcgagcttcgagctgtttaacgattgcttcaacttcagagaggctacggttgttagccaccgtgtctcggtggagtga

SEQ ID NO: 19213 - DNA, 891 bp, Glycine max
  Peptide Sequence Number=SeqID_110898
atggcaccaagcaaggaagaagaatccaattttgagtttgaagtggagtatcttaggacatcctttcaaactctacagactgcctgtgaagagctgcgacattgtagaatgttcatgaagcttctggaggctgtacttaaaactgggaaccgcatgaatgtggggaccaaccgcggggatgcagaggcattcaaacttgatactcttctcaaactggttgacgtcaaaggcgcagatgggaaaaccactctactgcattttgttgtacaggaaattatccaaactgaaggtgcttgtctctcgggcactaatcaaactccaagctctactttgagtggagatgccaagtgtaggaggcttggactacaagttgtatcaagcctgagttccgagctagcaaatgtgaagaaggcagcagctatggattctgaagttctcagcagtgatgtcttgaaactttccaaaggaattgctagcttagcagaggctgtgcaattaaaccaaaccatggcatcagatgaaagcagtcagaaattcacagaatcaatgaacaaattcatcagaatggctgaggaggaaattccaaaaattcaagcccaagaaagtgttgcttcctcccatgtgaaggagattacagagtattttcttgggaacttgacaaaggaagaagctcatccatttagaatattcatggttgtaagagacttcctagcagttcttgaccgggtctgcaaagaagttggaatgataaatgagagaactatggttagttcagctcataaattccctgtgccagttaaccctatgcttccgcaaccccttcctggattacatgagagacaacagtataatgactcttcagatgatgatagttcatcttcatcaccatag

SEQ ID NO: 19214 - DNA, 1377 bp, Glycine max
  Peptide Sequence Number=SeqID_110899
atggatttgaattcctctccttcgaacaacacaattgccgtgaatggaacaatccccgtcgcttccacgttcgccaaggccaccgcgccgttggagaaccctccgccggcgaacggctccagcaaccggaaacccatcgcattgtggccggggatgtaccattctccggtgacgacggctctgtgggaggctcggaccaagatttttgagcggcttctggaccctccgagggacgctcctccgcagagtgaattgctcaccagaaccccgtcgcagagcaggaccagcatcttgtacaacttctcctctgatttcgtgctcagggaacagtatagggatccctggaatgaagtccgaattgggaagttgctcgaagatcttgatgccctcgctggaactatttctgtcaagcattgttctgatgaagctagcacaacaaggccacttatagttgtcactgcttctgttgataagatcgtactaaagaagccaattagtgttaacattgatctcaagatagttggttctgttatatgggttgggcactcctcaatagagattcaactggaagttactcagtccaatgaagagggcaatgattcagactcagtagcactgacagccaacttcatattcgttgctcgagactcaaaaactgggaaagctgctccagtgaatcgactttcgccagaaactgctcatgaaaaacttctttttgtacaagctgaagcaagaagtaatttgagaaaaaggaaaagagaaggggaaaagagggactttgagaatggggagaaaaataggcttcaggccctattggctgaaggaagaatattctgtgacatgccagctttagctgatcgagacagcattcttctaaaggataccagccttgagaatgctttaatatgccagccacagcaaaggaatatccatggtcgaatatttggaggtttcttgatgcatcgtgcatttgaattggctttctccacagcatatgcctttgctggattagttccttgctttctagaagttgatcatgttgatttcctaagacctgaaagagagaggggaaagggagtattacaggttgatgtaggggactttttgcgtctcaaatcttgtgttctgtacacggaggttcacgatcctgatcagccacttatcaacgttgaagttgttgctcatgttacacgacctgagctacgtagtagtgaggtatcaaatactttccatttcactttcactgtccgtccagaagccaaggcgatgaaaaatggattcaaacttcgcaatgtagtaccagcaacagaagaagaagcatggcgtatattagagcgcatagatgctgacaacttgaatgaattcttcagaacataa

SEQ ID NO: 19215 - DNA, 723 bp, Glycine max
  Peptide Sequence Number=SeqID_110900
atgggtcgtcgccaaaacgactcagatttcggtagattcgcgattctcgtcctcttcttgataggcgcaatctcctgctccgtgatctaccttttccttacggtggtcttcagtcccagccctgaatctcttccttcagtggatgatcatgtggtgggggttgcagaagaggagcaatgctgcagagggattgaacatttggagctttggggtgatgctgtgaaatggggctctgaatttaggttgaattcctcggaggaatgttgcatggcttgtaagcgaatgtgtagcggtgatggaggaccttgtatgtgtaattcctgggtgtattgtggagatagagaggcttgtggacctagatttggtgagtgttggttaaaaaaacaaaaggatgccttaaatcctgatcgacgagactccggagatctagttatgtggacttctgggtttgtctttgataaggaagagggaactgttggtatggaaactgaccatggaattcttcgaataaaacttttgcctgaatgtgctccatattctgtttcctacatccttgagctgttggcgttgcctcattgtgttggttgccatattcatcgtgctgaaagccgaggaagcttttgggatacagaaggaaaccacataaaaaagataagaagagaaattacatcaagagtagttggttgtcaagttcccaacaaagaggatatagcttctgattga

SEQ ID NO: 19216 - DNA, 762 bp, Glycine max
  Peptide Sequence Number=SeqID_110901
atgtcgtcagagttggaggtagcatctgtataccttacggcagggcctagaaaaatcttatctatgggtcaaatgtcacctcttgcagtgccaaaagaaaaagatactatactaatactaatactcgagaaggttaaaatagcttatgacattcctatagtgacagatgtgcatgagtctatccagtgtgaagcagttggcagagtagcagatatcattcagattccagcattcttgtgtcgccaaacagatcttctagttgcagcagccaaaactgggaaaattatcaacattaagaagggccagttctgcgctccttctgtgatgacaaattcagctgaaaaggtccggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagaagttggatggaggaggtgtggcaagtggaggtcttcgagaactgataccttgcattgcaaggacagcagttgccgttggagtggatgggatcttcatggaggtgcatgatgatccactgaaagcacctgttgatggcccaacacagtggccgttgcgccactttaaggagctacttgaagagcttgtagccattgctaggataagcaaagggaagcaacggttcaacattgatctcacaccatttcgtgaataa

SEQ ID NO: 19217 - DNA, 1572 bp, Glycine max
  Peptide Sequence Number=SeqID_110902
atgggtgtggctcaaaacattcccgatgcggaggagggaaccttggagattggaatggaatacagaactgtgtctggagttgctgggccattggtcattcttgataaagttaagggacctaagtttcaagagattgttaatattcgcttgggagatggaactactcggcgtggacaagtgctagaagttgatggtgaaaaggctgttgttcaggattctgctgcaaatggttttgtctgtcttgttctatcttctgctgttgctattattgcaaacagtgggcttgtttatttaccatattgtaccattcaccaggtctttgagggtacatctgggattgacaataaatttacaactgtgcaatttaccggagaggtgttaaaaactccagtatcattggacatgcttggccgcatattcaatggttctggaaaaccaattgataatggtccacccatattacccgaggcttacttggacatatcaggaagttccatcaaccctagtgagagaacctatcctgaggagatgatacagacagggatatctaccattgatgtcatgaattctattgctagaggtcaaaagatccctctattctcagctgctggtctcccccataatgaaattgctgcacagatatgccgtcaggctggcttagtcaagcgactagaaaagtctgataatcttctcgagggtggaggagaagaggacaattttgccatcgtgtttgcagctatgggagttaacatggagactgcacagtttttcaaacgtgactttgaggagaatggctcgatggagagagtgacccttttccttaatctggcaaatgatcctacaattgagcgtatcatcactcctcgtattgctcttactactgctgaatatttggcatatgaatgtggcaagcatgttcttgtgatactcacagatatgagttcttatgctgatgctcttcgtgaggtatctgctgcccgagaagaagtacctggtagacgtgggtaccccggttacatgtatacagatcttgcaacaatatacgaacgtgctggaagaattgaggggcgaaaaggctctattacacaaattccaattctaaccatgcctaatgatgatattacacatccaactcctgatcttacaggatatattactgagggacagatatatattgacaggcagttgtataacaggcagatatatccaccaatcaatgtccttccatcattgtctcgtttgatgaagagtgccattggtgagggaatgacacgaaaggatcattccgatgtgtccaaccagctctatgcaaattatgccattggaaaggatgtccaggcaatgaaagctgtggtcggagaagaagcactttcatctgaggacctgctgtatttggaatttttggagaagtttgagaggaagtttgttgcccaaggagcttacgatacacgcaatatcttccagtcactagatcttgcatggactttgcttcggattttccctcgcgagcttcttcatcgtattcctgcaaagactcttgatcagttctacagccgagatgccggaaactga

SEQ ID NO: 19218 - DNA, 159 bp, Glycine max
  Peptide Sequence Number=SeqID_110903
atggatgatcaagtcacaagcttgaacgagctaagggtgagaagagacaatgtcctcgctgagtgggttggctgtgcgctaagcccgctgctctctggctcaacatcttctagggttttgcatttgtttagcgagttggctgcctcactaagcgaatga

SEQ ID NO: 19219 - DNA, 330 bp, Glycine max
  Peptide Sequence Number=SeqID_110904
atgattcaggtttccagtcatgcggttggaagcccttgtatcaattatccattaagcccagtcaaacctgaactgtctccttctgagatcttggtgtctacacttgttccaccactgtgcacaatatttgcactcactgttcctccttttcctcgtctagatctcaggaggaagaaagataaatatgtgatgatccaagatggtaatgagagttggattgatgagccaaatgcgttggaggaatattatattatgggtggggagggtgcttttccaaagcttgagagtgggaggtttgggatttgggaaaaagcattaatgtgttactag

SEQ ID NO: 19220 - DNA, 342 bp, Glycine max
  Peptide Sequence Number=SeqID_110905
atggaagtgactgagaaatatgatgtattcagttttggagttatttgtctagaaatcatcatggggaagcatccaggagatctcatttcttcattgttgtcttcatcttcagcaacaataactgataatttgttactaattgatgtgctagaccaaagacctcctcaacctctaaattcagttattggggatatcattttggttgcaagcttggcattttcttgcttgagtgaaaatccaagttctcggccaaccatggatcaagtgtctaaaaatcttatgatgggaaaatcacctttagcagaccagttccctatgattagacttggacaacttctctaa

SEQ ID NO: 19221 - DNA, 849 bp, Glycine max
  Peptide Sequence Number=SeqID_110906
atgaaaaaagcgaaaaaggaacgaacttcgctgaaatcagacatgattcgaagtaaagggaatgaaggaacgtactactcgggattcatttcgaaggaagaaagtggggactggggattcgccggagataggtccggtgtcggtgcttcaccttggatatcaggagaatcgcacgcacgaaggaatcgaaagacagcttcgctggcttcgcttgcacactcttcaccccaatttgcttgtttatccaaaaccatttctttggcctctgctgccagcatagttactgctcgtgatcaagctgcagctgagaagggtggcagcttgaatcaaatactaagaaatgatacagaagcagctgcatttgactgggaaaagagggtgaatgttgttaaagctcatgtctctgatttttggacagttaagattctgaagcctggttcacacacttggaccgagtttgcaggcacttttgggtatgcagctccagaacttgcccagactatggaagtgactgagaaatgtgatgtgttcagttttggcgtgctttctttggaagtcatcatggggaagcatccaggaaatttcatttcttcattgttatcttcaccttcagcaaaaatagcttataattggccactaattgatgttttagacgaaagacctcctcaacctccaaaaaaatcaattgttggggatgccattttggttgcaagcttggcagtttcttgcttgagtgaaactccaagttctcgtccaaccatggaagtgtctaaaatgcttatgacagggaaatcacctttagcagaccagttccctatgattagacttgggcaactcctgtatcactga

SEQ ID NO: 19222 - DNA, 294 bp, Glycine max
  Peptide Sequence Number=SeqID_110907
atggtgagtgaaaggggaattgggagggaaatttataggtgcgaaaaagaagcgttgagaatgggaatggtgcataactgcatttaccgtatagagtgggttgcctttatgatgagtgcaagtttgcatagagatagaattagaaagtgtgtgcgtgatgcatatcgagaaaaccttatagatcttcgttacgtagagccatttctgtatggacacgtttgcaaaacctccagccttgttgcgctaaggaaatttatggcaaatgtctcacatagaatatatattatattttaa

SEQ ID NO: 19223 - DNA, 1254 bp, Glycine max
  Peptide Sequence Number=SeqID_110908
atgaagcttacaataaaaacaccacaccctctcccttcaccccaatccaacaccctcctcaaacctcgctgcataacaacaaccacccaaacatccaaaccaaccagcaacaaaaacctacacatgtctaatgatacacgacaagccgcattacgtttagagaaaatgataaacttggaagaagaacataatactaacaattattttccgtccatgcaatcatcaaaacttggcaagaggtggaaggagtaccatggcatgagcaattgggaaggcttgctagacccattagacgacaacttacgtgctgaaatactaaggtacggtcatttcgtggaaaccgcgtacaaatcattcgagtttgacccctcctcacccaactttgcaaactcgaggttccccaaaaaagctcttttagaacgttgtggtttacctaaaacgcggtacaaggtgaccaaatacctacgtgcaacctcgggtattcagctacctagttgggtggacaaagtaccaagatgggtggcaaaacaaacgagctatgttggatacgtagcggtgtgtcatgacaaggaagaaatcaaaaggcttggtcggcgcgatgttgtggtggcatatagaggaaccaccacatgcttggaatggttggagaattttcgtgcatctctcaccaacctccctattccatgcagcagcaaaagggcatttgaaaaaaatggggtcatggacggaagtggggccatggtggaaagcgggttcttgagtctctacacctcctcacttcctgcaaaggtgtctttgcaggaaatggtgaggcgagagatctcaaggatcctcgacacctaccgcggggaacaactcagtctcaccgtcaccggccacagtctgggggcggcattggccacgctcacggcgtatgacgtcaaaaccgccttcccagaattgccggtgacagtcatctcctttggtgggccccgcgttggggaccggaggttccgacggcagcttgagaggcaagggaccaaggttttgcgcatagtgaactccgacgatgtcatcaccaagcttccagggtttgtgtttgatgatgacgtggctagcgctggaggggtacacgtggcaggatttccgagctggatacagaagagggtggaggaggcacagttagtgtacgcggaggttggaaggaactacggttatgtagcagggattctccgtaccttggaaacacgaatgttgccacgtgtcacgagctga

SEQ ID NO: 19224 - DNA, 2301 bp, Glycine max
  Peptide Sequence Number=SeqID_110909
atggagagggttgcagagccaaaggtacttcctcggtccttgcctgttctagttgaggtatccaatgcacacacggatgcaataagggaagctggtcaaagactaaatgggcaggatgtttcgagtgtgcgtggaattccaggaagggaagggaatcagtttttgaaagcgcgggatggccctatgaaacgtctggcctccatcagagaagtggcccagttatcaaatgcacgaatagttttggtaagagaggatatgggattcgatacacgctgtcaagagcctccctcccctgcgcctacaagaatgtggaaaggaaagggctctttaccggaagctgtagaacttgtgcctgatattgagaaattgaagggtggcaatgattcttttgtggaaactggtccaagttcatttgcaggtgctagtcatcccccagaacctgttgatactgatcttatgagaacggtttttgtaccaataggtcaaactaaatctgaagctggatgcttactgaagagtgtgtccttgaagggtcctttcttagaagatctttcaattcatgttcctgcaaagaaaccaagcctggctgttgtttctcctgcagaaagcatggttgaagaatcaaatgagatgggtaacttatcttcgccatttttaggagctcgtgcatcacagaatactgagaactctccccttgccccagattctgaggagaaagaatgtgtttgggatgcctcattgcctccaagtggcaatgtcagccctcatagcagtattgacagtactagtgttgtcagaacaatgagcattgctaatagttgtgcaagtacatatcgaagtgatgcagtcactagcgatggcatgcttagtttggacaggaattgtgatagcactaaaggaagtgtaagaggggattcacttgagagtgcaaaaactagtgctagtcgagcaagtgacagcagtggcctcagtgatgacagcaactggagtaacattactggcagtgccaacaagccccacaaaggaaatgatcctaggtggaaggctatccttgccatccgaacacgggatggaattttgggcatgagtcattttaggttactcaaacggcttggttgtggtgatattggaagtgtatatctctcagagttgagtgcaactcggtgcttttttgcaatgaaagttatggacaaggcatccttagcaagcagaaataagctgactagagcacagacagaaagagagatattgcagttgcttgaccatccatttctgcctactttgtatacacattttgaaactgacagattctgctgtttggtgatggaatactgtccagggggtgatctacacactttaaggcaaaggcaacctgggaaacatttctcagagtatgctgcacgcttttatgctgcagaggtcctgttggcacttgaatatcttcacatgcttggagttgtgtatcgagaccttaaacctgaaaacgtactggtccgagatgatggtcacataatgctctcagacttcgatctttctctccgatgtgctgtttcacctacccttattagaaattttgacagtgacccctcaaaacgaggtggtggtgcattctgtgtccagccagcatgtatcgagccttcatcagtatgcatccagccttcatgtttcatgccccggctctttgctcagaaaaataagaaatcacgaacgcctaaagcagaacctggcatgccgtccagcacgcttcctgagcttgttgccgaaccaacaacagctcggtcaatgtctttcgttggcactcacgaataccttgcccctgaaatcatcaaaggagaaggtcatggaagtgcagttgattggtggacatttggaattttcttgcacgagttactatatggtaaaactcctttcaaaggatcaggaaaccgtgcaacactgttcaacgtagtaggccagcagctcagatttcctgaatctccggccacgagttatgccagccgtgatctgatccggggcttgctggtgaaggagccgcagcaccgacttggggtgaagaggggcgcgaccgagatcaaacaacaccccttctttgaaggcgtgaactgggcgttgattaggtgcagcacaccacctgaagttccaagaccagttgaatgtgatctaccagcaaagtttgaaccagttgatactgttggggttggcaacatcaacaatagcaacaatagtagtaagaggatggtgggtaataataatactgacatgaagtctgggggtaaatatctggactttgagttcttttaa

SEQ ID NO: 19225 - DNA, 138 bp, Glycine max
  Peptide Sequence Number=SeqID_110910
atgggtactggtgtttggctatgtgatgttgatggtggttggaggtgggatatgccgcaatttgagtgtgtcgtggtggttggatttggtaaaaaacttgatatgggttatgttttgattagagatgaattcacataa

SEQ ID NO: 19226 - DNA, 337 bp, Glycine max
  Peptide Sequence Number=SeqID_110911
atggagcagttggtgaagcaagcctctgcttcccccaacgctaacgcactcacttccgttctcgttgaagccacttctcacctcaacctcttcgctttctcacaatttctcgccctccccaaccttctacagcttcaagtaactgagaattctgtttatcttgatatgcttcggttgtttgcacatggaacatggagtgattacaagattgccaccatcgtcgtcgttatgaccactgttgccatcaccaccatcgccaacgacggtcatgccaatagcagtagtgacaacagcgacggtgacgacgatcatgctaacggaggtggtgacagtcatg

SEQ ID NO: 19227 - DNA, 123 bp, Glycine max
  Peptide Sequence Number=SeqID_110912
atgtggggtgctgctttttcggtaagaatgttgaccagaaagaggaagggttttgaggaggtgcatttgcttgcttcacgtgatatgcttggaagcatcatcatcgcctcatcatggagatga

SEQ ID NO: 19228 - DNA, 1125 bp, Glycine max
  Peptide Sequence Number=SeqID_110913
atggctggaagtctcacactgtggactagaagggactacttcaattctcttcatgggaccttgcccatttcaatcagaatggttgacatgactaacaacatcatcagtggtgaaataccaccagagttaggatacttgtcatccttaaaattgaccaacaatcattcaccattaccacttcccgggattgatgtggacttttcctataataatttgaagggtcccatcccagatggtttccctgcgtcttcgctaataggcaacaaggatgtatgtagcgacaattggtatattcaaaccggactcaaattccagccttgtccagcccacgaccacatagtattgggcaatctgttggtcatagtacttcctgtacttatttctctaatcatggccttcttactgtgcctgaggcatattttccttgaaactaagaacaaagatacaaaggcaactgcaacgaccaagaatggggacttgttcagtatatggaactatgatggaagcatagcctatgaagacatcattagagcaatcgaagactttgacatgaaatattgtattggaacaggagcatatggaagtgtttacaaggcacaattaccaagtggcaaggttgttgctgtgaagaaactccatggctttgaagcagaggtgcctgcttttgacgagagtttcagaaatgagtacatggagaaaggaagcctgttttctgtcttgtttgatgatgtggaagcgatggaattggattggaaaaagaggcctagtgttggtgactttggcacagctcgattcctcagccttgattcatccaatcgaactatagttgctggaaccattggatacatagccccagagcttgcatatactatggttgtgagtgaaaagtgtgatgtgtatagctttggagtggtggcacttgaaactttgatgggatcgcatcctaaggaattactgtcttcacttcaatcagcttctactgataatggcatcaccttatgtgaaatattggaccaacgcctcccacagccaacaatgtcagttttactagacatagttcgtgttgccatagtggcatttgcgtgcttaaatcccaatcctagctctcgcccaacaatgaaatga

SEQ ID NO: 19229 - DNA, 578 bp, Glycine max
  Peptide Sequence Number=SeqID_110914
gtacacaaataaggcttaagacatgccatggccaatatttgcgtgccaatggaggcttaccaccttggaggaactctatcacccatgacatcccacatagaacatcaacatcaaattgggttctatgggaggtggaccttgtagagcttcgaccaaaccctcccaacccaatagaaaacactacacctattgccacacccaatccttcaatggattctaccgaattggattctcctacatattcagatgatgtctcctttaatatagatctcaagtcttctaaagtaccaattgagaatgaggatttaaaggagaatgagtcacccaaaaaagatggaagggttatattttataatataggtgatgaaaatggagatgttcctagtgcaaatgaagaaaagttctttacattcaaaggaagtagcgtggaagatttgaaggaaaagttaaaagaagaaacagggcatgatgatattcttgtgtgttgtcgcaacccattgaatgcaaaactttatccccttcgtttacaattacctcctaacaatactgacatacacgttgtggttactccttcttaa

SEQ ID NO: 19230 - DNA, 591 bp, Glycine max
  Peptide Sequence Number=SeqID_110915
atggcaagaagtgcaaataaggttacctttatcttcttggttgcttttgccattactattccatgccttgaggcgggcattgctgagtttgacgattttctgaaagcacaagctagtgaggcccaagtgatcgctcttaaatcctaccaacctgaccctataaacgttacagccgagttcaatatccatgttcatagggcattaatggaggaagaaaatgatacaaggagggaactaaagcagaaataccatggaccatgcatggccacgaatccaatcgatagttgttggcggtgtaggaaacattgggcacaagaccgttttagggaaaccggttcatcgcgcccaacaacaacgctgcaaaggaaatcccacaggcactatgcttcacctgaagtgtggagcaaatggcagtggaaatcagagaacgacctcttcataaatggggctacttttcttcagtcaggagcacctcttgggaagcttcctttcaacaaagggctcatgatgaaacctagacctggggcagaagccagcaggctcacacgctttgctggtaccctaaattgcaagctgggtaagccttgctaa

SEQ ID NO: 19231 - DNA, 555 bp, Glycine max
  Peptide Sequence Number=SeqID_110916
atggttccctcatgtttggggaatcattctagccaatttctacaatttttggtgttgaaaggaaaccaattgattggccccattcctcaaacatatacgataacaaatgctctgagaataatagatttaagcaataacaatcttccgggtcaattgccaagagcattggtcaactgtagaatgctagaggtatttgagctttcaaaccttcaagcattggatctttctctcaacagtttatcagggaagattccccaacaattggaagaattaacctttctgtcgtacttgaatgtgtcacttaacaacctctcaggtcctatacctcaaaataagcagtttgctacattcgagggctgttcatttgagggtaatcaaggactgtgtgggaatcaattgttcaagaaatgtgaggatgatgcaggctcaccttttgctccaccttcagcaactgaagatgatcatgactcgggattttacattgaatttgattggacagtggttctgattggatatggggtggactttgataacgctaaatttaggtttaattga

SEQ ID NO: 19232 - DNA, 948 bp, Glycine max
  Peptide Sequence Number=SeqID_110917
atggggttgggtttagcagaagggctaatccccacaacatgggaaaccgaggttcgaattcctgtttggagagagccttctccattgcataccacaacgattgtggagaagtgtactcttaagctggttgatgattacaagaacatgttatgccaagccacggaacccttgtcaacctttttagagtatatcacatatggtcacatgatagacaatgttgttttgattgttactggcaccttgcatgagagagatgttcaagaattactagaaaaatgccatccactcggcatgtttgacagtattgctactctggctgttgctcagaatatgcgggagctttacaggctggttcttgttgacactcctctggctccatacttctctgagtgcattacatcagaggacttggatgatatgaacattgaaataatgaggaacactctttacaaggcataccttgaagacttctatagattttgtcagaaacttggtggtgccacagctgagataatgtctgaccttctagcttttgaggctgatagaagggctgtgaatattaccataaatagcattggtactgagcttaccagagatgaccgtagaaaattgtactctaattttggtttgctatacccatatggtcatgaggaacttgctgtctgcgaggacattgatcaggttcgtgctgttatggaaaaatatcccccctatcaatctatttttgctaagctatcatatggagagagccagatgcttgacaaggcattctacgaggaggaggtgaaaaggctttgcttggcttttgagcaacagtttcattatgctgtgttcttcgcatatatgaggttaagggaacaggagatcaggaacttaatgtggatttcagaatgtgttgctcagaatcagaagtccagagttcatgacagtgttgtcttcatattttag

SEQ ID NO: 19233 - DNA, 378 bp, Glycine max
  Peptide Sequence Number=SeqID_110918
atgggcagttatttttcttccatcagcgccaccgtggtcgaggcagagaatcctcacgtgagagcgttccactccgcggagagctggcagacccacttcaaacagatcaaagactcccctaagctcctacatttcacggtgtcgtggtgccccccttgcaaattcatagctccgctatttaacgagatggccgcaatgtttaccgacgctgaattcatcaagatcgatgtcgacgaattatctgatgtggcgaaggagtttaaggtggaagcgatgccgacttttgtgttgtggaagaaagggaaggaagttgacagggttgtgggcgccgagaaggacgaactcaagaacaagattgagaaacattatcaattgtga

SEQ ID NO: 19234 - DNA, 4233 bp, Glycine max
  Peptide Sequence Number=SeqID_110919
atgggtgaggtgaaggaagaaaatgagagattgaagatgatgctggaaagagtagaaaaggactaccactcccttcaactccgtttctttgacatccatcacgaagatgtttcaaagaagggtttagctgattcttctacttgccatgatcatgaaactgaagagcttgtgtcactttgccttggaaggagtccaatggtgcctaagaaggaagcaagaattggaaactccaacaaactaaaagaagatgttggacccaaccttacacttggattagactccaaacaccttttgtcaatggaggttgtgtctgattttagtcccatgaacagctccgaacaaccaaaggaagcggaagaagaggtaacattgtcaacaaatcaatcagcaaaagtgataaatgtaaatgatgacatgtcagatcaaatgccagccaagagagccagggtatctgtgagagctagatgtgatactcccacgatgaatgatggatgccagtggaggaaatatggacagaagatagcaaagaggaatccttgtccaagggcatactatcgttgcacagttgcaccaacttgcccagtcaggaggcaggtgcaaaggtgtgctgaggacttgtccatcttaatcaccacatatgaaggaactcataaccaccctcttccagtttcagccacagccatggcttcaaccacttcagctgctgcttccatgctgttgtcaggttcttcaacatctcaccacccaacaaaccacaattctgcatcttttggaaatgctcctaccacactacaaagtggtctgagtttcagtcaccagtttgatgaatcaagaaccaaacaagttttctcacccccaaaccatgcttcactacacatgttcccaacaatcactctagacatgacttattcagcttctaattcctcctcattaactcaattccatcatcgcttaccttcaacaatggcatcaatttcaaacttaaaattttctccagctagtctcagctgttcacaagataataacttcataccctccatttggagtaaggggggtgacactacaacaccaccaataattgacaaaatccccactaggccagttatcaagggaaatccatatttccaagaaaatttctaccaacaaagcataacaaaccaaactcctttcaaagaagctttggcagaaacaataaccaaagcaatcagcacagacccgagtcttcgttcagtaatagctgctgcagtttcatcaatagtggggaatggatcaaacagtgggaaccaagaaggagcagagaatgttcttggttcagggttgaacttaaaacttggggatcatcttcaattggcttcatccaatcccttgaaccaaaatgggaaagggtgcttaacaggctacttcaaaagtcttggacaacaatcacaagactggttaaaccagggtggagatttgtacagccgaagatatgcttacaaagagcgtaagatcaaccccgaaacagcaccaaacctacgtttgaagtggaaattcaatgcaggcaaagatatcactgcaacaccagccatatataatggcaccctttattttccaagctggaatggtaacatctatgcggttaaagaaggcaatggatcgcttgtttcgaagcaggacttgcagaatctgacaggactaaatgcaactggctttgttcgatctcaattctatgatccttctgttgttattgctgtcaaaagaacaagtggtgagcttgtgaggaagaccactttggataaccatcctgcagcacttatcactgtctgggacatattacatcgggacatattcacctctacagaaaagacagaaaattggttaaaccatggtgggaatatatacaacagaagatatgccagcatggagcacaagatcagcgttgaaactgtttcgaacctaagtttgaagtggaagttctatgctgggaaagacataactgcaactccagctattttcgatggcacactctactttccatgttggaatggggatattttcgcagtaagagcaaaagatgggtcgctggtgtggaagcagaacttggggaatttaacggggctaagtgcaacggggtttgtggcaggtgttaactggacagtggctagggcaacaccaacaatagcagaggttgaccttctgatttttggaatatatggtcctgcagttgttattgctgtgaaaagatcaacaggagacttagtttggcagacacctttggacagccataactccagtgttgtcaccatgtctggaacttactacaaaggggcttattatgttggggcatcttcactagaagaactcactaccgaagaatgttgcacctttcggggaagcttctcaaagctagatattcaatctggtgtcattttgtggcaaaccttcatgctgcctgataatcatggacaaagaggagaatatgctggagcagctgtatggggaagtagcccttctattgatgcatcaaggaatcatatatacattgccactggaaacttgtattctgcccctttggacatacttgaatgtcaagaaagagagaataatgtaacacaacccactcaccccgatgagtgtgttgaaccagacaatcactctgattcaatccttgcacttgacttggacgatggaaaaatcaaatggtaccgccaactgggaggatatgatgtgtggttcctttcatgcaacaatttgtcaacacctaattgtccacctggtcctaaccctgatgctgattttggggaggcaccaatgatgctcacaattgatgtaaatggaacaaaacaagatactgttgttgctgtacaaaagagtggttttgcttgggctttgcaccgcgacaacggcaatctcatctggtctacggaagctgggcctggtgggctagcaggaggtggaacttggggagcagcaactgacaaagaaagggtctacaccaacatcgctaattcggatggccagaacttcactcttaaaccatccaacaagactacaaccagtggagggtgggtagcaatggaagcaagtagtggcaagattttgtggtccatagccaaccctagtaatgccactgctaatggtcctgttactgtagctaacggcgttgtctttgcaggatccacaaatcaaaaagggcctatttacgcaattaacggcaagactggtaaaattgaatggtcttatgagactggatcgacagtgtatggtggcatgtcagtcagtgatggggcttattatgttgggacatcttcacaagaagaaggcctcccacctgaagaacgttgcacctttcgtggaagcttctcaaagctaaacattcaagctggtggcattttgtggcaaacctacatgatccctgataatcatggacaaaaaggagaatattctggagcggctgtgtggagaattagccctcccattgatgcatcaaggaaccatatatacattgccactggaaacttgtatactgccccttttgacatacttgaatgtcaagaaagagagaataatgtgacacaaccaactcatcctgatgagtgtgttgagtcagacaatcactccaattcaattgtggcgcttgacttggacgatggaagtatcaaatggtaccacccattgggaggatttggcaccaatgatgctcacaattcatgtcaatggaacaagatgttgttgctgtgcagaagagtggttttgcttgggctttgcaccgtgacgacgacaagctcatttggcctacggtcactcttagaccatccaacgagactacaactagtggagggtgggtggcaatggaagcatgtagtggaaagatcttgtggtacacagctaaccctagctagtaatgccaaagctaatggtcctattactgtagctaatgacattgtctttgtaggatccacaaatcaaaaaggacctatttatgcaattaacggtaagactggtaaaattgaatggtcatatgagactggatcgactgtgtatggtgacatgcccgtcagtgatgggtgtatatatttaggaaatggatataagataggcaatggagtgtttcttggaaatgtttttgctggaacttcactttttgccttgtgtctaagcaaaattctatggatagttgatacaactgatactgatgatcgcacaacagacacaggggtacaactagcagacgtaaaacaagcagaaacatag

SEQ ID NO: 19235 - DNA, 1416 bp, Glycine max
  Peptide Sequence Number=SeqID_110920
atggaacaccaaaaagaggagcaactagaaccagtgagtcctgtgggacaatacttcaacagctctgtgctatgcatatacatcattggagttttagaattcgaagttccaatagatgacttgcaaacatatgctcttcttaaagatgttttccttcccatcaatccacgcttctcctccatcatggtccaagataaagatggagagaaaagatggaagcaagttgatgtaaacttgacggaccatgtcaacatccccacattccccgaaggaaaaacagcggaatcttatgataaatattttcatgattatttatcaagcatagcaatggagcaattaccacaaagcagaccattatgggatattcacataatcaattaccttacaagtgatgcatccagcactataatatttaagcttcaccatgcacttggagatggctattctctcatgggtgctcttctttcttgtcttcaacgagccgatgacccttctcttcccttgtcctttccttctctcaaacaatctaaacaagaaccttcttccactaaaagcttttgcagaaaattttcttggatgtgttcctctgccttcaacactgtctcagattttggatggagtgtattgaagagtagcatcattagtgatgataaaacaccgataaggtttggagacgaaggagccgactatcaaccaatttccatatcaagcatgacattctccattgaccacatcagggacatcaaatcaaggctcggagtgacaataaatgatgtggtcactggaattgtcttctatggaactagattatatatgcaagatatggactccaaatcaaagaccgcacactccacagcattggtattactgaatacgagaaacgttgaaggttaccaatcgatcaatgatatgctaaatactaaagccacgggtccatgggggaacagaattaccttcttgcatgttccaataccgaaattaaatgaaacaagaactacaaaccctcttgaatttatttgggacacacataacataatcaagaggaagaaacaatctctaggagttgtactcaccgggacacttttgaagatagagggcaaattgaggggacaagaggcagtagctaaacgcattcgtggcacattgacaaaatcaagtgcagtgatttcaaacttggctggaccaatacaacaaatggctttagctaaccatcctgtgaaaggcttgtatttcacattggccggtggacctgaaagtctagtcatttcagttatgagctatatgggagtcctaagtgttaccctcaaaacggaaaaagacttcatagacgaacataaattgaagttgtgcatgcaaagtgcatttgagataattctccaagcagctatggaaattcctcaggaaaccaaaccttag

SEQ ID NO: 19236 - DNA, 81 bp, Glycine max
  Peptide Sequence Number=SeqID_110921
atggtgaatagattcgaagcaatggggatgatgctcaagtggtgctcgatcatcgttgttgttggcctgttcaaggtgtag

SEQ ID NO: 19237 - DNA, 249 bp, Glycine max
  Peptide Sequence Number=SeqID_110922
atgaagaaaaggcttgtgtttgatttgggttcaccaaaacccggttgggtcagagaaaaatttgatgacaaccctcactttaggtactatgaaattacacctccgacgacgacgatggcaagtgtggaaatgatgccacatgggtgtcatggtgattgcggtggggagggaggagaggaagaggcagtgttcgagggaacaagggcatttaatggaggaggctatgacagtcaaatagaaaaattatag

SEQ ID NO: 19238 - DNA, 313 bp, Glycine max
  Peptide Sequence Number=SeqID_110923
gaatcgagcatacctaatgaggagagttaaaattctgcgaagagatggaagtagaaggtgctccaacaactcgccggtgacgattgtgaggcaggtgaaatatgggaagtgctgcaggaatcttgcatgcagaattggaggacatgttgttgatggttgcacggagtttgtggccagtggcgctgaaggtacccgtgaagctatgacttgtgctacatgtggctgccataggaattttcatatgaaggaggagataactcaagtcctttgtgcctgctcttctcaccctactacccgtaccgttggagattga

SEQ ID NO: 19239 - DNA, 1284 bp, Glycine max
  Peptide Sequence Number=SeqID_110924
atgtcagaagaactttcctgcaaatcatccttggatgttcctttactaccgcagtggaatcaccatgaggagaaagccaatatagcctctcatcattctaccaaaaatactactgtatccctctttcgcacctgccttaatggactcaatgcaatatcaggtgttgggattctctcagttccatatgctcttgcatccggagggtggttaagcttgggtcttttgtttgctattgccactgcagcattttacacaggcacgttgatgaaaagatgcatggacaagaattcaaatataaaaacctaccctgatataggtgaacttgcatttggaaagacaggaaggctaataatatcagtgtccatgtacatggagctctacttagtttcagcagggttcttgattctagaaggcgataacttgagtaacttattccctattggggagattcagatagctggcttagcaattggtgggaagcaactgcttgtgatattggttacctttatcatcttgcccacagtttggttggataatttgagtatgctctcttatgtatctgcaagtggagtttttgcttctgctttcattatcctatcaatatcatggactgcaacatttgatggagttggttttcatcaaaagggaactcttgttaattggaatggtatccccacagctgttagcttatatgccttttgttattgtgcacatccagtcttccctactttgtataattccatgacaaacaaacaccagttctcttatgtcctgtttgcatgttttttgttaaccacggttggttatgcatctatggctataattggttacctaatgtatggctcacacgttgaatcacaggtcacattaaacctgccactagacaaagtaagctcaaaattagcaatatatactaccctggtcaatcccatatccaagtttgctttgatggtgacacctattaccgatgctttgaaagacttgctcccaagtacgtacaggaatagagtgaccagcatcttaggcagcactgtcttggtgatgagcactgccattgttgccctaactgttcctttctttggagatctaatgtctttggttggagcatttctaagtatcacggcttctatcctgcttccatgcttatgctacttgcagatttcaggcacatataagaaatatgggtatgaggttgtagccatagtagcaataataatagcaggtatagtaatgggaatatctggtacatacacctctatcatggatatagtacaccatgggtaa

SEQ ID NO: 19240 - DNA, 5382 bp, Glycine max
  Peptide Sequence Number=SeqID_110925
atggcttcaagagtgattttgcaaaagagaaggagcctcttcttcaaccctctatgtagtctacctactcgcattatttttggattctccagtgttgggcacgctcagccattggaatctagtgaattagaagatgatctagcagcttatgcagcttcaagatttatctcgcacagttcctttagagtatcaagttttggatttatatctgacaagatagagttagtttatctttcaagattggggtggttatccagatgtagccgtaatatttccacggcttcagctgatcaatctggattgactagcagttataagggaagtgaacaatcagctactatacagaaaaaggaagcttcaccagaggaatgcgatgaagctgttgaaggcttgagcaacataaaagcaaaagctaaggctaaacaaatgcaagaaccaaagaagagtgctgattctattttaaggaaattatggactaggattttaggaattggtccagctttcagaactataatgtcaatgagcagggatgactgggcaaagaagtttcatcattggtgggatgaatttaaatctacccttcaacactactggtttggtacaaaactactttgggctgatatcaggataagctccagattattgttgaaacttgccggtggaaagagtctttctagaagggagaggcagcaactcacaaggacaacagctgatattttcaggctagttccattcgctgtatttatcatagttccattcatggagttattgttgccagtattccttaaattgtttcccaacatgctgccttccactttccaggacaagatgaaagaacaggaggcattaaaaagaaggctaaatgcaagaatagaatatgccaagtttcttcaagatactgtaaaagaaatggcaaaggagattcagaattcacaaagtggagaaatgaagaagacagcagaagatcttgatgaatttatgaacaaggttggtgcttctaccattgctactagttgtgctctccagatcaagaatgatgataaactgattcaagttgagggtgtcgaatctctttcagaagcagagcttcgtcaagcttgtagagatcgaggattgcttggattactttcagtggaagaaatgcagcagcagcttagggactggctggatttgtctctcaaccattctgtgccatcttccctcttaattctttctagagcattttctgtttcaggaaaggtcagaccagaggaagctgttcaagctacactctcttctctgccagacgaggttgtagatactgttggggtgacaactttgccgtctgaagattctgtttcagaaaggaagaggaagttggaatatcttgaaatgcaagaggagctaatcaaggaggaggaaaagaaagaggagacagagcaggccaaaatggtagaatctgttgttggtagtgaagagagggcttcaagaaccaaacaaatacaaggagagtcggtgagcagggaacgtcaagagtttttgaggcttgttagaaaggagatggagctttatgatagtatggtagggaaagaaggtacagaagatgaacaggaagctaagaaggcctataaagctgcaaggaaggaaagtgatggtgctattgaggtggcaattggtgataaggtttcttcagcacttgttgacagggttgatactatgctccaaacacttgaaaaagaaattgatgatgttgatgctaaaattggagaccgctggcggttgctagacagggattatgatgggaaagtgacacctgaggaggttgtttctgctgctatgtatctgaaggacactctgggcaaagaaggaattcatgagtttatcagcaacctttccaaggatagtgatgggaaaatattggtggaagacattgccaaattgggcgcccagaaagaagaagccgatagagacgaactatgctcgactcactccgcgtttttccgatcgaacgacgccgttttggtgagttttagcttcgtttcgtttcccgacgcggactcattgcttgctttcgtttcccacgcgattgttggaggagtcgtgttgcgtttgttgaccgaggagtggggaatttgcgaagtgaagagggatgttttactctcagtttattttggccaagaaagggccacttgggactatatggatagctgcgcatttggagaggaagctccgcaagaaccaggtggcggataccgacattggcgtctccgtagccatcttctacttggtgtggtgaggatatattctaggaaggtgaattacctttttgatgactgcagtgaagccttgcttaagattaagcaagcttttcgttccacagcagttgatttgccacctgaagagtccactgcaccttaccattccatcaccttacctgagacttttgatcttgatgattttgagctaccagataatgacattcttcaaggtaactatgttgatcaccatgtcagtactagggagcagattacactgcaagattctatggagggtgtgatttacactacttcacagtttggcttggatgagcgctttggtgatggtgatgcttctcaaattgggttagaccttgatgaggttttgttaaatgacaaagctgctacttcggagcatgatggctttggtgctaatattcaaatgtctcatcaaaatgatgaaaagaaacaggagattgatgatttacccactgctgctgaactcagtgaatatgctgaaggtccatcaacccctggactggaagagccaaatttatttggaactcagatggatcagggcaataatgaagttgattatcataattcagcagatttaatatcattggaggccgcaccgaaagaatcgtcggatcaccaaagggagaatgatgtaattaattgctccttgcaaaataatgggaatcatatttcttttgatttgcatcatgaagataatgcctgcgatctggttgaaatgaatagcaaaaaagaggagcaggagcatttagcatgtcaggttgtgatgaaggatcaagaaaatttgatacctaatgatcattgcttaactttgttacccttggtggactcttccaataaagactacacagaatgtgaaggtgggatgatcaatgcttctgatgtagctgagaaggaggacttacaagatggagttttgatgaacaatgacccagtttctgctgctttggatcaaactattacaaattgtgttgtttctgctcctttgatgaacaatgaaaatgttgcttcttctggttgttctcatgttacttctgatcaagaggacctctcatgtaaaccgttgtctaacatggatggatcttggggtccaggatttgatggtcgtttggaggatggtaacacattatcaaagcatgaagttctgaatggcattgaaatttccaagagtgaggggcaattctgtccatttgacgatgctcgagtatccaatgttattagtcctctacgatcacctggtagacctgaagttgttgatgaggaagctcaggcctctcaagaactgaaggaagcagagactttaaaccatgtatctcttgaagctgtgcagcccgctgaatcaatccttcagccatgcacctcccatcttggccagccttctcggtcatttattgaagattttagcatttctttccgactaaatacaccaaggaactgcagcctgagaacacccccaaagccttttggcatctttcctattaccaaatcctctgaacatgccgggtcttctaaaggtgaaaaatgtcatgtaactgatgtttcaaatcctgctttaagttaccaagggactatagagccatctgtatttaaagaaacgcctgattcggggaaaacagatatgcaacttgagagtcagatatttagtgacaaagtagaaagtataaacaaatctgctgctgctgacatgccagagcctgaaaagttgctctcagcttaccagcatgatggtgaagcaaatcatttgctgatggcatctactcctgacaatcagggtgcaactgaaggccatacaggtgcggcaggagtaaaatgcatctctggtaaaaaacgtagctacacagaaagtactcttacagtgcagagtatggatttaattgaatcttacgggggagctcaatccaagagaactgctgagtctgttcctgatgatgatgatctattgtcatccatattagttggtagaaaatcttcagtcttgaaaatgaaacccagtcctgcagcccctgaaatagcatcaatgaagtgtgttcgttctgcttctgcaccacgtactagtgccttaaagaggaaggtgcatatggatgatatgatggtcttgcatggcgaaacagatactgaaattgatggagtggagggtaataatgaacctatggcagtccaactccaagaaaatgcagaagtacaacctacagaagtagtggagggtaataatgaacctatggcagtccaaccccaagaagatgcagaagtgcaacctactgaggtacctgttttgtctgagagtcatcagtctgaggttaacttgggatctcgtgatattgatgctcatgggcacatggatattatttctcatgtggaggagcttgacagttctcaaaatgttgaattgaacaatgtcagagcaaatattgaagtttctgaagcagggaattgctctgttggccctgggcatgaatcttcatccttaactgaagtcttcaaaaatgattttgccgcatcactgtctcgcgtggataaaaccaatgatcttgttgattctatccacacaaatatattgagcattccaaatgctgagaatttgaatacaatccctattctagaggatgactttgtggaggatcaaagtgataaaaatggagtaggtgctattgaatgtagcatggaaactggaacacaagttcaaacagatggcttggaagccaatgatttatatgcatccttggctattggttctaaagaaactgatgaatttactgatattcaagcttcctttaatggtgacctaccattagaggaaaatagaaacaacttgctagggcagttaaatgaggatcaaattgttgcttctggcatggagtgtgatggcaaggatgcaaggtctgactgcatatttattgaaaatgctaaagtagattgtttacaatctgaagcacttggtttagatgaaaaagagagttcattgaaagatgcagaaatcccagtctgtcaggaagctggactacaaattacaatgtgccctgaaattaggagtccttttgtggatcagaatgatgagtcgaaattgaattttgaaagtggtgttcttcatacatcattctttgcactttcttag

SEQ ID NO: 19241 - DNA, 2115 bp, Glycine max
  Peptide Sequence Number=SeqID_110926
atggggtctatgaatttgttaggtttttctctctctcctcacgaagaacacccttctagtcaagatcactctcaaacgacaccttctcgttttagcttcaaccctgatggatcaatctcaagcactgatgtagcaggaggctgctttgatctcacttctgactcaactcctcatttacttaaccttccttcttatggcatatacgaagcatttcacagaaacaatagtattaacaccactcaagattggaaggagaactacaacagccaaaatttgctattgggaacttcgtgcaataaacaaaacatgaaccaaaaccaacagcaacagccaaagcttgaaaacttcctcggtggacactcatttggcgaacatgagcaaacctacggtggtaactcagcctctacagattacatgtttcctgctcagccagtatcggctggtggtggtggtagtggtggtggcagtaacaataacaacaacagtaactccatagggttatccatgataaagacatggttgaggaaccaaccaccgaactcagaaaacatcaacaacaacaatgaaagtggtggcaatattagaagcagtgtgcagcaaactctatcactttccatgagtactggttcacaatcaagcacatcactgccccttctcactgctagtgtggataatggagagagttcttctgataacaaacaaccaaacacctcggctgcacttgattccacccaaaccggagccattgaaactgcacccagaaagtccattgacacttttggacagagaacttctatctaccgtggtgtaacaaggcataggtggacggggaggtacgaggctcacctgtgggataatagttgtagaagagagggacagactcgcaaaggaaggcaaggtggttatgataaagaagaaaaggcagctagagcctacgatttggcagcactaaaatactggggaacaaccacaacaacaaattttccaattagccactatgagaaagagttggaagaaatgaagcacatgactaggcaagagtacgttgcgtcattgagaaggaagagtagtgggttttctcgcggtgcatccatttatcgaggagtgacgagacaccaccaacatggaaggtggcaagcgaggattggaagagttgctggcaacaaggatctttacttgggaacttttagcacccaagaagaggcagcggaagcatatgatgtagcagcaatcaaattccgaggactaagtgctgttacaaactttgacatgagcagatatgacgtgaaaagcatacttgagagcaccactttgccaataggtggtgctgcaaagcgtttgaaggatatggagcaggttgaactgagtgtggataatggtcatagagcagatcaagtagatcatagtatcatcatgagttctcacctaactcaaggaatcaataacaactatgcaggagggggaacagcaactcatcataactggcacaatgctcatgcattccaccaacctcaaccttgcaccaccatgcactacccttatggacaaagaattaattggtgcaagcaagaacaacaagacaactctgatgcccctcactctttgtcttattcagatattcatcaacttcagctagggaacaatggaacacataacttctttcacacaaattcagggttgcaccctatgttgagcatggattctgcttccattgacaatagctcttcttctaactcggttgtttatgatggttatggaggtggtgggggctacaatgtgatgcctatgggaactactactgctgttgttgcaagtgatggtgatcaaaatccaagaagcaatcatggttttggtgataatgagataaaagcacttggttatgaaagtgtgtatggctctgcaactgattcttatcatgcacatgcaaggaacttgtattatcttactcaacagcaatcatcttctgttgatacagtgaaggctagtgcatatgatcaagggtctgcatgcaatacttgggttccaactgctattccaactcatgcacccagatcaactactagtatggctctctgccatggggctactacacccttctctttattgcatgaatag

SEQ ID NO: 19242 - DNA, 2535 bp, Glycine max
  Peptide Sequence Number=SeqID_110927
atggcagcgcctacggagataatcgacgtcgacgccgaaaactctcctactcctactactatttctcctcaagattcgaaatcgaatcgcgccaaaaccaccacgcgaaagcgcaagaaggttccgtcggtgctgcaaagcctaaagagcgccgaggagaagcaagcgcacatcgaaaccctcgagaaggaactcgacgcgctgttccgctactacaaagaagccatggctcagaaagtgcgcgtcgagctgagcctgtgcggtggttcacgaaacgtcgtcgtcgcggcgctgatggaggagagcgaccttccgctgtcgaagctcgtggacgaaattaacgacaagttgaacggagaagtaagtaacggcgcaatcgtgctggcggagcctgtgacctacgcgacggtgaagagtagcgtgttgtttgtgggacagagagtgacctacggcgtgtccaatgctgatgctgatgtattggaggaccatgccgagtcgtgtctctggtgctgggagactagggatttgaaattgatgccaaaatctgttcgaggagagcttggtgttcgacgcacttgccggagaaggatccatgagaggattatggctgtctctgaaatgatagcagctctgaaaaagcaagagagtcaaccagattacaatgatggcttaattaaggcatcagcaaaggtcaataaagcttttcctgaggcagatatccgcttgttagtggatggcttgttgcagaaaaacagtgaagacatggacaagaaaagagcaagccaagaaaataaattgctaattaagcagttggagagaaatagaaaagaggctgagaaagagaaagagaaagaaagcatgcacaatgaactgcaaagagaaacactgctcaatgaatcaaatttaaaattgtcacaagatgaggcaagaaatgatgagaaagcttctgaaaagaagaaacagcaaaagaaacaggtagatgaggcagaaaaggatcaacggcgtaaagagaaagcagaagctgaattaaaaaagaagcgtagtttacaaaagcaagcttcaattatggagcgctttctgaaaagaagtaaaaacagtccctctccatctgagaaggacaaagtttcaactaaatcaactgcatctgatttgttaagatgcaagaataaaagtttgtttgagtcagctacactttcaatggattgtactcttgcatcaagtagtgatgttatgctagaagatattcgcaagacacacttttcttcatggcgctctttaggacaattaattcgcttgaacagaaaacagagatggggcttacgtcagaaacctcggactaaagtttttaaggaacttaagctgagtgctattaaaactgcagttcatgatgttgagttggacatggagaaacatgtcaacagattgggagaatgtagttctgatatcagttcatgcccaatgaatgaagatagttctcctcctgataccaagaagtacagtcggggtagacaattattgcagtttgataaatctcacagacctgccttttatggtgtttggcccgcaaaaagtcatgttgttggagcacgccatcctttaaggaaggatccaagtctggattatgaagtcagcagtgatgaggaatgggaagaggaggaacctggtgaaagtctttctgattgtgataaagatgaagaggaatgtcaagaggaatgtacaaagtctgatgaagaaagtgaagatgggttctttgtacctgatggatatctctccgaggatgagggtgcacaagtggacagaatgcaaatagatgatgacattgagggggctgatagctcccctagctgtaagaatgacattgagatcgaggagttttgtgctttacttcggcagcagaaatatctaaataatttgacagagcatgctcttcggaaaaatcaacccttgattatatcaaatttgattaatgacaaggacctttcgtctgaccacaatattagtggtactcctaagctggagcagatgtgtttgcaagtcttgagtatgtacgtaattcctggcatctcatgtatagaaatatctgaggacaaaatgcaagacgaggaccaagaagtctgcctctctactggtaaaggtgttgctagtctaatatctggtgtagctgtcatacctgactcagacctacccataattgtgactactattcaaagttgttctcagggtatgaataaagttttggtgtctttgcaacagaagttcccttctgtatctaagtccttactgaagaataaagtgcgtgaagtatctgactatgttgataaccgtttgcaggtgaagaaagaagttctggataagcttggcttggcagttaaacctgaaaaaagtagcgtgggaccaaagagcattgctgcatttttttcaaaaaggtgcttgccgccaactggagaaggtgcgaaacctggtgaaacttcaccactgcccctcaaatcatcttttgccattgatgaacgaccgcaaagttcatatgatatataa

SEQ ID NO: 19243 - DNA, 2775 bp, Glycine max
  Peptide Sequence Number=SeqID_110928
atggagttgtttgaaatattggaacttgaacatgatggttttgatgtgggtggtagcacttatgatgctctggtgagtgcttgtgttggtttgagatcaattagaggtgtcaagagggtgttcaattacatggttaatagtgggtttgagcctgatttgtatgtgatgaacagggtcttgtttgtgcatgtgaaatgtggcctcatgctcgatgcacgcaagctgtttgatgagatgccggagaaagatatggcttcatggatgaccatgatcggtggattcgtggactctgggaatttctctgaagcttttgggttgtttctgtgtatgtgggaggagtttaatgatggaagatctcgcacgtttaccaccatgattcgggcgtcggctggattgggtcttgttcaggtgggaaggcaaattcattcatgtgctttgaaaagaggggtcggcgatgatacttttgtgtcttgtgcgctgattgacatgtacagcaagtgtggtagcattgaagatgctcattgtgtttttgatcaaatgccagagaagaccactgtgggatggaactccattattgctagctatgcacttcatggttatagtgaggaagctcttagtttctactatgaaatgcgtgatagtggtgctaaaatagatcattttactatttcgattgtgataagaatttgcgcaagattggcatcattagaatatgcaaaacaagctcatgctgctttagttcgtcgcggttatgacacagatatagtggcaaacaccgcgcttgttgacttctatagcaaatggggcaggatggaagatgcctggcatgttttcaacaggatgcgccgcaagaatgtcatatcttggaatgcactgattgccggatatggtaatcacggtcaaggagaagaggctgtagaaatgtttgagcagatgcttcgagaagggatgattcctaaccatgtcacttttcttgctgtcttatctgcttgcagctattcaggattatcagaacgaggttgggagattttttactctatgagtagagatcacaaggttaagcccagagcaatgcattatgcatgtatggttgaactattaggtcgggaaggcttattagatgaggcttatgaactaattagaagtgctcctttcaaaccaacaacaaacatgtgggcaacattgctgacggcatgcagaatgcacgagaatttagaactgggaaagttagcagccgaaaatctttacgggatggagcctgaaaagctgtgtaattatatagtgcttctgaatctatacaacagttctggcaaattgaaggaagctgctggtgttttacagaccttaaagaggaagggtttaagaatgcttccagcttgtacctggattgaagtcaagaaacagtcatatgccttcctttgtggagataaatctcattcccaaacaaaggaaatatatgaaaaagtgaacaacatgatggttgagatatctaggcatggttatgttgaggagaataaagctttgcttcctgatgtggatgaagaggaacagcgcattctcaaataccatagtgaaaaattggctatagcttttggacttatcaacactccacattggacacctttgcaaattactcagggccatcgtgtgtgtggtgattgccatagtgcaattaagtttatagcaatggttacaggacgggaaattgtggtaagagatgctagcagatttcaccattttagagatgacataaaatcaggacatgcatatattggtggggaagaagggtacaggcaagatagtgacattcagaaggctaaggtctcaagggaggcactcacacagctctcaaaattggttgagtctcgagttactacaggggcagtaactgcatggaaattagttcttgctgggaggttttcactgcttcatccatggtgtgactttgttgaggtacagaaaaaacctagtatgcacaaatgctacatgggacatgagcataaggatgcagcacattctaaaagttgtagtatgcaacactttcacagaagtgttatctggagccagaaagttggttgtgggagccacccccaaaaccacaccaccttgatttggcaagttgagagtgtgggcctgtggggttgtccagaagctccactggcatgccatgagttggccggaaatgcagctgatagctttgggtcagatgctgatctattactttttattcagaagaatcaacggtacaacatctctgaggatacctggcaacaggttctagctttcagctggtgtacccgtgatagtctggaagcatatgatcctgaaggtgcttggcctgttttaatagatgattttgttgagcatatgtacaggatgcaaggatcgtattatgataattccaacttccattgtaactgtggtgatccagaatctcagtcatgtgtttttgatgaccccctccctggactgagaagtttttctggtctaaagaggaagttacccgaggacttgagcaaaagtgatgatatggattccaatgacatgattctttcaaattgtaaaagaagtagagctcatgatgcggtggatttggaggacaatccaccagggaatacagcagatgactgtatggaaaccagtagacaaaatagtccgttgtgttcatcgatgtccccatgtgcagttgaaggttgtctgtctaagggatttgcaggactactctcaactcgttcctttgtgcagtttggtagggagagaagggcttccttttga

SEQ ID NO: 19244 - DNA, 579 bp, Glycine max
  Peptide Sequence Number=SeqID_110929
atgtcaacctcgaaccagcaccagttccgatacactcaaaccccttccaaggtgctccaccttcgcaaccttccctgggaatgctccgaagaggaactcagagagctctgcaaacccttcggtaagatcatcaacaccaagtgcaatgtcggcgccaatcgcaaccaggcttttgtcgaattcgcggatctaaatcaagccatttcgatggtttcatattatgcttcatcttcagaaccagctatggttcgtggtaaaactgtttacattcagtattctaatagacatgaaattgtcaacaacaaaagccctggagatattcctggaaatgtcttgctggtaactattgaaggtgtggaagctggggatgtgagcattgatgttatccatttggtgttttctgcttttggctttgttcacaaaattgctacattcgaaaagactgcaggttttcaggctctgattcagttcactgatgctgagactgcttcttcagctcgggatgcactggatggaagaagtataccaaggcaaggcttactgaagcttggtagtcaggatacagttgacttgccatga

SEQ ID NO: 19245 - DNA, 1593 bp, Glycine max
  Peptide Sequence Number=SeqID_110930
caccattacgaaccttggaaccctcagacagattcacgctttaatgatcgttaacggtttcacttccaacgttggtttcctccgaaaactcgtcctcaccaccgccatgtcaatggtgggccccgctgcaaccaccgccgtgacacaatatgcagtccagatgttcgctcaaattccccaaccagacaccttcatgtggaacacctacatcagaggctcttctcagagccatgatcccgtgcacgcggttgcactgtatgcccagatgacccaccgttctgtgaagcctgataatttcactttccctcttgttctcaaggcttgcaccaagctcttctgggtcaacaccggttccgtggttcatggccgggtttttaggcttggtttcggttcaaatgtggttgtgaggaacacccttttagtttttcatgctaaatgtggagacttgaaggttgcaaatgatatttttgatgattcggataagggggatgtggttgcttggtctgcactcattgctgggtatgcccaaagaggggatttgagtgttgcgcggaaactctttgatgaaatgccaaagagagatttggtgtcgtggaatgtgatgatcacggcttacacaaaacatggggagatggagtgtgctaggaggctttttgatgaggctcctatgaaggatgttgttagttggaatgcaatggttggtggttatgtgcttcacaacttgaaccaggaggcattggagctgtttgatgagatgtgtgaagttggggagtgccctgatgagattggggagaaggtgcatgccaagatcatggagttgaacaaggggaagttgagcacacttttggggaatgctcttgttgatatgtacgccaagtgtggaaatattgggaaaggagtttgtgtgttttggttgataagagataaagacatggtctcgtggaactcggtcattggtgggttggcctttcatggccatgctgaggaatcacttggtctgtttagggaaatgcagaggactaaggtttgtccagatgagatcacctttgttggtgttttggcagcttgtagtcatactgggaatgttgatgagggtaatcgttatttttatctaatgaaaaataagtacaagattgagccaaatattaggcattgtgggtgtgtggtggacatgctagcgcgtgctggacttttgaaggaagcgtttgatttcatagcctccatgaagattgaacctaatgctattgtttggaggagtctgcttggagcttgcaaagtccatggagatgtggagttggcaaaacgagcaactgagcagttgcttagaatgagagttgaccaaagtggggactatgtattgctgtcaaatgtatatgcatcacatggtgaatgggatggggccgagaatgtaaggaagttaatggacgacaatggtgtgaccaaaactcgtggctctagctttgttgaggcatacaggattgagccaaatccagttaatggaaggactttgcttggagcttgcatagtttatggagatgtggagttggcaaaacgtgtgaatgaggagctgcttagattgagaagggatgagtg

SEQ ID NO: 19246 - DNA, 384 bp, Glycine max
  Peptide Sequence Number=SeqID_110931
atggaggattcattggagaattggatttcacagttggaaatggaggaatatgatgatgtgttgaatgaaagtcatcatggctcatttgatgagcaagagttcctaagagagatccttgaggagcagccagaaaacttgtcacctcaaagagaaaacatctgcagcaccagccccaccaacagcactgtgtcctttgatgaggcaattagctttaattatgcgagtggcagcactctccacaaaagcaacagctccaactccatcaagtctttgaaaagatcatcatcatcaagtgtctcaccagcctccaccaccacataccttctctcttttgatacctcaattgttgaaccaatcacacttaaaccttcccctaagcttgat

SEQ ID NO: 19247 - DNA, 731 bp, Glycine max
  Peptide Sequence Number=SeqID_110932
gttgcacactttgtggaggagctcataggtcaggcttatgtattcccactgaagaaacatctcatgaagttaattacatgggaaaccatcctagacaaaattttagtgcaggtggattttctggattgcaacatggccaaccttaccaacagcataatcaatggagaactcacgctggtaatcaacctttagtacaggtgaaggagtttgatgagaagcgcaacccttgcgctaagcgccctttccttcatgcactaagtgagctattgttcgtgctaaacgccttgacccctgatcattggctggatggtcctgctaagcgaattctggatttccagatgaacgcgttaagccaagctgtagcgctaagcacgttcatcttctctgttgagttatctgttgaactcgctaagggcggttgtgcgctaagcaagtactatggtgttgcaacctacccttcggcgggagggcgacgcaggactcacgggtgcgtcttccaagaaaggaaaatgcgcggagtcgccaccaacgtttattcaagaaaaacgtcagaaaaaccgaaaaagaacgttacggattgcgcaacaatgtttccattcgactttcggcatgttgcggaacttcacagattgcctaacgatgggtgttatgtaccttggggcggtcaagcgaaggtgcagaaaatgatgctcagtctttacgcgtcaatgggctcatttgcccctgattga

SEQ ID NO: 19248 - DNA, 946 bp, Glycine max
  Peptide Sequence Number=SeqID_110933
atgggatcaaatcaaacacctctgcttaagaaaaggttctatcaagtcaaaatcaaaagcttagaggttgccagtttgcgagaattggggcaattgatgggtcagctccaatgtcaagtcttccacaagacatatgggaagatttgggacctagctacaatagaagtctccgtggaagcaattgcctcccttactcaatattatgaccagcccctaaggtgcttcacgtttggggacttccagctagtaccaactgtggaagaatttgaagaaatcctgggatgtccgctcggaggaagaaagccatatctcttatcaaggttctatctctctatggcaagagtagcaaggggattagtggacctagcagcaattgatgccttccttgcttatcaccataccaaggaaagcccggtcatcgctattttggccgatgtctatgacatgttcgaccgaagatgctcacctgtctattacaaggtcacttcttatgcaccgagaaaggaaaggcgaactgggagatttccaaatgttcccttaatgggaacaaggggttgtatcaattacaatcccgtcctcgccataagacaacttggctaccccatgagaggagcgccatcggaggaaagcatcacacctttcattgcctggggtttcagtgaccccaatgcgagagtgcttcaagaagtccaaaaggcatggggtgcagtgcaaagtaaagataaggagcttagggggagcagcaacgggatcgccggtggctatcataagtggctgagagttcgaacgcaaaagttggattggctcccaaagctaaaagctgcaagagaggaagaggctgaaactctggaggagagtgaggaagtgcaaaccctaaaggcgaaacttgaaagagcccaagtagtcaaagagaattcaagtcaatggccatcaaagtctggacaga

SEQ ID NO: 19249 - DNA, 111 bp, Glycine max
  Peptide Sequence Number=SeqID_110934
atgaagaatattccagatttgggagttgtatttgcgtttgaggaaggtcgacaaaagcggggctcttgctcctacgtaccctccatcgagaagggaatcagacctacgtag

SEQ ID NO: 19250 - DNA, 489 bp, Glycine max
  Peptide Sequence Number=SeqID_110935
atgcatgctttgttagggtcattcaatagaggaaactggtttgactctaaagtccttgatagtgcagggctgagttatcgtgctttcacgaggaatcagggtgcaataaccgaaggagagcatcataaggacaattgttattattattctataaataattttgactggaaacaggaaccagtcatgtacgattaccatgagaaagaaagagctccggatcttgaaagtattttggcagacttcatgacgtaccaacgaattcaatttgaaaggaaccagtcttctgcaggttatcaatgggagtcattccggcaatctgagtatcaaaataaatcagaaggagttcttaatctggatgatctgttaatgcaattcaaagatatggtagaatcaatacaacaaacctttagaaggactgaaactcatattagtaagttgattgatgacatgactaatgttgcggccagaaaagaggaagagcatacatag

SEQ ID NO: 19251 - DNA, 323 bp, Glycine max
  Peptide Sequence Number=SeqID_110936
aaaagggagaagagagacaaaaggaattcaggcggttagtccttggcgaattctttttggcaaagggagaagggaatgaaaatgatgaatcgcacaagttttgttttcaagatgatgacaaaggtgatgacaaaaagctcaaaggtcaatcaaagaatgagttcaagatattcaagatagaatcaagaacacttcaagattcaagaggaaagttgatttcaagaatcaagaatcaagaatcaagattcaagattcaagattcaagaatcaagagaaggcttaatcaagataagtatgaaaaggttttctcaaaaattgagtag

SEQ ID NO: 19252 - DNA, 429 bp, Glycine max
  Peptide Sequence Number=SeqID_110937
gcatcgcctttgccgtctaccgtgaagcagacacgcaaagcctcacgtctacaatcgttgtctactagaccacctagtgctgagagaccggtggtccacattgatcctagtatcggcaaggccgatggtccccataggaagaaattaagaacatatttggggattgtggcgcgtgataaggtggacgtcacctatgagaactggaaggaggtccctattgctcagaaggacttgatttgggaggatattcgggcggaatttgaaatcctagaggcttctgacagtaggacgaaaaggaagttacttcagactgtcgatgagagatggaggcagtttaaatcagaactcatgaggaaatgggcccttgcagccgatcaagatggtgtggacgacactgtctgtgagaaatacgacataagcaaggaataa

SEQ ID NO: 19253 - DNA, 256 bp, Glycine max
  Peptide Sequence Number=SeqID_110938
atggctgatgccaagtttgcggggctgcttggtcttggcaagccgttggttgaaattttgccccccggtcaacttcgtggttttttgcccgttgttggcttggctagggtcggcggtgctgggttatggccccgtgctaagtttcggatggggtttgttggtgatttggaggggagggacgaatcaaagcgacaagggctgaatctcagtggatcgtggcagcaaggccactctgccacttacaataccccgtcgc

SEQ ID NO: 19254 - DNA, 297 bp, Glycine max
  Peptide Sequence Number=SeqID_110939
atgaccggcagactgcttgtcgggtcattgacatttgattgtcgcatcatgcattatatcattgttagaattttgatgcctcgttcttctaatcttgctcaagcctctgaggaggacttgattctgatgtgggctttcttgaccggtcatccaatcgactgggcccatttggttcgttaccgcatgcataaggcattgcggtctgttaaacgctcctttgctattggtgtcggtgcagtaacctcctttggctaccgtaaggacgtagatgggcagtggctgaagaaggacgcgtaa

SEQ ID NO: 19255 - DNA, 329 bp, Glycine max
  Peptide Sequence Number=SeqID_110940
gcttaacggtgaatgcagtggaagaatgggagtctcgagggctaaagcagataggggacgtgtcaacttccaggcggttcatattggaagcattgcgcgaagccgatgtaattgaccttgacggcaacaaaggagatctgtgcttaatgcatccaggggcgtcgcatgatgtggaaacatgcccaatagttgaggaactgctgcaggggatgataaatagggggcaaattgaaatccacagcgcaaagaaggaggaaggagagggacattaccacttagaggccctgaggcttccagcccttaacagcaaagacgcctacaccctgtga

SEQ ID NO: 19256 - DNA, 121 bp, Glycine max
  Peptide Sequence Number=SeqID_110941
atggcaggacatggtagggatcagaaccgtgatgtcctcaaccgcatcacaactgtgctggaaactctggtgcaggaatgtgatgtggagccggcggagtatcgaggactcatggctttcc

SEQ ID NO: 19257 - DNA, 51 bp, Glycine max
  Peptide Sequence Number=SeqID_110942
atggacacccgtctccgtgtgattggtgatcccatgaatgaagttcaacag

SEQ ID NO: 19258 - DNA, 228 bp, Glycine max
  Peptide Sequence Number=SeqID_110943
gtgaggacgtgtagtcctctgaaggcgagcgcgtgtagccctctgaaggcgagcgcgtgtagccctctgaaggcgaggacgtgtagtcctttgaaggtgaggatgtgtagtcctctgaaggcgagggcgtgtagccctctgaaggtgatggcgtgcagccctctgaaggagagggtgtgcagcccattcaaggcgagggtactagtacccaatggtccacccttttga

SEQ ID NO: 19259 - DNA, 363 bp, Glycine max
  Peptide Sequence Number=SeqID_110944
atgaatttcgttttcgtttatgtgtcctctaccttcgagtttggagccatgcgtagtgattacttagtgcaattctccattctcaatctttttcggagtcccatgaattgcgttttcgttcaagcgtcctccacccacgactttggagccatgcgtagtgattgcttactgcaattctccattctcaaccctttttcggagcccatgaattgcgttttcattcatgcatcctccacccacgagtttggagccatgcttagtgattgcttagtgcaattctccattctcaaccctttttcgaacccccatgaattgcgttttcgttcatgcctcctccacccacgagtttggagccatgcgtag

SEQ ID NO: 19260 - DNA, 525 bp, Glycine max
  Peptide Sequence Number=SeqID_110945
atgtcaggatttacacacgattctcctcaaatttcagccaacatcaattacccccttgcaccttacgcttcagagccctacaatgctcaatggaacgcccgagggcttctcgtgacaagcacacgttgcgttcgagtcgtattctcggagaaatggaggctttctcgctgcaaaattcatttattggttggtgttcttgggattgcctttgtggataactgggcggtgggtgtagctgggggtgatactgagggcgttccgaagtgttttcaaggggtataccaccaactgcttgcccttcagtggcatatccgagccaaggctcgaagtcggctagattgtgatggggaatttcatgtgtctcccccacggagtggagttattgacattcttattgggagtgtacgccacattgggtggcgtatagttgagaggcaagccatatggtgggaaggcgtgctcgttttgaatttgcacatcatgggggccgcccgtacttcccaaatctttgcctaccatatctga

SEQ ID NO: 19261 - DNA, 228 bp, Glycine max
  Peptide Sequence Number=SeqID_110946
atgaagattgcagaaatacaagtagtggggatgtctcctccacctctaagacttcacaatcactcacaaactcatctcaagctctcaggacggcttcctcttcaagctctggtctctacagatcttcacacaacaaaatctttcaaaatctctggaactttgacctttctctctctagaactctctagacatgtagaagcttcaagaaaaggccaaaatatcctctaa

SEQ ID NO: 19262 - DNA, 54 bp, Glycine max
  Peptide Sequence Number=SeqID_110947
cgctttttggcaagaactacgtaggtctgagttcttcatctcaattgaggatag

SEQ ID NO: 19263 - DNA, 376 bp, Glycine max
  Peptide Sequence Number=SeqID_110948
atggaagagccatcgaagaagagaaagggatcatcctccactactgctgctgctgcccatcgccgccacggcccatccggagcacccacagctcctattcatccttctttgtcatctccaggatcatcaacattgttttcatccgatgatcagcgtctatggtacctttctcagttttcttctagaataatcttagaccctaagtacctagacgtagaattctttaatgatgaaacgtttgattgctatcaagtgtttcaaaattctggtcttgttgatttcatgtcattaaaattgccatattatcctgaacttgtaaaggtcttctactgcaatttaaaaattcaggatgaccttattatttctgaggtgcctg

SEQ ID NO: 19264 - DNA, 198 bp, Glycine max
  Peptide Sequence Number=SeqID_110949
atgtcgcaacctacccttcgacgggagggcgaggcgaaaagcaaaaatgtgtcttcaaaagagaaaaagcatggagtcgccactagcgtctattcgaggaaaatgttagaaaaaccaaaaagagctcgcccaggtgagttgttgcttcaaactgaagtaaccttgctcacccaggcgagctggttacttcacccctaa

SEQ ID NO: 19265 - DNA, 662 bp, Glycine max
  Peptide Sequence Number=SeqID_110950
atgtcctcaccttgagagggctacacgtccttgccttaagaaggctgcacgtcctcgcctttagaggactacacgtgctcgacttcagagggctacatgttctcgcctttagagggctacacgccctcaccttcaagggactgcatgtcctcgcctttaaagggcttcacgtccacgccttcagagggcttcacgtcctcgccttcagagggctacgcatcctcggctttggaggacttcacatcctcgcattcagagggctacacgtcctcgcctttagagggctacacgtcctcgacttcataggactaggcgtcctcaactttagagggctacacatcctcgccttaagagggttgcacgtcctcaccttcagagggctacatgcccttgccttcagaggaccgcatgtcctcatcttcagaggactacacgccctcaccttcagaggactgcacatcctcgccttcagagggcttcacgtccttgcctttagagggctgcactccctcgccttcagagggcttcacatccttgcctttggagggctacacgtcctcgacttcagaggactgcacgtcttcgccttcataaggctccaggtcttcgtctttagagggctactcgtggcccaactgggattgtgcccacaagacacttag

SEQ ID NO: 19266 - DNA, 513 bp, Glycine max
  Peptide Sequence Number=SeqID_110951
atgggtttaagcaaagataacagcggcataactagcctgataaatgccaaaggaaatcgtgggaagtatggtttaggctataagcccactcaggcggatatgaagagaagcatcgcgggaaggaagagcggtggtcaaagctcgagttggagacaagaaagtgaaggaagcccgccctgtcacataagtagaagctttataagcgcgggtctgggagacaaaggtcaagtggtcgcgatatgcgaagataatgttccgagtacattggaggtggtacaaccatgccctcctgatttccagctgggaaattggcgagtggaggaacgccccggcatttacgcaatgagcataatatccgatgacgagtcccccgaaggtactaatacctgggacccgcttatcaacttcgagcaagaaacgaatcaaacggaagatgaagggaacgaggatgtgggacttcccccagaattagaaaggatggtcgcccataaggaccaaggtgggatcctctag

SEQ ID NO: 19267 - DNA, 438 bp, Glycine max
  Peptide Sequence Number=SeqID_110952
atgcttcagagcatcatcaaggatagatcatttacttcagagttacaagtggtggcgcctccaggatccattccttctgttgagcagtttatggagagggaacatgaaggtcccacaactcaggtaccacagcatgtaaaggatgggtcatctgaggccaccgttccagaaccattcactgtagaggaggaggcaggtgagacacaggttagacaggaagctactgctacttttgaaaggtcgcgagaagtcacatcatatccacccacacttgtggtggacctatcctcatctcaacatgcagtaaacccctccactcctatactcgagataccagaggacccgaccacaccaatcctgactctaaacacttctcctccagctactccagtacttcatctgacagatgaggaagatgctcaggcacaggatacttag

SEQ ID NO: 19268 - DNA, 640 bp, Glycine max
  Peptide Sequence Number=SeqID_110953
gtccgcaaggcatgggaggtggtacaaaaggaggacaaagagttcagaggcagtaacaatgggcccattggtggctaccatgagtggttgaaagcccacgtgcaagctttggattggctcccaagtctgagaaccgctaaaagggaggaagttgaggcaccgaaggaagacgaagaggtggctcgtagggaagaacatggctggaacaagttccgaggggctctgtggggcagtaacagcgagcttaagctctggaaggaggaaagggaccaatcgcgagaagacaatttgatcttgaaggatgagttgaaggcttgctttaggtccaagaaaagtttgtctcagcggttatgcgagacaaagaccaacatgttagccatcatcagcaagtaccaagaagaactaaatctagccacgacccacgagcatagagtggcagacgagtatgcccaagtgtacgcggaaaaggaggctagaggaagggtgatcgactcgctacatcaagaggcaacgatgtggatggaccgattcgctcttacctccaatgggagtcaagagattccccaattactagccaaggctaaagcgatggcagacacctactccgcccccgtggagatccacggacttctcagctatt

SEQ ID NO: 19269 - DNA, 378 bp, Glycine max
  Peptide Sequence Number=SeqID_110954
atggcttctaggaaaagaaaggcaccatctacacccacacaagttagatttgacagatcaagatttacttcccaagaggcttgggaaagatatacaaacattattgtgcctaggaagcttcagccagagaggaacatggtggtctattatacagagttcgatgagttcgaggaggaactcgaaagacaccactgggacgaggagttgactgactttggggatggcaacattgatgttgccattgtgaaggaattctacaccaacctctatgaccccgaggaaaaattgcctaagcaggtgagggtgagagaccccagttgttgtggaagagggggaatcactctgtgcttattccagatttgcactcctgaggcctga

SEQ ID NO: 19270 - DNA, 1414 bp, Glycine max
  Peptide Sequence Number=SeqID_110955
atgaacatagccgtaagtataaatatctacacatcggttgtgttacaagtagccatcaagcccttaattgatatgggcatagatgcagcggttttaatgtgtctaagagacattaggcataatcaatttgaagactccctaattggaacagtcgaaaccagcctaggacaaggtccaatatattttaactgttatccaaacaaaacagtgagtctgatggacataaacattcttgactctctgttcttaaacatccactttcatggccttgacatgaaagaaggatcaatcccagcagccttaatttataggatccagtacaaggtcatgaatacttgtgcatctagagtcctgttaaaacctcaaaaaggagaaacaaccttgtttatcactgatatgacaaaggctaacgtttctctcccgagaaaaataaaatgggatgaggtaactcttcccgaaagatgggttatggataaggcaacaccgtctattccccgacccgctccaaccatagaacatatcaagcaagataactccggaaaggtagagataaccttcaataggagaaattctttttcatcaaggatagaagcctctagaacccgttcaattccagtaggactaactagatctgagtcacacaaccagttccctactgtaaacctccaaggaatagacactacttctagcatacctagaacaacatacaaccaaaaacaagaggacgaccaaaagtcgatccaatccccaacatactcttctatggaacctgatgatgtatctgacaactttagcattgataaggaaacccttaggaaagatttttattctccggagaatgaacctcaaaggagatggtttttccaacattacaagggtacaaacagaaaacaaatccaagacaagttctacgaatttgtcgaacgagtcaaaattaatgtccatttctttgattggtttcatgcttatgccatcagaaatgatatagattacccttggaaacaagacatcataggtgatccaacaacaaatgtcataacaaattggcaagttaaggatggtgagttaatccaatcggaattacctcccgcaacacaatatcaactaccaaatatcaaagacagtaacaataaacctgtcatggcaattccattcaagacaaaagatgtcagcgaggaagtaacctctaaagacatcaagagcctaatggaacaggcaaattataccaataaatatttacaagctttaggagaaaccataaaaactaaggtagttcctaaacaaaaatcaattgaggaaacttcgccaagtatccccattgaaaaacctttattcaaacctttcaaagttagtgagaaggctaaacgaaaaattagggaacttagaaaaactaaatccttaattgaaggcgtag

SEQ ID NO: 19271 - DNA, 324 bp, Glycine max
  Peptide Sequence Number=SeqID_110956
atggtccatgacatctccgtcaaggtgaaactggaagtaacagggacatcgacagccctaaatgtgtttggcagtagacgaagaaatgatgtaacacgatccatcttttgccccaatttttgcaagatggttacttccatgcttcaacttgacttgatgaaccttttcgtaaaagcacgagcttggttcaaccccataacccagggaatggcaattttgattgccaatacttcaacaacatttcatagggatgagagactcgagaatacgcatgctacgcatggaaaatgggaaaacgcaagggtcacacatgagcaaacatga

SEQ ID NO: 19272 - DNA, 625 bp, Glycine max
  Peptide Sequence Number=SeqID_110957
gagcagactggccaggcgaggacaacctccacccggacctgacctactgggctccgccgcccgcgacccgcacaccgacggcggcttcgcggagcggatcacggtgcgcgccgagcaggtggtcccgctgcccgacggactggacacccgccgcgccgtgctcgccgaaccgctcggggtcgcgatccatgccgtgcaccgcgccggggacgtgaccggggcgcacgtgctcgtcagcggctgcgggcccgtggggctgctcacgatcctcgcggtgcgtgcggccggtgccgcgcgcgtcagcgccgtggacctctccccgctcgcgcgggagcgggcgctcgcgctcggggcggacgtcgccctcgacgcagcggagcagctcgggcaggacgtcaccgtcgccttcgaggcctccggcgccccggcctccctcgaggcgatcctgcgcgtggtcgcccgcgccgccgtggtggtccaggcgggcaacctgccgccggccccggtctccgtcgccctgggcccgatcgtctccaaggagatcgactaccgcggcacctaccgcttcgtgagcgagatcgaggaggcggtcgagctgctcgcccgctccgagctcgccgagggc

SEQ ID NO: 19273 - DNA, 531 bp, Glycine max
  Peptide Sequence Number=SeqID_110958
atggagaccgcgggatacggcccggccgtgcgctcccacgaggacttcgcccgcctcgccgtgcggcgcgggctcggccaccgggagcacgccctggaccccaccccgcaggccggccgcgatctcgcgcgcacggtcttcgccggcgcggaccggcccggcgcagacgggaccggcggccggcccgacgcagtggtcgccatgaacgacctcgccgtcgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggtgtggtggttacgcgcagcgtga

SEQ ID NO: 19274 - DNA, 334 bp, Glycine max
  Peptide Sequence Number=SeqID_110959
atggcgtggaacatcggcgacaacggtttcgagatggtgctgggcacgtatgtcccgcacatcatcgacgagcacatcaccggcgccctggcgccgctgctcgcccacgacccgtccctcgccgagcgcccgtaccgggagatcccgcactgggcgatccatcccggtggacgcagcatcctggacaaggtcgaggcgaagctggctctcgaggcggcgcagctggtccccgcccgcgagacgctgcgcgactacgggaacatgtccagcgcgacggtgctgttcgtgctgaaaggcgatcctcgaggccgcgcgaccgggggcggaggagcag

SEQ ID NO: 19275 - DNA, 378 bp, Glycine max
  Peptide Sequence Number=SeqID_110960
atggcgatcgaggaggtctggctctccgaggatctcttcccgggcctggcctccgaggatctcagcgggtccctctacgagctgctcgagacccgctacggcgtggccgtgtaccggcacgaccggcgcatctccgccatctccgtcgacgcggtccacgcggagctgctcgacatcgaggtgggcgccgccgcgctcttcgccacccagatcggcgtcgaccggcgggggcggcgcctcgagctgggccgctcgatctaccgcggcgaccggttcgacttcaccacggtcaccttcgccgccggccggcagggaccggcgccggggcgttcccacagaccagtgaacagcaggacgaacagggaggtacggccatga

SEQ ID NO: 19276 - DNA, 252 bp, Glycine max
  Peptide Sequence Number=SeqID_110961
atgagtgctagaggagcttgggagacctcgaagtacacgagtgcgatttcgggcaccattcgattcacggctacttctttgtgcatccagatgaacctgcacggacgcttcagcgcacggtggagtggacagctccttggattagctttgtgtatttttgaggggacgccacaactacaagccttaagtgaaaaccatgatatcaccatatccttaaggaattttggagctttggaattgttttgggaataa

SEQ ID NO: 19277 - DNA, 721 bp, Glycine max
  Peptide Sequence Number=SeqID_110962
tgctcgccgcgcccagcagcgcgtggtcgacgtccttgctgtaggcgtagcccttcgcctcggggtcggcggccttcgcggaggcgacggcggcgagcttcgcccatcgcgaccacggcgcccggacggggtcggccacctcgcgtcgcagcgcctcgagcgcgtcgaggtgccgacggaccgtgccggcggtcttcacgctgaacggcccctcgccggcctcggcgctgcgctgctccgcctcgagcgccgtgagcgccgcatcgagggcggacagccaggcgccgcgccggtcctcggcggcggcgggcggcagcgcggcctcgcggtagtcctcccacgcggcctctgccccttcgcgcagcgccgtctcgtccagcaggttggtgcgggcgcgggaggcgagctgccgcacgtgcgcgcgccacgacggggcagcgccgaagggcatctccggctcctcctcgccgtcgtgctcggtgcgggccagcagcgcggcggcgcgcgagccggccagcgcggcggtctcgtcgatcgcggcgcggaacgccgccttctgccggtcctcgtcgagcacctgcacgtccggcgagatgccggcgtcgagcgcgaactcgcgcagcagctccccggagacggagttgacggtgctgatcagggcgctgtccacaccgcgggcggcctcgagctggccgcgctcgagcagggtgcggcgcacccg

SEQ ID NO: 19278 - DNA, 525 bp, Glycine max
  Peptide Sequence Number=SeqID_110963
cgaggacttcgacagccgcatgagggcgagcacgaggcccaggccgaagccgatcgcaccggccgcggcggtgagccgcagcgtctccagcaggccgcggatgatcgattccgcgaagaaccactgcgccaccacgccccactcccagcgcgggttggtgacgaaggaatacagcaccacgagcaccgcgaggccgacgaggagcgcgagcaccagccggcccgggtgcttggccgggaccacgcgcaggtgggagaggtcctcggcgggcggctcaggggcgtgcgcggcgggcgccgacccgtcggcggcggaggcgtcagcggtcggcccgtcggccgatgcgtccgggcgggggcacgacatctcctgccgtcccgtcgccggggcgcggtcgagggccgcagcggcctccggggggcggcggtcggtctcgggggagacgacggaggaggtcatgaggtgccttccgtgacgggacgtgaaccggcgagcggtcctggcttgcaggagccgacgctataa

SEQ ID NO: 19279 - DNA, 947 bp, Glycine max
  Peptide Sequence Number=SeqID_110964
atggccgcggttgatggcgatggccatgcggtccagcgagttcacgtacagcagcgactctcccacctccacggcggcgaagctgtgcgcgtaggtgagctgggcggcgtggaccacggagccgtggtggtggatccgcacggtgacccggtcgccgtgggcgatgcccagctcgcggaagagggtgcgggggatcgaggtccacagcgagccgtagcgcacgtcgtgcgtgtcgatgatgcccctgacctgatcgccctcgcgctcgggcgggttcgcaggcagcctcaccagtgcggcccggtcgacgctcggaccgacggcctcgaagctggtcgcgccggaggcgaggcgcgcgccggtgaaggcgtagatgtcccggccgtggaaggtgtaggactcctcggagccggggcgacggttgcgggtctcgtcgatctcgcggatctcgtcgatgccgaagatcgcctcgagatgggtgagcgtgccgttgtcgggcgtgaccacgtagtgcccggtgctggtgcgggccacgatcgacagccgctcggtgcccaccccgggatcgaccacggagacgaagacggtcccctccggccaataggtcagcacctgggcgaggcggtaggagccctcccagatgtcgtagggcgggatgttgtgggtgacgtcgtggatccggagcgcgggatcgacgccgacggccacgccgtacatggcgctgaccgcgccgtcgtcgagaccgaaatcggactgcagcaccagggagctcatgggggaacgtcaggacatgcgagggcaacgctcggcaagagcaggcccggatcgccgccgctcaccagaatgcctctcaaacgcttgagcaccgtgggggccgaccacctcggccccggtgcgttacgaggagatcaagcttatcgataccgtcgacctcgagggggggcccg

SEQ ID NO: 19280 - DNA, 201 bp, Glycine max
  Peptide Sequence Number=SeqID_110965
atgatcgtgcgggtcctgtcaccccggcccgcagcgcagcagcgcccgcaggatcaccgggcccctgcaccgcagcgcgcggggacgcggaccggaccgttcctcccacctcggagagcatcgctgacctgcgatgaccatgcgacggaggttgcctatatcacgccggatgcggccccgtcaggcgtttgccggaagtga

SEQ ID NO: 19281 - DNA, 813 bp, Glycine max
  Peptide Sequence Number=SeqID_110966
ctcgcggtcgctgcgcagcacgatcgcgtcgggctggatgccgatcgagcgcagtgcggccacggagtgctgggtgggcttggtcttcagctcctgggaggggccgatgaagggcacgagggagacgtgcacgaagaacacgctgtcgcggccgaggtcctggcgcacctgccgggcagcctcgaggaagggctgcgactcgatgtcgcccacggtgccgccgatctcggtgatgacgacgtccacgtcgtccccggcctgggagcgcatcgactccttgatcgcgtcggtgatgtgggggatcacctgcaccgtgtcgccgaggtactcgccgcgccgctcccgggcgatcacggtggagtacacctgcccggtggtgacgttcgcgtgggcggtgaggtcctcgtcgaggaaccgctcgtagtggccgatgtccaggtcggtctcggcgccgtcctcggtgacgaacacctcgccgtgctggaaggggttcatggtgcccgggtccacgttgaggtacggatcgagcttctgcatcgtcacccgcaggccgcggctgcgcagcagcatgccgagcgaggaggcggtcagccccttgccgaggctcgagaccacgccgccggtgacgaagatgtgcttggtgatgcccgggttccggaagggcttgcccgcggcggccgcgccgatccgcggaatgggtccggtgcccggctgggaggtgttcgcgctggtatctgccacggactgtcaacctaccagccgcgggggtcggcggcgagcacctcatcgagctgggcgaggaggtcctgcgcg

SEQ ID NO: 19282 - DNA, 875 bp, Glycine max
  Peptide Sequence Number=SeqID_110967
ttgctgatcacgacgttgcgcacgccgccgctcatctcgctgccgatcaccacgccgccgtggccgcgcaccatcgtgcagccggtgatggtgacgttctcggtcgcgacgcggtccggggtgcgctccgtgccggccttgagcgcgatgcagtcgtcccccacgtcgatgtggcagtcgctgatgcgcacgttgcggcaggattccgggtcgatgccgtcggtgttcggcgactcggcggggttgtggatgtgcaggttcgtgagggtgacgtcctcgcagagggaggggtgcaccgtccaggccggcgagttgcgcagggcgacatcccggatcgtgacccgctcgcactcgtgcaggccgatcagggtgggacgcggatgggccagctcctcacggcgatggcggaaggtgtcccaccaagtctgcccgccgccgtcgatcgtgcccagcccggtgatcgccacgtcccgctcgccgtgcgcgtacaggcagggcgagtggacccggccgacggccccctcccagcgcgcctcgaccgcggggtacagcgccggatccggcacgaactgcagcagcgccccggcctcgaggtgcagctcgacgccgctgcgcaggcggagcgcaccggtgcggtgcacgccggcgggcacgctcacccggccgcctccggcggctgcggcctcgtcgagggcgcgctgccactgcgtcgtcgcgacggcggggtcgacgaggtcctgcgggggcgaggtgacggtcacggcggagcctttcggggcgggagggccgacgggcggcgaggggcggcagggcggggacggcgccgtctgcggtgccggatgcggcaccgtcccctgcggcggatcaggcgttga

SEQ ID NO: 19283 - DNA, 858 bp, Glycine max
  Peptide Sequence Number=SeqID_110968
atggcggtgcagagaggcggcggcctccgcgaaacagcgggtcccccggagcggcgagggcgttgtgccagccctgccagtcgatcatctctcggtgcccacgagctcggcgggcagctggccgccgaaccccgggagcaccaccgtcatcccgagctcccgctcgcgctcggcgatccgccgtcccagctccgcgcgggcctcgagcgcctcgtcggtgagcgcggcgccgaggtcatgggtgatgcccatcgtggtccagggcaggaaggcgggaccgccgacgaatcgcgccgccgcctcccgttccacgccgaggtcgcggagcatccggaccagcacgagatcgtgccccacgaggttcagcggatgggtcacgccgtgcagcgccatccagtcgatgtgctgttcccagcgctcccagtcccagaacgccatcgtgtacccgaaggtcacggggttgaggtggtaccggatctgcaggggagtctcgacacgctgcggggcacggtcccggagggaggcgggcacgtcgatgtgcggtgcggcgtcccaggagaggtccgccccgaggacgtcctcgaacgcgcgggcgagcccgacggcggcggccgaggggctgctggcctcgacgcgcagctcgccgccggagacgccgacggtgacgtggtcggtctcgacctctgccccggcccggcccgggccgctgctcccggcccgatcgggccggggcgccggcgcgagatggaactgcacccgctcggcgagccccggggcgcggcggcgcaccagctcccgcaccccgtcgaagcaggaggcggcgggggaggggacggtgtggtcacgggacacggctga

SEQ ID NO: 19284 - DNA, 327 bp, Glycine max
  Peptide Sequence Number=SeqID_110969
atgactgacaacacccaggccgagaccccggccgtcgaggagctcgcgaaggagggcgcccaggcgtcctccagcgagcgcccgtaccgcaagaccctgcgcggcttcgtggtctccgacaagatggacaagaccatcgtggtcgccgtcgaagagcgtgtgaagcacgcccgctacggcaaggtcacgacgaagacgagcaagttcaaggctcacgacgaggagaacaccgccggcatcggcgaccgtgtcctcgtcatggagacccgcccgacctccgcgaccaagcggtggcgtctggtggagatcctcgagcgcgccaagtga

SEQ ID NO: 19285 - DNA, 893 bp, Glycine max
  Peptide Sequence Number=SeqID_110970
atgtcgacgacgacgaagcgccagcggcgcggcgggatcgtccgctccgtgccgtcggcgcagatcacggagcgggcgcggccggcggcggagtcgtcgaagagccgccgctcgggcctcgagccgtcgccggccgggtcgttcactgcatcggacgtcgtcatcatcgacggtctcctctggtcaggactgcgaggtcggggcctgcgggatgccgtgcctccacacgcggtgggtgagcggcatgccgggccggtaggcgaggtggatcgcggcgggggcgtcgagcacgtgcagatcggcgcgggcgccgaccccgaggtggccgacgtcggtgcggcgcagcgcgagcgccccgccgcgggtggcggcgcggagcgcctcggcgagcgagaggtgcatctgcagcaccgcggtggtgacgcagaaggtcatcgcgctggtgtagctggtgccggggttgcagttgctggcgatcgcgagcatcgcgccggcgtccagcagctgccgggcgggggccaggggtgcgcgggtggagaggtcgcaggccggcagcgcggtcgcgaccgtcggcccggcgcccacggcgagccggcccgggccgtcgccgggcgcggtggggcgggaggcggtcgcggcgagcgcgtcgacgtcggccgggccgaggtggttcacgtggtccacgctcccggccccgagctcggcggcgagcgcgacgccgccgctgcggccgagctggttgccgtgcacccgcagcccgaggccggccgcggcgccggcgcgcagcacccgggcggactgggcggggtcgaagcgccctcctcgcagaacacgtcgatccagcgcacgtgcggggcgacggcggcgagcatctccccggagaccagctcgac

SEQ ID NO: 19286 - DNA, 833 bp, Glycine max
  Peptide Sequence Number=SeqID_110971
gccgcggaagaactcgatccaggtcaccgccacagctgagcagccggaaccgcgacatccgcgccagggcgagcagcagcccgaaggggaaggcgaccacggcggcgagcgccgtgaccttgagcgtcccccacagcccgtgcccgaggaaggcgaggtagtcggcgcggagatacaccacccacttgttcggatccagctggccgttcgcgtggaactgccacagcgcccccgccagcagcgcgaggatcgccacgacgctgaggatcgacagcagcaggatgcgacgccgccccttcgggccgggagcgtcgaagaggacctgggtggcggtggaggaagacgtggcagtgctcatgcgcgcatctcctcccgctcgttcctcgcagttcgtcgacccgcagtgctcatgcgcgcatctcctcccgctcgttcctcgcagttcgtcgacccgcagtgctcatgcctgtgctcctgccgtgacgtcgagcgtggcgcggtggcccgagcggccctcgccgcccggggcgaccgcccgctcgatgacgccgccgagcgcggcgccgccgagggagaggatcagatagaccgcaccggcgatgaggaacatcagcaccgcctgggcgtagcggatgttcagcgtctgggtgacccaggtgacctcctgcaccgcgatcgcggagcacagggcggagccgatcacggtgccgatgaacacgttgaccagcggctgcaccatcgagcggaacgcctgcggcagcaccacgaggcgcagcgtcccgaagaagcccaggccgatcgaccgggccgcctccgcatgcccgatcggcacg

SEQ ID NO: 19287 - DNA, 579 bp, Glycine max
  Peptide Sequence Number=SeqID_110972
atgcccagcgcgctgagggcctgttgtcggtccccgcgctcaggcagtaggggaggatccgcgagcccggatcctcctgctcgatcgcaccggcccatcgcgtcgaccaggggcgactcgcggggcgagtcgcaccgagacccccacgtggtccacgatcacctcgacgtactcgccgctgagctcgtcgagcagggccagcacctcctcctggtgcccgggcaggaagcggcagtcgaacccggcttccgccgtctgcgggatgacgttgaccttgtacccgctctcgagcatggtcagattcgccgagtcgcgcagggtgccggtgacgaagtggcgggccccgccggtcagcggcaggaacgccccgatgtcctcctcgtcccagccggtgcccgtgatctcggtgatcccgtcgaacagggcgcgcacgctggcgatgaactcgatcgggaaatcgtgctcgtcgatcgcggtgatcgcgcgggcgaggcgcacgatggcgttctcgtcgttggggaccgagccgtggccggcacggcatcgaattcctgcagcccgggggatccactagtctag

SEQ ID NO: 19288 - DNA, 735 bp, Glycine max
  Peptide Sequence Number=SeqID_110973
atggctcgcactgatcggcgccattggattcgcgcttttcaaggggttccgaaggggacgcggcaagacgggcggggcaaacaactcattgcgctcattatcgggatcggcttcccagcgaccgcgacagctgaaacaccagagcagaatgggctcgaaacgcactctgacactgagctcaccgagctctttggcgatgccggtgtggccgaaaaagacatagcaggccttatagcgaagattcgctccggggaagtcccggaatcaatgcagcccgacagcacgccggctgaggagtccactgaggaagtcaagggcggctacgttaccgtctaccgatacgcagacgggtctgccacaacagtcacctcgacctcagggaaccaggcggacgacctcaagcccggcacgatcgcgacccaggcgatcgccgtcaagggagttggatgctcctcgaagaagacttctggctcgacgaccacctacaccgggtgcaatgttgaagctgcctatttgattggtaccgccaagttcaagttcgacggcaaacgctctggcgggaagttcacgatcacgcgcgtttacggcggtgggtgcaactacttgactaagtgcggcagccccaagatcgtgcgcaagacgtcgtcttcttcgcagcatgcacaggccgagatggcagtgcacggcacccccattaagggcgtcggctggacgcagatcaagcttatcgatacc

SEQ ID NO: 19289 - DNA, 645 bp, Glycine max
  Peptide Sequence Number=SeqID_110974
atggggctgcagcgcgacggggtcgtcggcaccggcgacctctcgaccgacgcggccgtgctggcgctgttcggcgacggcgcctcgagcgagggcgaggtcgccgaatccttcaccttcgccgcctcgttccaggcccccgtcgtcttctacacccagaacaaccagtgggccatctcggtgcccacccaggtccagtcccgcgtgccgctcgcgcagcgctcccgcggctggggcatcccctcggtgcgggtggacggcaacgacgtgctcgccgtgctcggcgcggtgcgcaccgcgctggactccgcccgcgacggccgcggccccgtgttcgtcgaggcgctcacctaccgcatggccgcgcacaccacgagcgacgacgcctcgcggtaccgccccgccgcggaaggaggaggaatgggccgcgaaggatccgatcctccgcctgcgccgccacctcgcccagctcgacgagatcgacgagcagttcgtcgcccgctgcgacgaggaggcccacgacctcgccatgcagctccaccaccacatccacggcatggaggacccggacccggtgcacatgttcgaccacccctacgccgagccccatccgatcgtcgacgccgagcgcgccgagtacctcga

SEQ ID NO: 19290 - DNA, 918 bp, Glycine max
  Peptide Sequence Number=SeqID_110975
atgttcaccctgcccgatgagctcgacgccgaggaccaccaccaggacttctacgacaccatcgctttcctcgccggccccgagcgcgcggaccgcgtgcgggagcatctcgcccaggtgcgcgagggcatgctccagggcaccgacgagggcacgcgccgcgccgaggaggcaacggcccgggcccaggcggagcttcagcgggtcatgtcccgcaccgaacggctcggctccaccgcagtggccgacgggatgctgcgtgagatggagatgccctccctcgagctgcggcccggcgacctcgaggtgtgggccgcggccgacgcgatcggccgccgcgcgcacggcatggacatgttcgagttctggcgctcgagccccttcccggtgaacctcatggatccgtcggcctacgtggcccagcgccgcacgctcgacctcgcccacgagggcgacgaggacctcgcggcgctgctgcacctgcgccgacgaggcctactctcctgggacgacgtgcaccggttccgcgagatcgaccccggcaaccccaagctccgtgccatgatcgacgccgccatggagcgcggcgtgtggaagctcgcctggctcccgccctctctgccgtacaccgccccgggcggccctttcgcgaccgagggcgcgcgcagcttcaccaaacgcctggtgttctccgcctggagcgtggtgccgaaggcgatctccgccctgttcagctacgaaacggaccgacggctcagcgctttcgcccccgggcaggggaggggcggtccggcgctgtacgacgggccgcgcgcctcgccgctgctgcgcttcgccgttgccgatgggaagctgatgaacctgccgcacctggcgctgctccaccatcgaattcctgcagcccgggggatccactag

SEQ ID NO: 19291 - DNA, 168 bp, Glycine max
  Peptide Sequence Number=SeqID_110976
catgttatcagctcaacagtgagtgacccttctttcttaggagaccccgccgttccttcttccgagggcaaggatggaaattctcatcccgggtcaaggtttatggtgagttcggattttggctcagggcttgtagaatggctggacatgatgtatgtcagggtgtga

SEQ ID NO: 19292 - DNA, 1185 bp, Glycine max
  Peptide Sequence Number=SeqID_110977
atgtaccactgtgtgttttctgtgaaggattcgtttgaggagcaggccacacagggatcgtttgtcccccatggacgtcaggatgttctggccgctgctattggacgtctagagcaccctggacgtgtccgtggtattggagccggaaacgatcctgagaccggtgactctgacaggtgcggcttgtacatagaagcagatcctgcccgcctggttgccatcgggagagtttatgagggatccactgttgttcataacactcctttgttgcttggccaagtaaaggtgagtgtggaggaggttagagatgcagatgctccagttcctgtacccactgatgaggtttccttagtgaggcaggcacttcacaccttccttgcttggccgacacatctagtcaagtctttatcacagcaggtagctgtgtctccgccaaaaccacctccgaagcccgatccggaggtcgatgatccactttatctgatgacattgaccatcccagagcttttcttgaggccttatcaggttagatgggatgccaccgtgttcggggtcgttaatccagatttccccctgtacataaagtacgaagacctctccgaaatcgcacacggtggtcaatgtctcagcatatcagtgttacagttatggattctgcatctcactgaaacatgtatgcgagcggggaattctgatatctatggattcctcgagcctcagtccattcagaggtctgggcaatcgcagtttgaatctgaaagttacataaagagttggatgcggagttcacaatgcgatgtgtatcttggagcctacctaaatgggttccactgcagtggacattggcagatggtggtcatcctgcccaaggaacacttagttgtctggttttgttcattgcataacaggccagacaactaccttaaggggattattaatagtgctatcaagggtcttgatgatgctccacagcctaaatcaaaggctcctgcttggtggattgtcgtcaagtgtaatagacaaaaaggaactactgagtgcggctactatgtcatgcactggatgtccaccatcattttaggaagttttagaaataattgggaagcatattttaacgaccctagaccattggagcccgagagattaaaagcattgcggattcagtgggcacagttttatctctga

SEQ ID NO: 19293 - DNA, 216 bp, Glycine max
  Peptide Sequence Number=SeqID_110978
atggagcaaacgcggcagagaagcgaagaggcgcgaggaggtgaacatgcaagagaagaatcaaacaaggctgcttcaaaggataagcattgcttcaagattaatacaagattgcttcaacgaacaaagccttgcttcaagattactttaagatcaagccttgcctcaaaacaaagcgattccaagacatgcaaggctctggtaatcgattactag

SEQ ID NO: 19294 - DNA, 312 bp, Glycine max
  Peptide Sequence Number=SeqID_110979
cgagcagatgcgctaagcgcaggggcttttaaaactcaatcatcatatggaaacgctaagcgcagttgtgcactaagcgcaccatacgaaactgctaaaaattataaggccattcgttgcatctgcccttaccttgcttcatctccctacattcctgcacctttgctattcattgcattcatctacacaatccaaatgaaagcgctacgcgcagctatcgcgctaagcgcgttcatcttctctattgagttttctattgaactcgctaagcgcggttgtgcgctaagcgagtactgtgtatcagacacttag

SEQ ID NO: 19295 - DNA, 607 bp, Glycine max
  Peptide Sequence Number=SeqID_110980
atgggcgacggcgagggtgtagggcaggatcagctcgctggcccggggcgcgaccacgaccgcgccgatcacggtgtgcgagccgggccgcacgatgagcttcacgaacccctcggagatcccctgcatcttcgcgcgcgggttggtgtccaggcccagggtcatcacctcgccggccacctcgccgtccagcacctcctgctcgctgacccccaccaccgcgatctcagggctggtgaagatcgcggaggagacctgcgcggagatcagcggggagaccgcgtcgccgagcgcgtggtgcatcgcgatgcggccctgcatggcggcgaccgaggcgagcgggtagacgccggtgcagtccccggcggcatagatgccgcgcaccgaggtgcgggagacgcgatcggtctcgatgtgcccggagtcccgcaccctcaccccggcgcgctccagtccgagatcaccggtccaggggatcccgccgagcgccatcagcacgtggctgcccgcgatctcctcgcccgaggtgagggtcacgaccacgccgtcctcggtgcggcgcgcggtcgcggcgcgggagcgggagctcacggtcacgccgcggcgg

SEQ ID NO: 19296 - DNA, 600 bp, Glycine max
  Peptide Sequence Number=SeqID_110981
gtcgacggtatcgataagcttgatgagcccgagcagcgcgatcgcgtcatcgcccggctccgcggtgagacccgccccgtgcccgcggccgagcacgatgatgccgtcctcgcccgccgggtccgggccgagccccagctcctcgccggagcagatcatgccgtcggagacatggccgtacgtcttccgcgccgcgatcgcgaagtcgccgggcagcacggtcccgggcagcgagacgaccaccagatcgcccggggcgaagttgtgcgcgccgcagacgatgccgcggctggggcgctcctggccgggctggggatccttggggttgtcggcgtcctcgttgtgctcggggccgacgtcgacgcgcacccagttgatggtcttgccgttcttctgcggctcgcccacgagctcgagcacgcggcccaccacgagcgggccggtcacctgggcgccgaagatgccctcctcctcgaggccgacggagaccagcgcggccgcgacggactcggcgctggtgccctcgggcagtgcggtgtgctcggcgagccaggtcaggggaatgcggatcgaattcctgcagcccgggggatccactag

SEQ ID NO: 19297 - DNA, 660 bp, Glycine max
  Peptide Sequence Number=SeqID_110982
atggcggcgtggacgaacaatggcgcggccacaactctcggtctgcgacgaggcagaccttctgtcgcactcccggactacgatccggagtcgagccggcaacacaccgtgcgacggaggaatctggctcatgattgtcgaggaggaggtgcccgtgcgggatgggactcgatcggacacatgagcgcatggtcgcccgtgagccgcgcccgaacctctgcacctcgccgtaggccctccgtcatggtgacgtggaaccctcctccggaggagccgaacgcgtcgtgtcccatctgctcgaaacccgtctggttcttccgcaacaagaacggtggctgcgcgtacttcgacgcgatcggcaagccgtggcctcttcacccctgtatggaaaaacagcagagcgctgaggaccgccgggccgccatcgaggcgcgcgccgcctacgaccgtgcgctggagacgtctccccgattcagagcgcggcagacagctcgagtcgccgtgctcgattccgtctcgagggtggaccagcagaggacgggctcgtccttcacgacggctgcaccggcgaagcaggagtcggacgacgatgaaccactggactggatgggtggtgctgggcggtttcttcgccctgttgctgtcatgcccgtggagctg

SEQ ID NO: 19298 - DNA, 751 bp, Glycine max
  Peptide Sequence Number=SeqID_110983
cttcccaaccgcacgtacgtcctgggacctcggctgatctggctcggcgaggcggccacgcgccagctcgggccgacgggacgtcccttcctccagcacctcgcggacgagctcggggagtcggcgaacatggctgcgctcgacgggcagatgatcgtctacgtcggccaggtgcagtcgaaccgctcgatgcgcatgttcaccgaggtgggccgccgcgccttcccgcacgccaccggtgtggggaaggcgctgctggccacgctgcccaacgcggaggtcgagaagatcgtgcgcggcaccggcatgccgcagccgacgtcgaagagtgccgcgtcgctcgaggagctcttcgagcgcctggacgtggtgcgcgagcagggattcgctatcgacgacgaggagcaggagctcggcgtgcgctgctacgccatggccgtgcccggggagcggtcccggatcgcgatctccgtgtccggcccgtcctcccgcgtggacgcggacttcggcgagcgcgccgtgccgctgctccgcgaggtcgcgcagcaggtggccgaggagatggacctggtcccgggcgtccccgccggagacgccgctcgtgcctgccgcgggatcgtcgagccggtagcggctgatcgcctcggccgccgccgaggcgggaacctctccgcgccgggtcaggagctgcagggtgcggaccaccacgctgtgcgtgtccgtgccgaagaaccgccgtgcgcccgcgcgg

SEQ ID NO: 19299 - DNA, 321 bp, Glycine max
  Peptide Sequence Number=SeqID_110984
atgagagcagtgacctggcagggcaccgagcacgtgagcgtcgagaccgtgcccgatccgacgatccagcagcccaccgacgccctcatccgcgtcacctcgaccgcgatctgcggctccgatctgcacctgtacgaggtgctcggaccgttcatgagccccggcgacatcatcggccacgagccgatgggcatcgtcgaggaggtgggcgccgaggtccgttcggtgcggccgggggaccgggtcgtggtgcccttcacgatctcctgcgggcagtgcgcatcaagcttatcgataccgtcgacctcgagggggggcccg

SEQ ID NO: 19300 - DNA, 924 bp, Glycine max
  Peptide Sequence Number=SeqID_110985
ctgctcgagccgactgctcgcgggcgggcgacggctcgccgggacggctccggcgaggcctcggcctcccatggagcccacgccgggcatcggagtggacgccgcccgcggactgctcggaggcctttcgccgagggcagcgggacggagccgtcggaaacgcccatcgactccgatcccgaggcggcgccgtctgccgccgcgcccaccgagatgccgggccgggcgcgcggggcgtcctcccccgagggcagcaccgcgacgccgatcgcgacgagcgcgatcgccacgatgatccccagggaccgcagagtcttcatgtcaggcatggtcgccaccggcgatgagatcggggcgcggggcgccgagcttgccccgcaagtagcccacgtacacgtccaccacgttcgaggcgccgtcgtagtcgtagccccacaccttggacagcagcagatcgcgggtgagcacctggttcgggttctcgaggaacacccgcgccatcgtgaactcgcgcgaggagagctccacggagcgctgctgcccctcggcggtgcagctcgcgatgcgggtgcgcaggtcgagggagagatcgccgagctcgagcacgtccgcgctgacgctgccgggcccggaggcggcctcgcgggcccgcagcttcacccgggccagcagctcctcgaagcggaagggcttggcgatgtagtcgttggcgccgtcctcgaggccctggacggtgtcgtccacgccggtgcgcgcggtgaccatgaggatcgggatctgcacgtccatgccgcgcagcgccttgagcacctggaagccgtccatgcgcggcagccccacgtccaggatcagcaggtccacgtccccggcggaggcgaggtcgagggcggagatgccgtcctccaccacggtggtggcgaagcc

SEQ ID NO: 19301 - DNA, 797 bp, Glycine max
  Peptide Sequence Number=SeqID_110986
ctggtaccgggccccccctcgaggtcgacggtatcgataagcttgatcgccggcggcgatgcgggtgacctcgttgccgccgtggtcgcgcacataggtggagtactggcgggccagcgccgcgtagtcctcggcgcgcatgttgccgccgcagccccaggcctcgttgccgatgccgaagtagggcaccgtccacggctcgtcgcggccgttggcgcggcgcagggacgccatcggcgagtcgtcggcgcgggtgaggtactcgatccagtcgctcatctccgcgaccgtgccggagccgacgttcccgttgacgtacgcctcggtgtccagcagctccacgaggtccatgaactcgtgggtgccgaaggagttgtcctcgacgatgtcgccccagtgggagttgaccatgcggggccgctcctcgcgcgggccgatgccgtcgcgccagtggtagtcgtcggcgaagcagccgccgggccagcgcaggttcgggatctgcagcgcgcgcagcgcctcgaccacgtcatcgcggatgccgcgcgtgttcgggatctgggagtcctcgcccacgtagaagccgccgtagatgcagcggcccaggtgctcggcgaaatggccgtagaggtgccggctgatggtggcgccgggcaggtcgaggtcgatcaccacacgggccgggccgtcggtgggggcggccgacgggccggtggagcccggaggcgcgggagccggtctgcgtcgcgctcagcgcggagacgaggccggaggtcaggagcgggaagactcggtcacag

SEQ ID NO: 19302 - DNA, 1008 bp, Glycine max
  Peptide Sequence Number=SeqID_110987
atgcgccgagtgctgcgcgcctcctcccgcgcgaatcccgaagcaccgtcggacggcggcggctccgtgcctgccgccccggctgcggcaggtcagcaccatggcgcagtacgtgcgggaccaccaccgctcccccgtcaccgtcgcggacatcgccgcctccgtgcacctggccccctcgcacgcgatgacggtgttccgccgcaccgccggggtgaccctcggcgactacgtgaccatgtgccgggtcgccgaggcgcagcggctgctgctgaccacctcgctgaaggtcaccgagatcgccgaggaggccgggttcgggtccctgagcagcttctacgagcatgtgagcgcagcgtgcgggatgacgccgcgggagtatcggcggcagcggcggtgaggagtgctcggcgagagccgtcgtccctcgaggactacccgcgcctcgccggggaggcgctgggactcgcgcggccccgatccccgcgccgcaagggtggcgcgcagtcgcagcggccgctgccgttcgtcggcccgggcgagcggctgtgggtgctcgacgtcccctacgggacccaggtcgagggcgcctcgtggcatccggccgtgaagatgcacctgttcgtcggccgcagcctgcccgcgcatctcgcgccctacgctcccggaccgcacaccctcggccggttcctcgagaacaccctgaatcccgagagccctgcgccgaaccccgcaccggccgagcatctcgagccgcgcaagaaccagttcgaggcggccgacgcgatcgcggaacgcgccctggccggagggcggcagttcctgctcgccgacgagccgggcgtcggcaagacgatctccgctgttctcggcgcgaccgcggtgggcgacgtccgcggcgcgcggcgagtgctcgtggtcgccgaccggccggcggcgatcacgatcgggcactggtgccgcaccatcaccgcgctcggcgacggcgacctggaatggggtgggtga

SEQ ID NO: 19303 - DNA, 732 bp, Glycine max
  Peptide Sequence Number=SeqID_110988
atgtcggccccgtgctcgagcgggcgcagcagcaccggggtggccatcgtgttgtcgacgacgacgggcacgccgggcggcgtgggcgatctccgcgatcgcgcggaggtccggcacggtgaggacggggttgccgatcgattcgaggaagacgccgcgggtgctctcgcgcagcgctgccgcccaggccgcggtgtccagggggtccacgaaggtcacctcgatgccgagatcggcgaagctgtcgccgagcaggtccgaggtgccgccgtagagcttgttcgaggccacgaagtggtgcggtcccgggccggcggcggccacgagcgcgagcagggccacggccacggccgcctgcccggagccgagggcgagcgcgcccgccccgccctcgaggtcggcgacgcggcgctcgagcacggcgttggtggggttgccgttgcggctgtagatgttgccgggccgggacagggcgaaggtgtctcgggcggaggcgaagtcgtcgaactcgtaggcgacggactggtagatgggcacggtcaccgtgttctgcggcgtgccgggggtgtagccggcgtggatctgccgggtggcgaggcccgggccgcggccggtcgcggcgtcggcgccgtgcggggtcggggtcgggacgatgtcgggggtcatcgagggggtcctctctgcggggtcgtccgtcatcctgcggtgctcgcggctcccgagcacccctag

SEQ ID NO: 19304 - DNA, 1117 bp, Glycine max
  Peptide Sequence Number=SeqID_110989
gcatgcggatcgccgtcggcgacttggtgagcaccgtgcgagccatcttcagggcctcgcgctcgagttcggcgtgtggaacgacgcgattgaccgcccctgcctcgtacgcgcgctgcgccgaatactcctcggcgaggaagaacacctcgcgggcgaacttctgcccggtctggcgtgccatgtaggccgagccgtatccggcgtcgaagctgccgacgtcggcgtcggtctgcttgaagcgaccgtgctccgccgaggcgatggtcaggtcgcacaccacgtgcagggagtgtccgccgcctgccgcccaccccggcacgaccgcgatgacgaccttgggcatgaaccggatgagccgctgcacctcgaggatgtgcaggcggccgactacggcacggctcgcgccgtcgacgaccgccgtctccgcgtccgagtacttgtagccgtcgcgtccgcggatgcgctggtcgccgccggagcagaacgcccagccgccgtccttcgggctcggcccgttcccggtgagcaggaccgcgccgatgcgggggtcctgccgagcgatgtcgagggcgcggtgcagctcgtcgacggtatgcggccggaaggcgttgcgcacctccgggcggtcgaaggcgatgcgcaccgtgggcaggtcctgctcggtgcgctccccgtccgcggactcgatgcggtccaccgcgcggtggtaggtgatgtcggtgaagcccggcccgccgtgctccgtcgcgggcacctcccgccagcggtgcggatcgaaggtgtcggagacccgacggggcagggggacgggcgcggtggtcatgacctccagggtagtccggcggtggccggtgccgggtcggtgacgagccgcccgcaggtgagcacgtcgcagcgctcgccgtcgatgaggaacgtggcgcgctcggtgccctcgtgcacgaatccggcggcacaggccacgcgccccgaggccgaggcgcgggggagcggcggggtgaggtcaccgcctcatcgtgcccgcttcgcctcggcgccggccactcattaccctcgggggcatgcgcatcccttcctgctctgcgcgagcgcggcatcgaccgcgtctcgcctg

SEQ ID NO: 19305 - DNA, 781 bp, Glycine max
  Peptide Sequence Number=SeqID_110990
gaattcgatatctcggcctgcgtcggcgacccgcccggcaggcggccgcgtggctcggcgagcacgcaggccggctgaaggcaaacggccggctcgtccgccgctccccgatgaccatggtgctcgagacggagctgctgcgctgcgccgtgatcggcaagcgcggcggctggcagaccctcgccgagaacgccgacgagctggggctggacgcgacggtgttccacgagctcgccgagcaggcgctgcgccagcacgagcagctcgacgaggtccacgcccacgcgcggcgccgcgccttccgcgccgatcgcgggacccgcaccccgcagggctgagccgtgggcgatgcccgggcccggcctgtaccgtcggccctgtgaacagcgcatcgaccgccctggacctgtacctcagccgcctcaccacggctctctccacggcgaccgcgaccggtgagccggaggtggtggtgcccgatcgcggcatcaccggcgacgtcgagacgcagggcgacatccccgagctgtccttcctctccggcgcgcgccaggaccacctctcggtggcgatctgctcggtcgacggcgagatcacccgctccggcacggaccacaccttcccgatccagtcgatctcgaaggccttcgcctacggcgccgcgatcgacctgcacggcatggaccacgtcaactcgctcgtcgacgaggagccctccggcgagcagttcaacgccctcagcctcgacccggtcaccaagaagccgaagaacccgctgtga

SEQ ID NO: 19306 - DNA, 191 bp, Glycine max
  Peptide Sequence Number=SeqID_110991
atgacgtttttgggactggttgtcgctcgcgtcgctgttgttggtgtctctgtctaccttgatcttccattctatctcttcttctgtttgcatcgtgattcctttgttgctcctcttgctgttctctggcccgatatgtacctcaaagttgaaagcttccttcagaaatatagtgtgattggccgtcaggg

SEQ ID NO: 19307 - DNA, 600 bp, Glycine max
  Peptide Sequence Number=SeqID_110992
atggccgagaaaacaaagtcaagactgaatcaaggtgacaatagtcaaaatgcagatatggtcgtcgaccctccatcccctattgcgagacatgagaagtggaaaaaggctaggacaaacaaatttgggcaaatgacatctgcagcagctcaagaaatcgcagacaaaattggagcttttgtcccacatggtcgtcaagacatcctaaacactgccattggccgtccagagcatcctggacgtgttcgtatcggtggacatggtgtgaccatacccagctactttggacatgcttcctgtgggtcccacagttctttgcctacgatcactgccaaaagattggttgaaatcatacaaactattaagcaagaggtgaagaaagaggtagaagacgagaacaaagaccgtatggacaagatgaaaatgaagttggatgcgatcaagagtgaattatcccaaattcatacgcaacagtcagcttccccaagaccgtctaaccctgacatatttgttgcacgtgttagcacgaaagagagttgtgctgaagctgctaataatgttgttggtaacgagcggtgtacattcatacatgtagtatga

SEQ ID NO: 19308 - DNA, 659 bp, Glycine max
  Peptide Sequence Number=SeqID_110993
gtgaaatgccggggggccggttattttgaatggaatgcggtggcccgcggcggtggattgggtttctcgcctggcgggtttccggcaaagccgaacgcgctggggacgctggttggggccagttattctcggcgtgctgtcgaacgggctggtgatgctctccgtgccgtattacgccatggacattataaaagggctggtgctcgcgcacttggattattgactgcgctgccaggcttcgcggccacgcccgcaccggtgccggctgccattgcgaaccacgagggtccgatccgcatcgcggtgatccgcaacctcggctccgacgacaacaccacgcagtttgtggcgggggcgattcaggaagggaagaaactcggctttaaggtcagcacttttttaagcaacggggacgatgccaaattccaggacttcgtgaaccaggcaatcagccagaagggcgcgatccgtactccaccgcgctgggtgaagaaggcggtggatgccgggattaaagtcgccgtgtttgatacggcggatgatgcttcgctgacgaacctctccttcggccagctggcgaaagatttcaacggcaaggccaatatcgtcaagctgtggggtggcggggcttcccgccggatggagcgtcgtcagggggc

SEQ ID NO: 19309 - DNA, 228 bp, Glycine max
  Peptide Sequence Number=SeqID_110994
atgtttttcatctgctggatatacaagcactttccctcagtcgcggagtccactactgatccggactacgacgaggattcaccgcgtgccggtaggtggattgctacgaagaagaccatgaagagcatactacaccggcgtacagggagtgcctggactgactctggatttcggatgtctgttggattccatatggggagcaccgactggtctgggacttccatatga

SEQ ID NO: 19310 - DNA, 540 bp, Glycine max
  Peptide Sequence Number=SeqID_110995
atggcgccgaccaggcaccctttggacccagataagtccaacagggccctgggatttcccgcactgatcacaggactctgccagtcgttcggagtccccgttgcacctaccaaggtgattcggccgcccatcacccgggcttttattgagaagtactgcacccagagacaggctcagggtgatgctccacaggccgcaggcgcgccaccaccacctcatcaggctggcccggttgggtcgtttgacgtagagcagtatttacggcatttggttcgccagcaggcggccaaccaccgggcacacgtacagacccatgattgtctttaccagctgagcctcagcatgcagagccagggcttcgcttctttttcatgccctactccagaccagttcagggcagaggtcgcatggcccggggattggcccgaggcccaagcaggagaggcacccccaggggctcccaacgatggagaggaggcccatgaggacgaggagatggctgatttgcttgacttcttgggagggagtggagctacatga

SEQ ID NO: 19311 - DNA, 384 bp, Glycine max
  Peptide Sequence Number=SeqID_110996
atggacatcttggcacttttgatcttcggggtggtcctctttccaaatgtggattggttggtggaccgggcagcgattgatgcttttctcgccttttatgactacaaggaaagcccggttgtcgctatcttagccgatctatatgacacatttgaccgaagatgtgagaagaacagtgcaaggatcgtttgctggacgaggggttgcatcaattacaatcctgtcctcactataagacaacttggttaccctatgagaggggcgccatcagaggaaggcctcataccttttattatacgaggtttcaatagcaccaacacggggggtgcttcagagggtccacaaggcatgggaaatgtcacaaagaaaggacaaggaacttag

SEQ ID NO: 19312 - DNA, 372 bp, Glycine max
  Peptide Sequence Number=SeqID_110997
atgggggtgagcttagctatcggaggggaagttaccttccttgcttctcaaggaagcttcccattgtgtgtgtcacaacatgcccttttgcgggcgagcgaggcgagactcacgtgtgcgctttccataggaggaaagatgcgcggagtcgccaccaacgtttatttgtggaaaacgtcgaaaaaccgaaggaaaccggtcataaagaatattccaagttcgggagttgtatttacacttgaggaaggtattagcacctctcacgtcgacaaaagcggggctcttgctcctacataccctccatcgaagagaaaatcagacctacgtagttcttttttaagggtgaatcaagtgattctttttacttggaag

SEQ ID NO: 19313 - DNA, 159 bp, Glycine max
  Peptide Sequence Number=SeqID_110998
atgggggagttttttttgagagtttttggctgtggagagactgagagagagctgagcttgaagaggaagccatcttgcggagctttggatgagattttgagagattgtgagttttggttaagtctagcccaacaagagggatctgaggatgacgcttga

SEQ ID NO: 19314 - DNA, 306 bp, Glycine max
  Peptide Sequence Number=SeqID_110999
atgcagagataccttatggttatccgcaccttttgtcagctagaggcaagcgagcctgttgacatgcagagactaacgtcatcatctgcacctttatcatccaaagacaacaagtctgatgacatgcgaagataccttatagttatccacaccttttgttatctagaggcaagcgagcccattgacatgcagagactaacatcgtcatctgcacctttcccgaagatgtcagtgtcttccggccgagactgcgaaaacgtctcgtttgctatccgtcagactcaagggtccggtagcaagcaatga

SEQ ID NO: 19315 - DNA, 240 bp, Glycine max
  Peptide Sequence Number=SeqID_111000
atggcaattctgatcgccaatacttcaagaacatttcatagggatgaaagactcgggaatatgcatgctatgcatggaaaatacatgagagcccggaaaatcatctcttcttacttgcattcgggcgcgcagtgccccatgtgtgcagttaagaatgtgatatggacctcccggcttcccgtgacaaaagacgagaccaacatacaatgcatgcgtgacgacatgatgcatgacatttag

SEQ ID NO: 19316 - DNA, 633 bp, Glycine max
  Peptide Sequence Number=SeqID_111001
atgaccatgattacgccaagctcgaaattaaccctcactaaagggaacaaaagctggtaccgggccccccctcgagggattagcgacccgaatgatccgaaatgggttaaggggatccagacccgcgattctgtgaaccagaaccagcaagaaacggaacagaacgaccagaaagcggaacaaaacagcccaaatacgcaacaaaacgagccagaaacgaaacaacctgaaccagtagtgcaacaggaaccggaaaagatctgcaccgcctgcggtcagagcggtggcggcaactgccctgattgtggtgcggtgatgggtgacgcaacataccaggaaatattcgatggagagaatcagcctgaagttcaggaaaatgatccggaggaaatatcgaattcctgcagcccgggggatccactagttctagagcggccgccaccgcggtggagctccaattcgccctatagtgagtcgtattacaattcactggccgtcgttttacacgtcgtgactgggaaaaccctggcgttacccaacttaatcgccttgcagcacatccccctttcgccagctggcgtaatagcgagaggcccgcaccgatcgctctttctcaacagttgcgcagcctga

SEQ ID NO: 19317 - DNA, 969 bp, Glycine max
  Peptide Sequence Number=SeqID_111002
atggatgggttggtggacctagcagcgatcgacgcttttctcgcctatcatgaccataaggaaatcccgatcgtcgctatgctagctgacctatatgacacgttcgaccgaaggtgtgagaagagtggtacgtggattgtttgctgtactcgagctctttatgtatggttggtttcacacctttttcgccaagaggtaaggcatgcttgcccgctagaaagttaccgttcatgcacagagaaaggaggcacaaattgggaccaactcttagcaaacaaagaaggagcgtctatcaactggttccctcaatggaaagaaggaagaattggagttcttatttcgtgcggaggatttccgaatgttcccttgatggggacgaggggttgcatcagttacaatctcgttcttgctataagacaacttggctaccctatgagaggggcaccactagaggaagagatcgcgcctgtcatttcacgaggtttcaataagaccaacgtggagacacttcagaaggtttggattggctcccgagttttgagaaccgctaaaggggaggaagttgaggcaccggaggaagacaaagaggtgcagaccccagggcagaactcgagcaagctcaaacagtcaaagaaagctaccaccaaggccttggagcaagagacaaaaagggctcgtagggaagagcacggccggaacaagttccgaggggctctgtggggcagcaacaacgagcttaagctccagagggaggaaagggaccaatcctgggtagacagtttgatcttgaaggataagttgaaggcttgctcgaggtccaagagaaacttgtctcagcggttatgcgagacagagaccaacatgctagccatcatcagcaagtaccaagaagaactaaatctagccacggctcacgagcacaaagtggcggacgagtatgcccaagtgtacgctgaaaaggaggcttga

SEQ ID NO: 19318 - DNA, 324 bp, Glycine max
  Peptide Sequence Number=SeqID_111003
atgtattctcttgatttcaggattgtcatcatcaaaaagggagagattgtggaagcaatgccttccaagattattttgatgatgccaaatgtggaagcaatgccttccaaggttattttgatgatgccaaagaatcaagagttaagaaaattccaaagattcaagaatctagtttcaagaatcaagattcaagattcaagaatcaagtttcaagaatcaagattcaagaataatcaagatcaagattcaagactcaagattcaagaatcaagagaagactcaatcaagataagttctaaaaaagttttccaaaacattgagtag

SEQ ID NO: 19319 - DNA, 207 bp, Glycine max
  Peptide Sequence Number=SeqID_111004
atgttgattgatcatggaaatgctttggcatatgcatgctgtgtatgttcatgcggggcaaagtgcactgaccttccagggtctttggcacttgctttgggccatgttcgtatgttggatgttgagtatgttcgtggcgggcaaagtgcactaatcttccatggtctttggcacttgctttgggccacgttcatacgtcgtatgtag

SEQ ID NO: 19320 - DNA, 333 bp, Glycine max
  Peptide Sequence Number=SeqID_111005
gggggtctgcgttcactattaagcctacgcccgtccattcctttcaagcttgatcccgcccttagactcgttacgctgttcgcccacttacttaaagactcgttggctccgcgctctattcggtcggaacccggtttgagaaccttctctcatagattcctttcaccaagtcatcgccagcaatcagctcttatcccttggtgtggtgtcaaagggcgagttcctttcttgtcttgcccaaaaacttgctttattctcattggagaaagactctcccgcggcaaggttttacacatagggccagctgctttatctcgcttgccgtccgtctag

SEQ ID NO: 19321 - DNA, 1065 bp, Glycine max
  Peptide Sequence Number=SeqID_111006
atgctagccgacctatatgacaccttcgaccgaaggtgtgagaagagcagtacgaggattgtttgctatactccagctctttatgtatggttggttttgaacctttttcgccgagaggtgaggcatgcttgcccgttagaaagccactattcatacacagagaaaggaggggcaagttgggaccaactcttagcaaacaaagaagaagcgtctgttaactggttccctcgatggaaagaaggaagaaccggagttcttatttcatgtggaggatttccgagtgttcccttgatggggatgaggggttgcatcagttacaatcccgttcttgctataaggcaaattggctaccctataagaggggcgccactagaggaagagctcgcgcttgtcatttcacaaggtttcaataagatcaacatggagacacttcagaaggtctgcaaggcatgggaggtgttgcaaaagaaggacaaggaactcaggggcagtaacaatgggcccatcggtggctatcgtaagtggttgaaagcccacgtgcaaggtttggattggcttccgagtttgagaaccgctaaaagggaggaagatgaggcaccggaggaagacgaagaggtgcaggcccttaggatggaactcaagcaagctcaaacagtcaaagaaaggttcaaatcagcagctcttaaaatccgaaaggagaatgccgaactgagagatataaatatagctaccactaaggcttgggggggggagaccaagagggctcgtagggaagaacacggccggaacaagttccgaggggctctgtggggcagtaacagcgagcttaaactcggaaaagaggaaagggaccaatcacaagtagacagtttgatcttgaaagatgaattgaaggcttgctcgaggtccaaaagaagtttgtctcagcggttatgcgagacagagaccaacatgttagctatcatcaccaagtaccaagaggaattaagtctagccacgacccacgagcatagagtggcggacgagtatgcccaagtgtatgcaaaaaaggaggctagaggaagg

SEQ ID NO: 19322 - DNA, 150 bp, Glycine max
  Peptide Sequence Number=SeqID_111007
atggcaccaaaaacttgttcgcttccagcaagtgcaccggatcgcacaaattcctcttgttggactaaacttggccaggaccgcattaagacaaacatacaacaactaggttatcgtaccccgatccctcctgatagtacgacaaactag

SEQ ID NO: 19323 - DNA, 610 bp, Glycine max
  Peptide Sequence Number=SeqID_111008
actaaggtcttatcccagagagatagaggctagtttgtgcattccgggcaagggctttattctaaacacagagggccaaccatggaagctcctcaaaaaagatcttaccaccctggctcagacatggagcgtcttctcgtacttaaacctagctcatacttcccacacttcagatttgagcacagacagagctaggttggtctatggcttaatcacaaggatggacatgaacattggcggtttgatctctggacaaatgatcatgatggctcagtctaacccttctcgcttaggctttccagctttaatcacagccttttgtagatcgaggggagtgggatctgatgcacttacctcctatgaaaacttaaggccggccattgacttagcttatatcataaagagctgttggaatgcgaatgaccaaacagttaaatttccagaggcatggaagaccaagctcagagcagctgatgctccctcttcctttgcgccaataactgacatccctgcatcctctacttcagccccactcctagctttagcagacttatttgcccagagctctcagacttcagatgccaaattgcaaagcttgtttgaaggatag

SEQ ID NO: 19324 - DNA, 303 bp, Glycine max
  Peptide Sequence Number=SeqID_111009
atgattatgaggagtcaagacatttatagtagccaagatgaggctactacttcaccttcctctagtgaaagtgaagaagcaaaaggggaagaatctagtgaagaaatctacccccaagaagaaggaagacctttaatggttaaggaggagtgtaaggagtttcaatacaacttaggcactcatatgggacacctaggtgttgaggaaaaaagcccagcgtttcaagaacctcgggatttgaggtcaaatccttttcaaggcggagagaatgatgcaatcctaccccgcaagggcattggatag

SEQ ID NO: 19325 - DNA, 312 bp, Glycine max
  Peptide Sequence Number=SeqID_111010
atgaccacatttaaggttcccaacaaaacactcactatcctaagggaaaaattgcctaaaattattacacacaaatggaagtttggtaacctattggaggctcccaacacacttccaatgaaaggcctttttggtataaaatttgaaagcaatgaagcgtttcttagtccaatagctcttaaggtggttggcccttgcttcttgactcaaattcttcaagcctatatggcaactcacaaacaacgaaacaaagagacaagcaataaccaaagaccaaaaaataaaattaaagttaaaccaatagatttttaa

SEQ ID NO: 19326 - DNA, 420 bp, Glycine max
  Peptide Sequence Number=SeqID_111011
atggatgatgaagagggcgtgcaagagcagatgaaggccgatctatcggccttaaaagatcaaatggtttctatcacagaggccatgctaaaactccagaaaactctagaggataatgccacggcaaccgcctccaatgcagttagggaagcggaaccagtgcttcagcccacgataaacttgggccaggatagaaacccaacactgttcggtcggaggtacagtccgcaagcttatccttatggcttgcctccagacttcactccccctgccgttccggaagatgtgagccaagcccctaccttcgaggggcaacttcctccttatgccgattaccccctgcaagaagacgacgaagaagatacccatctaggccctctgcttcccctcaaggatccatccccccatgaattaccttaa

SEQ ID NO: 19327 - DNA, 591 bp, Glycine max
  Peptide Sequence Number=SeqID_111012
atgaccaccctgacccagatctggatgaccttgctgctcaacaacatccagcccagtgatcataattccgacctccccctgccgaagtgtcagctggtgtacgccatcctgacacggatgagcattcacgtggctcaattaatcgctgatgccatctatctatttgcaggtatggcgcctaccaggcaccctctggacccggataagtccaacagggccctgagatttctcgctttgatcacaggactctgccagtcgtttggagtccccatcgcacctagcaaggccgcagatgcgctgccacctcatcaagccggcccagctggttcatttgatacggagcagtatttacggcatttggttcgccagcaggtggccaaccaccgggcacatctgcagagccagggttttacttcttttctgtgccttactccggatcagtacagggcagaggtcgcatggcccagagattggcttgaggcccgggcaggagaggcaccagcagaggctcccgacgaggcagatgaggcccgcgaggacgaggagatgaccgatttacttgatttcttaggagggagcggagccacatga

SEQ ID NO: 19328 - DNA, 756 bp, Glycine max
  Peptide Sequence Number=SeqID_111013
atgatgtttggcgccgcagcccatgctgacacccgtattggcgtcacgatttacaagtacgacgacaacttcatgtcggtggtgcgcaaggcgatagagaaggacgccaaggcttcaccggacgtcaccctgctgatgaatgactcgcagaacgaccagtccaagcagaacgatcagatcgacgtgctgctggccaagggcgtgaaagcgctggcgatcaacctggtcgacccggccgcggcgccggtggttatcgataaggcgcgcgcaaacgatatcccggtggtgttctacaacaaagagccttcccgcaaggcgttggacagctatgagaaggcgtattacgtcggcaccgactccaaagaatccggcgtgatccagggcgagctgatcgccaaacactggcaagccaacccggcctgggatctgaacaaagacggccagatccagttcgtgctgctgaaaggcgagccgggccacccggatgccgaagcgcgcaccacctacgtggtgaaaacgctgaacgagaaaggcatcaagacccagcagctacagatggataccgcgatgtgggataccgcgcaggcgaaagacaagatggacgcctggctctccggcccgaacgccaacaagattgaagtggtgatcgccaacaacgacgccatggcgatgggcgcggtggaagcgctgaaggcgcataacaagaccactatcccggtatttggcgtcgatgcgttgcctgaggcgctggcgctg

SEQ ID NO: 19329 - DNA, 258 bp, Glycine max
  Peptide Sequence Number=SeqID_111014
gccttgcttttcaaagaaaccagtcctatcgtatcgactaaggtttcccatcctagcctatcccggtgtctgctaccgaaagagagaatcggtctaagtgcagctcaaaaccagcccaacctcttcatggtcacatccccttatgcgacgcttttcgtgttgttgcatgtgccttacggtatccagatccagtcctctctgcttcctatgattgaagtgaagatccgcaatgtctgctttccttactctaacaagtaa

SEQ ID NO: 19330 - DNA, 135 bp, Glycine max
  Peptide Sequence Number=SeqID_111015
atggcatccttcagccagcttcagtcacagatgcaatctcagggacctcctgagcctctggttggtcctggtcccttcggtcctcgggaaacgatcctgagacgggtgactctaacaggtgccgcttgtacataa

SEQ ID NO: 19331 - DNA, 243 bp, Glycine max
  Peptide Sequence Number=SeqID_111016
atgttcttaactccaccatggcttgaatacttcgaatttgaagctgaaattttttctgaattttctagacatctggaaaaaaatagaagaaagaacccaacaaaggatcaagctgaatgttttgatgatgccaaagggttacatgtttctcaaagattgccaaagggttacatgtttctcaaagctttattcaagacaaagaaatcaaagatattcaagatggatgatcaagacagtttctag

SEQ ID NO: 19332 - DNA, 795 bp, Glycine max
  Peptide Sequence Number=SeqID_111017
atggcttctaggaaaagaaaggcaacctctacacctacccaagaagtcgagagatgccactgggttgaggagttgactgattttgctgacggcaacattgatgttgccattgtgaaggaattctacgccaacctttatgaccccgaggacaaatcacttaagcaaacccctgttattgtggaagagggggaatcactctgtgcttattctagatttgcactcctgaggcctgaccctcaggagttagctgctaagctctatatcccagggaggggattcgagcttaatgttgatggatacccaatgaagattctgaggaagaacatgactacattagctcagacatggagtgttctttccttctcgaacttgattcccacctcccacacttctgatgtcactcttgacagggccatacctatctatggcattattatgaagatggacatgaatgtggggtacctcatctcccaccagatctccctcattgctcagcatgacacgttcagacttggattcccagccttgattacagctttgtgtaaggctaggggagttcagtctgacttgagatccttggagagcctgagtcctgccattaatttggcatacattaagaagaactgttggaatcttgatgatccaacagtaactttcagaggacccaggaaggccagaggaaaaagatctgaagcgccttccacttcagcatcagagacaggaggtccttcttcttctacacttcctccctcttcctccacaaagatcctagtgattcctccaacaccttcatag

SEQ ID NO: 19333 - DNA, 231 bp, Glycine max
  Peptide Sequence Number=SeqID_111018
atgcagaagaagcaagaagaatgcagggggaaagtttacaaagcacaggcacaaaagtcactcacacacagggaaggaattgcaaaggtaagagtgagtagttcaggcttaacgcaatcaagcgctaagcatacctctactaaatcaaaagtcgtaaggatatgccgcttagcgcatcctgtcgctaagcccaaccatgtagttgaaatcctgaataagtctggggcttag

SEQ ID NO: 19334 - DNA, 249 bp, Glycine max
  Peptide Sequence Number=SeqID_111019
atgagggttcaaataggaaccaggccctcttgggccttccaggatgttcctccagaaggcggttgcttctggaggaagcaacctagctcgcctgggcgagcagggtggcaagcatctccttccttttctataaataggggaaggagggaagaacaaaaatgttcaaacctcctggtatctgagaatcacttaaaattagtgagaaaaattgtatccgtgaagaaaatccaagtcgaggcgcttccgtaa

SEQ ID NO: 19335 - DNA, 291 bp, Glycine max
  Peptide Sequence Number=SeqID_111020
atgcctgcaaaagtggtcgtctatgaggaccccttaagtatgaaaggttcgggagttgtttacacacgaggaagggtgttgaacccttcccttcagcctcccacgcccttttatagccaaaataggggaggaggttgcgcccggctctcccaggcaagctattgcttcctccagaaggttcctgatgggcccaggtggaatgatgcaatcttacccccccaagggcattggatagaagactccaagaagattgggccaaagatgcaagagaaggccctagggttctcatga

SEQ ID NO: 19336 - DNA, 406 bp, Glycine max
  Peptide Sequence Number=SeqID_111021
atggcatccttcagccaacttcagtcacagatgcaatctcagggacctcctgagcctctggttggtcctggtccctccggtcctcgggtgagcacaaaggggagttgtgttgatccctcaggaaacgatcctgagacgggtgactctgacaggtgcggcttgtacatagaagcagatcctgcctgcctggttgccgtggggagagtttatgagggatccactcttgttcataacactcctttgttgcctggccaagtaaaggtgagtgtggacgaggttaaagatgcacatgctgcagttcctatacccactgctgaggttagatgggatgccaccgtgttcggggtagttaatccagatttccccctgtacataaagcacgaagacctcttcgaaatcgcacacg

SEQ ID NO: 19337 - DNA, 210 bp, Glycine max
  Peptide Sequence Number=SeqID_111022
atgttaacaacatttagcacaagacatgtgagaagcttctatggaggcagcggaaggcaaaggagaagaagagaggggaggcaccatccactagggaataagccatggaagaaggagcttcaccaccaagaatgtgccttggataagaagcttgaagaggatgctttaatggagaaaaagaaagagagaaggggggagcctagaaattga

SEQ ID NO: 19338 - DNA, 469 bp, Glycine max
  Peptide Sequence Number=SeqID_111023
gatcccaccaggaagttatccagcttcagtgagcaattccttcaaggcgtcaaaactattgattaatgatcctatattggaaattcaggaatttaaagagaggcttttagatttaggctttgaggtgagtccagttttactacctggcgatcaagcaagttcacaagttttagggggaagccagctatcatcaaaggattcgtttctttcaaaagctgaagtcaaatctatttctaagatcaatgacatttttgaggatgttgtttgtgttacggtgggcattattagcaaaatagtcatggataaccattcatggtgttatccagcttgccttcagtgtcataggaaaactgacatccaaacaggaccattcacatgcggatgtggcaaggataatgatcagcctgaccgtgaatgtgctgaattgattggtcaaacagctgatgatgtgaatagggtcaagattgaa

SEQ ID NO: 19339 - DNA, 183 bp, Glycine max
  Peptide Sequence Number=SeqID_111024
tgtttcatttctaaacgaccatttagaggaaacactgggtccaacaaaatagaagaaaatcactcaaagtgtatcaatctcacacagcgtgttagcagctcaacagtgagtgacccttctttcttaggagaccccactgttccttcttccgagggcaaggatggaaattctcatcctgggtaa

SEQ ID NO: 19340 - DNA, 385 bp, Glycine max
  Peptide Sequence Number=SeqID_111025
ttccccgagagtttgatactcgattcttaccgttttatactacttgcgcgatccgatgcacttgccgggtttgatcaagtttttggtgccattgctggggaacttctttctatttggaaagagtcagccatgtataatcatcatgagaaaggaagagctcctgatcttgaaagtgtattggcaaacttcatgacatatcaagctagctctaaagaaggatcgtctaatctggatgacttgttaatgcaattcaagggtacaatagattcaatgcaacaagcatttaaaagagctaagactcagatcggtaagttggtggatgacatgactaaggttatgaccagaagagaagaagagtatgcagagattaaagcacatcaagaaa

SEQ ID NO: 19341 - DNA, 495 bp, Glycine max
  Peptide Sequence Number=SeqID_111026
atggcatccttcagccacatgcaatcccaacttcaatcgcagatgcaatctcagggacttgtagtgcctcctgagcctctggttggtccctccggtcctcgagtgagcacaaaggggagttgtgttgatccctcaggaaatgatcctgagacgggtgactctgacaggtgcgacttgtacatagaagcagatcctgcccgcctggttgccatagggagagattatgagggatccactgttgttcataacactcctttgttgtctggccaagtaaaggtgagtgtggaggaggttacagatgcagatgctccagttcctgtacccactgatgaggtttccatagtgaggcagacacttcacaccttccttgcttggccgacacatctggtagctgtgtctccggcaaaaccacctctgaagcccgatccggaggtcgatgatccgctttatctgatgacgttgaccatcctagagcttttcttgaggccttatcag

SEQ ID NO: 19342 - DNA, 244 bp, Glycine max
  Peptide Sequence Number=SeqID_111027
atgacacagatgcaatttgcgaatacgagagcccgggaaattgtctccttcttagatacaacgttttggggtagcaaagtgcccaacgggattaagacggaacccacgcaagatgcatatgcgaaagatggcacgcagcgtgtccgcttcgtgcccctattcaggggacctatatgggagggagctaaaaagcctttagtgataattcccaaggtggtcatatctctcttgatggtctctagag

SEQ ID NO: 19343 - DNA, 645 bp, Glycine max
  Peptide Sequence Number=SeqID_111028
atggagagaagtatgatagatgctgccagtggtggagcccttggagacatgactcctgctgaagctagaaatttaattgagaagatggcctccaactcccagcagtttagcaccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgtcgcaaggcaacctggagcaattgagcagcctgaagcttatgctgcaaatatttacaatagacctcctcaacctcagcagcaaaatcaaccacagcagagcaattatgacctctccagcaacaaatacaaccctggatggaggaatcaccctaacctcagatggtccagccctcagcaacaacaacagcagcctgctccttccttccaaaatgctactggcccaagcagaccatacattcctccaccaatccaacaacagcaacaaccccagaaacagccaacagttgaggcccctccacaaccttccctcgaagaacttgtgaggcaaatgactatgcagaacatgcagtttcacaagagaccagagcctccattcaaagcttaa

SEQ ID NO: 19344 - DNA, 489 bp, Glycine max
  Peptide Sequence Number=SeqID_111029
atgaatctaaatgaaagcatacaggatatgcaaaagaggttcacccgcattgtaaatcatcatgcatctatagggaaaatatttccaaatgaagatcttgtcaataaagaacatgaaatggaattgatgagattgaatcaacacgaggagaatgataaaaagaagaaggtaactgctcttaaagcttcatcttcaatccaagaagaaagtgataaagaggattcaattgaaatagatgaagatgatgatcttagtctttttaaaagaatagagaaatctgaaaagaaaggttttaatgaaaagaaggcaaagaaggcgtacattacatgggatgacaatgatatggactcatcagaaaattcagaaaacgaagttgtaaacctgagtctaatggccaagagttatgaaagtaatgaagaggtaacatcttccaataacaacttatccatttcatttgatgaattacagatgcatttgccgattacataa

SEQ ID NO: 19345 - DNA, 528 bp, Glycine max
  Peptide Sequence Number=SeqID_111030
atggctccgagaaagctttttgcaaaaagatctaggaaggacgccgcggctgaagggacttgtgccgctcccgagttcgacaaccatcgttttaggagcgctgagcaccaacagcgtttcgaggccatcaagggatggtcattccaccgagagagacgcgtccagctcagggacgatgagtacacagatttccaggaagagatagctcgccggcattggacgtcgctggtcattcccatggccaagtttgacccagatgtagtcctagagttttatgccaatgcttggcccacggaggagggcatgcggtcgtgggtaaggggccagtggattccttttgatgcagacgccctcagccagttcctaggagacccgctagtgttggaggagtgccaggagtgcgagtatagtcagaggaggaatcgggccgatggatttgatgaggaggccattgcccagctgttatgcataccgggtcaggattttgcccggaccggctcagctaactctataggagacatcctataa

SEQ ID NO: 19346 - DNA, 687 bp, Glycine max
  Peptide Sequence Number=SeqID_111031
atttgcgctcccggttacgggggccacggtttcctttcaacggttcttgggctaccccctgatattggagggcgaccaactgtgcgagcacatccagagaggaaggctatcacgcatcaactatgcataccggggcaagatttcacccgtgccgctgcaaaaagacgagtgtggatcatgcgcaccaacatgaccacttttacatggatatggatgacgttgctatttagtaacattctgcccggcgaccataatgccaatctccccctgcagatgtatcggttgggatcgcgcccacaagacgcccagtgggcccgaagaagtccaacagggccctggggtttccagctctggttatgggcctctgtagtcctacagggtgctcgtttcacccctgcagatggatcgggatcgcgcctgcaagacacccagtggacccgaagaagtccaacagggtcttggagttgtcaagctctaattacgggtctctgtcaattctacagagtacctgtcacctccagcaagggcatcaggccccctactaatcgagctttcatcaagaagtactgcgtccctaggcaggcacagggcgaaataccacagcagcctggggatggccggcagcgggcaacagacgcaccaccatcacctctagagttcgcctcagctcatccacaaaaaggttag

SEQ ID NO: 19347 - DNA, 270 bp, Glycine max
  Peptide Sequence Number=SeqID_111032
atgatattgcatgagattagaagacctaactctctaaaaagtgtccctagtggagtttccgactgtcgcaacctaccctttggcgggagggcgacgcgagactcacgggtgcgtcttccatgggagaaaaatgcgcagagtcgccaccaatgtttatttgaggaaaacgtcggaaaaaccggaaagtcgacaagggtgtttaccttgctcctacgtatcctcaatggaaatcagacctacgtagttcttttagaactaaacgttggttaa

SEQ ID NO: 19348 - DNA, 646 bp, Glycine max
  Peptide Sequence Number=SeqID_111033
ggttgagagtgctcattggtcactaaagagactcctacaaaactctgttggtgacatatgcagtgtttgggaagcaatgaataatatgatgacacttcaacacacccagattaaagcatcttttgagacaagcacgcacgtggttgggcatgtgtttaaagtaaccttgttcaaaaaaatacttggcatggtatcaaggcaaaaatccttcacgttgtggatttgtcatgaggagtacccacggtatttcatgtgcattttttcagatcaagggttatgtgggacacaggtgaccataactgaggagatggaaaccatatcgaaacgctttgagcaactcgatgtttttggcaaagtacatttgaagtcaaagctacaagaaattgcttatcctggtatgaactctatgtgtcctcctccagaaaaggattctattgaaaacattattgatgtcaaagcggatggtaattatggttatcaggcaatagctgtgttattgggtatgggtgaaaaatcgtggtcattggtgcgcaaccatctgcataaagaactgacaagctggtccgaagagtatatcaacctggttggtggcatacagagatttgaggaattaaagctttccctatatgttgacggattaactatg

SEQ ID NO: 19349 - DNA, 255 bp, Glycine max
  Peptide Sequence Number=SeqID_111034
atgaccatagattcacctccactccttagattcccatggatccgggcgaggctcacaggagcgtcttccaaaggaggaaaatgcatggagtcgccaccaacgtttatttgtggaaatcgtcggaaaaaccgaaggaaaccggtcataaagaatattccagattcaggagttgtatttacgtttgaggaaggtcgacaaaagcgaggctcttgctcctacgcaccctctattgaagaggaaatcagacctacttag

SEQ ID NO: 19350 - DNA, 426 bp, Glycine max
  Peptide Sequence Number=SeqID_111035
atgaaggccaagtatattgttcaaagcttgttaaagaacttagaaaaaatcaagaacaagcttgttcgcacatcgttcgcgtgtatgacatccactccacaagcttgtggttacgtgagcgtgaactactaccaatatatagatgttgtttatacaaatgagcacatcttaaaagcttactccgcacaatggtggcctcttgggaatgaagcggctattcctccttctaatgatgcatggacacttatccctgacccaaccacaattcgtgcgaaaggtcggccaaaatcaacaaggataaggaatgagatggattgggtcgaaccgtctgagcaccgaataaaatgcagtagatgtggagccgaagggcataacaggcgtcgttgtccaatgcaatctgagcgtgggagttgttcaaatcattga

SEQ ID NO: 19351 - DNA, 155 bp, Glycine max
  Peptide Sequence Number=SeqID_111036
atcagttcagggctgaggttgcatggcccgaagattggtctgaggcccaggcatgggaggcgctcgcagaggctcccggcgatgcagaggaggtccacatggatgaggagatgacagatttactcagtttcttgggagggagtggagccacatga

SEQ ID NO: 19352 - DNA, 294 bp, Glycine max
  Peptide Sequence Number=SeqID_111037
atggctgaggatgttcctcagttgcctgaggatgttcctcagttggatgaggatgtccctgatgcgtctgatggtagcccagacaggataggagctgccgatggtgctgagtctgatggagtggctagtgatgggacagctgctgatgatgaggggttccccggtgggccacgcgatccatcagttttgataggatttgttgatcatgtcgcacacagcatatggcgtggacagcgacccgatctcaagttggtctcccatgctaggaaagtagataatttgggagaccggctg

SEQ ID NO: 19353 - DNA, 408 bp, Glycine max
  Peptide Sequence Number=SeqID_111038
atgtcaaatcataaaagcactgagtcagcactaaagaaccttgaggtccaggtgggacaactggccaagcagatagctgataagtcatccaacagttttgtggcaaatacagaaaataatcccaaggaggaatgcaaagttgtgatgacaaggagtaaaaggtttgtggaggctgaggatgaggagagtgttgtgcataagaagaaagctgttgaaaaaaaagagaagagtagaagtgataaagctataaacgaaggtaaggaagtaccatatcctgtggtaccttccaagaaagaaaaggaccatcatttggcgagatttttggatattttcaagaaactggaaataaccatgccctccggagaagctttacaacaaatgttgttggataaagtggcctcggaataa

SEQ ID NO: 19354 - DNA, 402 bp, Glycine max
  Peptide Sequence Number=SeqID_111039
atgacatcaagaaagagggctagaactgatgacatcccttcatcatccatcctagctcctcagttatcagccattggaccagatgtccaacactcacaaaccttagtctcgatgctacaaagcttatttaaaggacaacttcttatcatgtacagcctgcaagagttggctcataacaggccaatcatacctatggagcattttcttgagcaacttgaagtagttcccccatctccacctctaattatcatctctgatgcatcatcgaatgaaattgttgcccctcctgattcaccagttggagaaacacttgatccccctaattccctagttggaggaattatcgatctttctgattcgtcatctggagaagctgttgctctcaccgattccctagtatag

SEQ ID NO: 19355 - DNA, 309 bp, Glycine max
  Peptide Sequence Number=SeqID_111040
gataaacagggagttaagggaccggcaaaacttgtacattggtcggaacctgatgatgatcccttataccaaatggcattgacgttcccaaagcttttcctcaagcctatgcaggtgtcgtgggattcaactgtgtttggggtgtataatgatgaaattcccttgtacataaagcatgaagatatttctgaaatagcacacgttggtcaatgtctcaatatctttgttatacaaatatggattctgcatatgaatgagttaagtctgcaatcagataatgcatatgtgtatggattccttgagccatag

SEQ ID NO: 19356 - DNA, 224 bp, Glycine max
  Peptide Sequence Number=SeqID_111041
gtggaggacgcatgaacgaaaatgcaattcatggggctccgaaaaagggttttgaaatggagaattgcactaagcaatcactacgcatggctccaaactcgaagggctccaaactcgaaggtggaggacacatgaatgaaaactgcaattcatggggctccgaaaaagggttgagaaaggagaattgcactaagcaatcactacgcatagctccaaactcgaag

SEQ ID NO: 19357 - DNA, 76 bp, Glycine max
  Peptide Sequence Number=SeqID_111042
atgactctcgtctctactccttctttttttctgcacatcaagcttatcgataccgtcgacctcgagggggggcccg

SEQ ID NO: 19358 - DNA, 420 bp, Glycine max
  Peptide Sequence Number=SeqID_111043
atggcacgcagagaccaagtttggtcattctgcacccatgatacgcggagataccttacggttatctgcacccctattgctaggcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacgacacagttgtgtccgatggcacgcagagaccaagtttggtcattctgcacccatgatacgcggagataccttacggtatctgcacccctttgctaggcagacacagttgtgtccgatggccacgcagagaccaaggttggtcattctgcacccatga

SEQ ID NO: 19359 - DNA, 501 bp, Glycine max
  Peptide Sequence Number=SeqID_111044
atgtcgcaaaactttatggattacgcaacaatcccctctttgacttctggaatgttgcggaactttacggattgcacaacaatgcttccttcgactttcggcatgttgcggaacatcacagattgcctaatgatgggtgttaagtactcgaagcggtcaagcgaaggttgcatgcccccgaacaaatggtccccagatgaaattaggggacaatggagaactcaccctagtaatcaattcaatagagaccatggtcggccatctaacaggccacaacaacaagggactagtctctatgacagaatgacaaagctggaagagactcttgctcagttcatgcaagtatccatgtccaatcaaaagagcacagagtcaacaatcaagaatctagaagtccaggtggaacaatgggcaaaacaactggcagaccgatcgtcacgtagctttggagccaacacagagaagaatcctaaaggaggagtgcaaggctgttatgactag

SEQ ID NO: 19360 - DNA, 47 bp, Glycine max
  Peptide Sequence Number=SeqID_111045
atgcagtatctaggaagtgatcctaggtcgtctcccaaagagcaatg

SEQ ID NO: 19361 - DNA, 99 bp, Glycine max
  Peptide Sequence Number=SeqID_111046
atgcagggccctgaggatgactcagttagctgcctctgtcagccagttagtctgaggatgttcgatagaggttttatcattttaggcctacttgactaa

SEQ ID NO: 19362 - DNA, 199 bp, Glycine max
  Peptide Sequence Number=SeqID_111047
gtcagggggcgcgaatacgataccgttgcgggtcatgcagctcagccccgtgatattggttactttggccgatagcaagcagatgttagtagctccttccttcctttcacttggaggcgcgtacctccatggaactgcgtggctgtttttgtatggaaacggaataggtccaactaccgaagggtgtcggggagtttag

SEQ ID NO: 19363 - DNA, 237 bp, Glycine max
  Peptide Sequence Number=SeqID_111048
atgccattcgttgatgagaaaataaaaaagggatatcgaaaattcggagtggctgaagctgaagcagctactttcgaagtaacagaaaagaaaaagcaacgactggagtgggagagattactaatccttaacttttcgaggaatccttcatcagtggttgtgaatgatctatttttctcaatctctatgacttgttcctacggaaccgagatcgaaaacattaagaataagaaatag

SEQ ID NO: 19364 - DNA, 264 bp, Glycine max
  Peptide Sequence Number=SeqID_111049
cagcaacagtcactacaaagacaacaagcaactgaggctcctcctcaacctttcatagaagagttagtgaggcaaatgaccatccagaatatgcaatttcagcaaaagacaagagcctccattcagagtctgacaaatcagatagggtctggcaaccaaattcaagtgcctccaccagtagcaacaccagcacctgaacctgttaagctttattctacacctgaaaaagaggatgagatagttgcacaaaagagagcttcctaa

SEQ ID NO: 19365 - DNA, 327 bp, Glycine max
  Peptide Sequence Number=SeqID_111050
atgggtgaagtagaggaggtgcaagagcaaatgaaggccgacacggaggccttgaaagagaaaatggccacaatgatggaggccatgatgagcataaaggagataatggaggtcagtgcggcttaccgaactcgtgctagagctagagtaatgggtgaagtacaggacgtgcaagagaagatgaaggctgacatggaggccatgaaagagaaaatggccacgatggtggaggccatgatgatcatgaagaagataatggaagccaatacggttgcagttgccactaccagcactgttgctaaggtgaaccccgatgcccccatctga

SEQ ID NO: 19366 - DNA, 2076 bp, Glycine max
  Peptide Sequence Number=SeqID_111051
atggggaccgggtttgacgacatgtctgctgagtcgcacccgttccatccccaacgtgccgcagcaggcgcagcgccatcgcctgttgctgaacgccatcatgctcggcggcggttttgtcggcatgcccaccgaatgcggggggttctgcgccttcccgccttgacatgccctccgttccgaccccagaatgcagcttgttccaaggggtgccctggatgtggaaccggggtcactgcacgccctcattccctctttgcgcctttctgcgaattctgcgcattcactcagcccctggctggccgttatgccgcagtccaaagagggcaccttcatgaccgaagcgtcaatcatcgccgcgctgctggcgtttatgcagcgcgaagaaaccacggaagcggatttcaaccagctggcgctacagctgttcgcgtggcaattcgaacacaatcttccttacgcccgcttcgcccgccagcgcggccgcacgccgctgacggtaaaacagtggcggcagattccggcggtgccgattacggcctatcacccgacgctggcggtttacgatcgctcgatgctgatcaatttccgccagcgctttatggccggatatccgcgcctgccgatggcgatcctgtttccacacagcagcgagctgcccaactcttcgctggcccattatctgacgctggcgatgcaagaatgtggcacgccagacagcgaagtgatggtggatgcgcaggggctgaaactgccgcgtctgatcgccgcgctggagcaggcgcaggccagcggccaaccctatgccctgctgggtgccagctacagttttgtccacctgctggacgaactggcgcgtcagcagcggcgtttcaggctgccgccgggcagccgcatcctcgacaccggggcgcgctgcagcagacgctcggcgtgccgcgttcgcactgcatcaatatgtacggcatgactgaactcagcacgcagttttacgatgccggcaatgaaatctgcccgccggtgaaatccggaccgcactggatccgcacgcgcgtggttaatccgctgaccggtgcggacgtgccggaaggtgagacaggcgtactggtgcatcacgatctcgcccatttcaattctgtttcctccattctgaccgaagatgccggcgtgatggtgcccggcgggctgctcgctggcgatggaatcgtttctcgctgccgcgcaggcgcggacatgaaagtgtatgccggccatctgccgggcatccgccacagcgagatggcgtggcacagcctgcactttggccagcagggcagcgcgctggaagtgtgcgtgccggtgctgtccgaggcgcagattgccacgctggcggccagcgtacgcgataacgcgcgccgctacctgcacaccctgagcgtagcgcgcatcaccgcgttgattgatgaagccatcgcgcgcctgcttgaccgttcgcacccgttgcgccagcaggcggagcggttgctgccgctggttaccggctatgacgccgagatgctgcggctcggtttaaccggctatctcaaaaccttccgtgaaccgcagctgcggcgttttctggcggaagatttcggcaacgtgcagatgctggacgattttcagccgcggccaaaaggcggctttgcccgcgcgtttggtccgcagctgttgctgcaggtctgggccggcaatgtgccgggtttgccgctgtggagcctgattgccggcctgctggtgaaggcgggaagcgtgggcaaggtggcgagcgctgagccgctgatggcgggctggttcgcccagctgctggcggagatcgatccgcagctgggcgagtgtctggccgttgtatggtggcagggcggtgatgaacgcactgagcagcagtggttccgcgaggcagacgtggtgatggcttatggcggagaagccgcgctgatggcgatgcagcggcgtctgccgccagccacgcgctttctgccgcacggccacaaaatcagttttggcatggtggcgcggtcggcgctggacgtgcggcgcggtacggcgctggcgcgtcag

SEQ ID NO: 19367 - DNA, 216 bp, Glycine max
  Peptide Sequence Number=SeqID_111052
atggagaaatgcactaagcactccctccacatggcctccacactcatgggtggaggacgcatgaacgaaaaacgcaattcatggggctccgaaaaagggtggaggatgcatgaacgaaaacgcaattcatggtgctccgaaaaagggttgagaatggagaattgcactaagcaatcactacgcatgactccaaactcgtgggtggaggacgcatga

SEQ ID NO: 19368 - DNA, 668 bp, Glycine max
  Peptide Sequence Number=SeqID_111053
atgacgttgtccgccgggcgggagcacgacgcgtaccgaccgatgcgcatccacgaaggtgttgaggaaatcatcgcccgcgaacagcgcgtgatcgcgatcggcaatcagcacggcgggtttgatctgcatagccgcgttgaccggcgcgacgccaatttgcagcagcgcaaagaaggtcatgtagaactcggccacgttgccgagctgtaccagtgcggtctcgccacggtgcagcccctgcgcctgaagtgcggacgcgaggttgttcaccgcctgattaaagttacgataggtgatacgccgatcgccgtcgataatcgccacggcatcgctgtccgcatggtccgtcaggatgtgggtcagcggcagatcctgccagtagcctttttctcggtagcgacgggcaaaatcctccggccagcgggtaaagggaatggtcatcagtcttccttagtgcaaaccaaacacgttgagcatggtggaaagcttcacaccggtttcacgccattcgcccaccggagaggaggcaggcacaatgcccgcgccagcaaacaggcgaacggtatttttatgcagccgcgcgcagcggatggtcaccacccactcgccgttcccttcgctgtcgcaccagccgacgatgccgccgaacagctcgcgatcaaacg

SEQ ID NO: 19369 - DNA, 216 bp, Glycine max
  Peptide Sequence Number=SeqID_111054
atggaagctcttgagcaattcaaatggcgcatgatatcgagacgttcaaaattcaacaatggaagctctcgagcaattcaaatggttcataacttttcactaggatgtccgattcaggcgcataatatatcgagacgttcgaaattgaacaacggaagctctcgaaattcaaatggtcataatttttcactcagaggtcggattcaggcgctataa

SEQ ID NO: 19370 - DNA, 510 bp, Glycine max
  Peptide Sequence Number=SeqID_111055
ggatcacaaccacagagacacccagtggacctgaagaagtccaacagggccctggggtttctagctctggttacgggcctctgtcggccctacagggcgcccgttccccccagcaagttcatgtcgtcgtggcatagggattgtgcccgcaagacacctagtggacccgaagaaggccaacagggtcttggagttgccagctctaaatacgggtctcttaaggtcatcaggcccccctaccaatcgagctttcatcaagaagtactgcgcccccaggcaggcgcagggcgaaacaccacatcagcattgggatggccggtagtgggcaacagacgcaccgccatcacctctagagttcacctctgctcatccacaaaaaggtttgagtattgcctacaccacatggccgactgtcgcaacctacccttcggcgggagggcgacgcgtgactcgcgggatgcgtgttccacaaaaggaatacgcgcggagtcgccaccaacgtttatttga

SEQ ID NO: 19371 - DNA, 474 bp, Glycine max
  Peptide Sequence Number=SeqID_111056
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccccactagaacttgccaaaagaagcatccattggggttgacccttggtgcatttcgattgatactgctcaaagatgggagtgtgctttttgccaaaaggtaccgagctcgaattcgtaatcatggtcatagctgtttcctgtgtgaaattgttatccgctcacaattccacacaacatacgagccggaagcataa

SEQ ID NO: 19372 - DNA, 240 bp, Glycine max
  Peptide Sequence Number=SeqID_111057
atggtcgctggccgtcttgacggtacgctggtgatgtccgccgccggtttcgccttcgccggtaagccggtggaagacgacaccattctcggttccggcattggtttcggtctgcgcaaaggcgatagcaagctgaaaggtgaactggatgcggccatcgccaaagtccaggccgacggcaccgtgactaaactggcggcgaaattcttccctggcattgacgtcagcgtcagcaagtaa

SEQ ID NO: 19373 - DNA, 600 bp, Glycine max
  Peptide Sequence Number=SeqID_111058
atgagcaaagttttagttctgaaatcaagcatccttgccggttactcacagtctaaccagctggcagacttctacgctgatgaagcccgcgccaaaggcgacgaagtcacggtacgcgatctggctgcccagccgattccggtactggacggtgaactggttggcgccctgcgtccttcagacgcgccgctgtcgccacgtcagcaggacgcgctggccctgtccgatgaactgattgctgaactgcaggcgcacgataccgtggttatcgccgctccgatgtacaacttcaacattcctactcagctgaaaaactactttgacctgattgcccgtgccggcgtcaccttccgctacaccgaagcaggcccggaaggtctggtgaaaggcaaacgtgcggtgatcctctccagccgtggcggcattcacaaagacaccccgactgatctgctgaccccgtacgtgaaactgttcctcggcttcatcggcatcaccgacgttgacttcgtgttcgccgaaggtattgcctacggtccggaagtggcaaccaaagccgccagcgatgccaaaaacgccatcaaacagattgttgctgcgtaa

SEQ ID NO: 19374 - DNA, 498 bp, Glycine max
  Peptide Sequence Number=SeqID_111059
atgaaaggcatgccgccaaaactgatgagcgatgacggtaaacatatcgtgattcgcccgctggcctactgccgcgaaaaagatatcgtgcgattcgccgaagcgcgccagtaccctatcattccgtgcaacctgtgtggttcacagccgaacctgcaacgccaggtggttgccgatatgctgcgtgactgggacaagcgctatccgggccgcattgaaaccatgttcagcgccatgcagaacatcgtgccatcacatatggctgatattaatctgtttgattttaaaggcattaagcatggtgatgcggtggttgacggcggggacattggttttgatcgcgaatcgctgccagcgcagcccgtcggctggcaggctgacgaggacgatcagccggacctgagcgctcgcctcgacgatcgtgcggcggctcaggctcgggaatcggctgcggttgcggcacgggttcgggaatcggtggcggatcggtcgggatag

SEQ ID NO: 19375 - DNA, 1883 bp, Glycine max
  Peptide Sequence Number=SeqID_111060
ccggtgcctttaccggcgcccagaagcgccaccttggccgctttgagcgcgccgatggtggcacgctgtttctggatgagcttgccactgcgccgatgctggtgcaggagaaactgctgcgcgtgattgagtatggccagctggaacgcgttggcggcaatcagtcgctgcaggttaacgtgcggctggtgtgcgctaccaatgaggatctgcccgcgctggccgccgccggccgttttcgcgccgacctgctcgatcgcctggcgttcgatgtcgtccagctgccgccgctgcgcgagcgccgcagcgatattctggtgatggccgagcattttgccattcagatgtgccgcgagctgggcctggcgctgtttcccggctttagcgagcgcgctcagctcaccctgttgcagcacagctggccgggcaacgtgcgtgaactgaaaaacgtggtggagcgctcggtgtaccgtcatcacagcaccgaacaggcgctcgacaccatcatcatcaatccgtttgcgccacgcagcgctcctgcggtaacagagccagcagcagaacagcgtgaaaacgccctgccggcgctgccgctggatttacgccagtggcaaaaccagcaggagtgcgcactggtcgaagccagtctgcaacaggcgcgatacaaccagcgccgcgccgctgaactgttgcgcacgggtatcactgaaggcgtcgcgctgcggcagctgtcagttttgcacgccgggttgtcagctatgcgtgagccgcgtccggcaggttactgcagactacaggcagacctcaaggagacccccatgctgactcaacctgctgaaaaatatcgcccgtggcctgtcatcaatctggcggatcgccagtggccgtcacgccatatcacccgcacgccacgctggctctcaaccgatttgcgcgatggcaatcaggcgctggctacgccgatggacagcgcgcgcaaattagcattctggcaactgctgctgcgctgcggctttaaagagattgaagtggcgtttcccgccgcctcgcaaaccgattttgactttgtgcgcctgctgattgaacagcagcacatccctcacgacgtcactattcaggtattaactcaggcgcgcggcgatttaatcgatcgcacctttgcagcgctgcgtgatgcgccgcaggcgattatccatctgtataacgccaccgcaccgctgttccgtgaacgcgtatttcgtcagagcaaagctgagatcgtcgagctggcctgcgccgccgcgcggcaaatccgcgcacgctgtgcggcgcagcccgccacgcgctggacctttcagtactcgccggaaactttctgctttaccgagccggaattcgcgctggaaatctgtgaagcggtcgccgccatctggcagccgggaccgcagcggccgatgatcatcaacctgcccgccacggtggaagtcaatacgcctaacgtgtatgccgaccagatcgagtatttctgtcgccacttcagccagcgctcgcaggtggccatcagcgtccatccgcataacgatcgcggcaccggcatcgcctgcgccgagctggcgctgctggccggcgccgatcgcgttgaaggctgtctgtttggtaacggcgagcgcaccggcaacgtcgatctggtgacgctggcgctgaatctctatacccagggcgtgacgcctgagctggactttagcgatatgcgcgaggtgctggaagtggtgacgcgctgtaaccagctgccggtccatccgcgccatccttacgccggcgaactggtgtttaccgccttctccggctcgcatcaggatgccattcgcaaaggctttgccgaacgcagcgcgcgtaatgaagtg

SEQ ID NO: 19376 - DNA, 309 bp, Glycine max
  Peptide Sequence Number=SeqID_111061
atgcactatgttccgccggtcgcggcttttgaaacgccgacgctcaatgaactctcctaccgcgcggcggatcaggctgggctcaatctcaacctgcagcccgccaccagcaataccgtggagctcggcagcaaaaaacgcctcggcaacggcctgctgaccgccgcgctgtttcagaccgataccaaaaacgagatcgtgtcagacagcagttacgaaggccgcaccagctacaaaaacgccggtgagacgcgccgccgaggcctggaactcggactcgatcagcagtttgctatgactggcacctga

SEQ ID NO: 19377 - DNA, 1287 bp, Glycine max
  Peptide Sequence Number=SeqID_111062
gaaaatattgagaacagggccggcagtaccagccctggagggaaaagatcagttcagcagcgcgaggatttcctcagtggtgccggtttcgccgaggcgcgggaagctgcgctcaatgctgttgtggtgggtttcagcgttcaggcagctcattgcctcagtcgccagcgtgacgccacgctgctgctgcaactgctgatgcaactgctgatgcaggtcgttattgtagtagttaacgcgtgcaccaggggacgcgagagtgaatgtggcaaaactgcctttaaagaatatagtaaattcgccagcggtacatttgctggtatgactggagggacgctgggtgcatctgctggtatcggtatttgttttgctgtaggcatagccactgcaggagccggaggggttgcttgcgccgctgtaggttcattggtggcagggtctgctgccagctcagcaacccaacatccagtagcgccagacagccttcagggagcggcaaagataagggccggcagcgccagccctggagggaaaagatcagttcagcagcgcgaggatttcgtcagtggtgccggtttcgccgaggcgcgggaagatgcgctcaatgctgttgtggtgggtttcagcgttcaggcagctcatcgcatcggtcgccagcgtaacgttgtagcccagctcgtacgcctgacgcgccgtggattccacgccgatactggtggcaatcccgcacaccaccacctgcgtcacgccacgctgctgcagctgctggtgcagatcggtattgtggaacgcgccccagcaccgcccagtctgccggcagagcagcatcgtgacgcggctgctgattgcggcccggcgcgccgcccgccacgttcaccagcaccaccggcagctgtttcgcgcgaaacgcctgcgtcgatgacaatcagggcggtttgggcatctaacgtggtgacagccatggctgctgatactgtgcagcagccagtcgtcacgctgggcgcgattgctggcgatgagctgcaggcaggcagcggtaggctgataacgggttttgcggccatcctgcgcatcggccacgccctgtaccaggcccagcgtctgcaggctggcgaccgtagcactcatcgactggctgcgcaccccttcgcgcgcggccagctcggtcactgtcattgcgccgtcgcgcaccagataccccagcacggaaacctgcggccaggtgagatcgcccggcggggccgattcacgcaggcggcgcatcagtttgccattgatgctgcgtaa

SEQ ID NO: 19378 - DNA, 2392 bp, Glycine max
  Peptide Sequence Number=SeqID_111063
atgacggcagaaggtgaactcagaggcctgatggatgatgaactgtttacctttaaaggaataccttatgcagcgccgccggttggcgcactgcgctggcgtccgccgcagccggtggtaccgtggcaaacgctgcgcgacgccaccgcgtggggcgatgccagctggcaaaatcgtgattactgcgtggcggccggcggcggcgatccgggccgcttcagcgaagattgcctctatctgaatgtctggacgcccgatgtcgaacctgctacgccgttaccggtgatggtatggctgcacggcggtggcttcagcatcggcgccggcagccttgatccctatcgcggcaaagcgctggcagcgcagggcgtggtggtggtgacactcaattaccgccttggccatttcggcttttttgcgcatccggcgctcgacgcccagtatctgccgggcaaggtggtcaataattttgcgctgctggatcagattgccgcgctgcagtggattcagcgcaacatcccggcatttggcggcgatcgccataacgtcacgctgtttggcgaatcgtccggcgcgcgcagcgtgctgtcgctgtgctgctcgccgctggccgaagggctgtttcataagggcatcgtgcaaagtgcctacagtctgccggacgtgccgcataagcaggcgcagcaaacaggcctgcaggtggcagcgcatttcaatctggccgcggatgccagtgcggagcagctgcgcgcactgccggccgacagtttctggccgctggagcgaccgctggcgctggggccggtggccatcagcggcgatgcggtgctacccagaccgatgctcgacacctttatggcgggtaaacagcatcgcgtgccgttgatgattggcagcaacagcgacgaagccagcgtgctggactacttcggcgtggatgcccgcagcgtgttacaacagctgcgcagcaaaagtcgcctgagttatcgcctgctgaagtggctgtacgatatccatgatgacagcctgctgggacgcgcggtggcgcgcgacatggcgtttaccgtcatgccgttgctggtggcacagtcgcagcacagcatcggcatgcctgcatggcgttactggtttgattatgtgtcagaaaacgcgcgtcatctctacccgcacggcacctggcacggcaacgaaattccttatgtcttcaatacgctcgcgacgctgccgccgccgggtgactggtattacagcgccagcgatatcgcctttgccggccgcgtcagcgcctggtgggtggcctttgcacgggatgccagtgagttcagccatcggctgcggctcgacggggaacctgactggccggtatggcggccaggtgaagatttgactctcgcctttggccacgacgggctgttcagcgtccactcgctgaatgcgctcggcgagggtaacgagattgatcgtcagctggtaaaccagatgacggcgctcagcaaaggcaacgatcaatatttccgcgtggtcacgcgtctgtcgcgggtaatggaaggccgcaccgccggtaacgcgccgaccgcagaagcgttcgcgccggtgcagcaggcactggataacatgaaacagcagttaacccagttcaaagccatggcgccgggtccgatggacagtgagacggtgaacaatgtgatcagcagctggcagaaactgctggatgagggtatcgcgccacaggtggcgctggcgcagcaggcttcactggatgcatggcgcgcgcaggccaacaatgtcacgccgccgctgagccgggcgtttggtgccagcgcagaagcgtttaatcaggccgccagcagcaagctggatgagacccgcgtgaccgtggacacgcttaccagcatgaccaaagtgattattgtgtcggcggtggtgttcggcttattgattctgctgttcactgaccgttacctggtgacgatgctggtgaaaccactggatcgcattcgtaaccattttaccgttattgcgcagggcgatctcagccagccggtggaagaatttggccgcaactgcgtcggcaaactggtgccactgctgcgggcgatgcaggacagcctgcgtgaagcagtcagcgccatccgcagcggcacggagaacatctaccgcggcgcggcagaaatttcagccggcaataacgatctttcatcgcgcaccgaagagcaggcggccgcgctggaacagaccgcagccagcatggagcaactgaccgccacggtgaaattcaacgccgacaacgcacgtcaggccagcgcgctggcggagaccgccaccggcaccgcgcagcagggcggccgtctggttggcgaagtggtgaccaccatgcagggcatttccggca

SEQ ID NO: 19379 - DNA, 276 bp, Glycine max
  Peptide Sequence Number=SeqID_111064
atggatgagatcaacgatgatttcagcgataccgacaccgtgctggttatcggtgccaacgacaccgtcaacccggcggcccaggacgatccgcgcagcccgattgccggtatgccggtgctggaagtgtggaaagcgcaaaacgtcatcgtgttcaaacgctcgatgaacaccggctatgccggagtgcagaacccgctgttctttaaagagaacacccagatgctgtttggcgatgccaaagccagcgtcgaaggcattctgcgcgcgctgtag

SEQ ID NO: 19380 - DNA, 756 bp, Glycine max
  Peptide Sequence Number=SeqID_111065
atggcggcggttgccggtccggcggcgctgctgatcggctggctgatcaccggtgtcggtatcctctttctgtcgctggcgatgttgctgctgacgcgtctgcgcccggaactggatggcggcatcttcacttacgcgcgcgccggcttcggcgagctgaccggcttctgctcggcctggggttactggctgtgcgcggtgattgccaacgtctcgtatctggtgattgtattttcagcgctgagcttctttaccgatacgccggatcgcatcgtgtttggcgatggcaacacctggcaggcgatgcttggcgcttccgtgctgctgtggctggtgcactggctggtgctgcgcggcgtacagacggcggccagcatcaacctgctggcgacgctgggcaaactggtgccgctgctgctgcgcggtggtggtctccgcccgcgcgcggcacaaaaaagatgtcgggcgtgcgacgctgctggcggtgctggccgcgctgctggtctatctgctggtaacgctgctgtcgcttggcgtggtgccgcgtgcggaactggcgcagatgcgcaatccgtcgatggccggtctgatggaacggctgctgggtcactggggcgatgcggtgattgcggttggcctgattatctcggtatgcggggcctatctcagctggaccattatggcggcagaagtcccgttcctcgccgcgcagcagggcgcgtttccgcgcagcattgcccggcaaaaccgccataa

SEQ ID NO: 19381 - DNA, 471 bp, Glycine max
  Peptide Sequence Number=SeqID_111066
atgaaaaaattatttgcgctggtgatcgccgctgctatgggtctgtcttctgtagccttcgctgctgagacaacaactgctgctgctgctgcaactaccgctgcaccggctaagcacaaagctgttcaccacaaaaaagccgctgctcagaaagcgcaggctgccaaaaagcacaagaaagtagagaagaaagcaccagcggctcagaaagcgcaggcggctaaaaagcaccacaagaaagccaccaaaccagctgctcagaaagcccaggccgctaaaaagcaccacaagaaagccaccaagccagctgctcagaaagcccaggctgctaaaaaacaccacaaagccaccaagccagctgcacagaaagctcaggcggctaaaaagcaccacaaaaaagtaaccaaacctgctgctcagaaagctcaggctgctaaaaagcaccacaaagcgaaaaaagctgctaaataa

SEQ ID NO: 19382 - DNA, 177 bp, Glycine max
  Peptide Sequence Number=SeqID_111067
atgacctctccagcaacaggtgaatttcccactggtaattctgatttacaaaagcagcatatccctcttccattccctccaagatcaatttccaacaaaataatggaagaggcagagaaggagatcttggaaacatttagagaagtagaggtcctttgcagtcaactggtgtggtaa

SEQ ID NO: 19383 - DNA, 339 bp, Glycine max
  Peptide Sequence Number=SeqID_111068
atgaccaagagcaagggcaaggatccacttgaaggacttagagggcctatgacaagggctagagcaaggaaagccaaggaagctcttcaacaagtgctgtccatactatttgaatacaagcccaagtttcaaggcaaaaagtccaaggttgacatgatcaagagcaagggcaaggatccacttgaaggacttggagggcctatgacaagggctagaggaaggaaagccaaggaagctcttcaacaagtgttgtccatactatttgaatacaagcccaagtttcaaggagaaaagtccaaggttgtgaattgtatcatggcccaaatggaggaagactaa

SEQ ID NO: 19384 - DNA, 291 bp, Glycine max
  Peptide Sequence Number=SeqID_111069
gagaatgatagagcttatccagcgcaaggtgttgcagcccagatacgcacactgctatataaacatgaaggttgcacggagttgatctctattgttcagagagcaatctctggtgtgtcgagtggtttgtttgtaaacacgggttgtatacagtggctgttagatcttcgaactaatactattttagtggatttcctccctggcttgcgcgatgtcgtgacatctggtacgacatctgtcatcggtatcagaatttcaattggtatcagagcaggcactcaaaatcactga

SEQ ID NO: 19385 - DNA, 366 bp, Glycine max
  Peptide Sequence Number=SeqID_111070
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggggagcttgtggcaacttgggcaatcgatcactcgccgtcttgcccatggagataagaaggctgttgctcgggtaccgagctcgaattcgtaa

SEQ ID NO: 19386 - DNA, 295 bp, Glycine max
  Peptide Sequence Number=SeqID_111071
atgagtattgtccaatgtttctactgcaaaggccatggacattttgcttcccattgtcctaaaaagttctgtaattactgcaaaaaaggtcatatcataaaagaatgtcaaatcagaccaccacggagaaatgcaacagccttcactgcaactaatggctcttctactactcctgtttatggggatcagaatccgcctgctttgggtctttcaggtggaaacaatttacctatcacagcaattggtgatatttcctcatatcttaccaatgtttatgtttctcctgatctcacta

SEQ ID NO: 19387 - DNA, 288 bp, Glycine max
  Peptide Sequence Number=SeqID_111072
atgtggaccaccacgggtacatataaagaattgaaaagcttggttttaggtacttacccgttgaagactgaagaaaacgaagaacgaacgatggatcttgaagaacggttgagaatcttcgccaaaataggggagaagcttgccgcccagctcgcccaggcgagcaaggttgcttcctccagaagcaacagccttctggaggaatcttctggagggcccaagtgggcctggttgctatttgcacccccttttttactaaatgcaccccccttttctatttttttgtaa

SEQ ID NO: 19388 - DNA, 466 bp, Glycine max
  Peptide Sequence Number=SeqID_111073
atgggcataccaaatcgcggatttcagggttacaaccaggggaactcatccggattccaccaagggggagcaggattcaatcacgggccaccgggatttaatcaaggaagaaacttcacgcaaggttcagggtggaggaatcagggaaaccaatataaggagcacaggaaccaacaaccataccaacaaccataccaaccgccataccagcatcccagccaaggtccaaatcagcaagaaaagcccaccaatataaaagaactgctgctgcaattcatccaggagacacgatctcatcaaaagagcacgaatgcagccattcggaatctggaagttcaaatgggccaattggcacacgacaaagctgaacggcccactataactttcggggctaacacggagaaaaatccgaaggaagaatgcaagacagtgctgactcgagggcagaaaaaagcacaggaggaag

SEQ ID NO: 19389 - DNA, 183 bp, Glycine max
  Peptide Sequence Number=SeqID_111074
atggagagaattgagagaattaagaaagaagaagaagaaagaagaggaaatgaagtcgaggtgctaccaaatcgcgactgtgatcattcccgacatcattccttgttcgatgttcttcgtacaattgtcgggatctcccttattattatatgcacatccatcttcttcatctatcatcggtga

SEQ ID NO: 19390 - DNA, 1026 bp, Glycine max
  Peptide Sequence Number=SeqID_111075
atggctgaaagtccatatacgaggtttagattggctcgccaagttaaaagtcgtcagcgaagagagtttgaagcacgggaagaggacgaagaagtccaagctctcaaaagcgagttaggaaaggcgaaacttgccaaggagaagttcaagttggccgctacacacatccggaaggagtgtgccggattacgggaagagaatgcaactaccgcaagagcccttgaacaagaggccaagagggctcgcaaggaagagtatggccgtaacaaatttcacggagctctgtggggtagcaacaatgaactcaagctgcgaagggaagagagggaccaatcgcgagtgcatagcatggtcttgaaagaggagttagttgcctgttcaaggtccaaaaggagcttgtctcagcgtttatgcgagacggagaccaacatgctagctatcatcgccaagtaccaagaagagttaggtctagccacggcccatgagcataggatcgcggatgagtatgcccaagtatacgcggaaaaagaggctagaggaagggtgatcgactctttacaccaagaggcaaccatgtggatggatcagtttgctcttaccttgaacgggagtcaggaacttccccgattgttagccaaggccaaggcaatggcgaacacctactccaccccagaagaaattcatgggcttctcggctattggaaaaacaccataactaaacgcaccacaaggcatccctatcacaccagatccaaatctagaacgatgggtgatcaagaggagacacaggaacagatgaaagccgacatgtcggctctgaaagaacagatggcctccatgatggaggccatgttaggaatgaggcagcgtatggagaaaaatgcggccaccgctgctgctgtcagtttggctgccgaagcaaacccaactctctttgcaactgtgcaccatcctcccttaaacatagtaggacggggaagggacacactggggcatgatggcaaccctcacctgggatacaactga

SEQ ID NO: 19391 - DNA, 557 bp, Glycine max
  Peptide Sequence Number=SeqID_111076
atggatgctggattgctgaccttccaagaggatcgacccaatgtgagaaccaacccgctcgccaggctgatctgttggggcgcccgcaaaagggaggtggattccccaggtgggaggttcctgtttgctgcactccccaaaagtgaaattcgtgagctgcatgacatggaaacgtgtttgggagtagaggaattgttacaacggatgatagatcaaggtcgactagaagttggcggtgaaggaagagaagagcagcatatatgcatgcagtccacggatgggagcggcgttgcgaggcccaaacccttggtgatatacttcaccaagggcacagcttcacaaaagcccggacaccccttagcagctagacctgttcctttcccataccaaaatagccacgcagtaccatggagatatacaccttcgagggagaaggaagaagaagccaccgacgtcagctcgttgtcggctaaagtaacaaatatcacgggactgagtggtgtgacccgtagcggtcgtgtgttcgcgcctcctgacctacagtccagcccgcgaac

SEQ ID NO: 19392 - DNA, 457 bp, Glycine max
  Peptide Sequence Number=SeqID_111077
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtggaaaaagcagcagcatttgtaattcggatatcatttgctaatgattcatatttgcctgcagaaattgcaaatggggatgagcatgttaaagctagtgcaatacgggcggtttgcgtattgggcgctcttccgcttcctcgctcactgactcgctgcgctcggtcgttcggctgcgcgagcggtatcagctcactcaaaggcg

SEQ ID NO: 19393 - DNA, 276 bp, Glycine max
  Peptide Sequence Number=SeqID_111078
atgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaggatacagatcatga

SEQ ID NO: 19394 - DNA, 699 bp, Glycine max
  Peptide Sequence Number=SeqID_111079
atggggacgagaggttgtattaattataatcccatgctggccataagacagttaggctaccctatgagaggtgcaccgtcggaggaaatcatcacgtctttcatcgcgcgaggtcttaatgaagctaatgcgaagatacttcagaaaatccgtaaagcatggaatagagtgggaagaaaagataaggagcttaggggaagtagcaatggcgtcatcgatggctatcacaagtggttgaagtctagaacgcaagggataacttggctcccaaatctgaaaagtctaagtgagaaagaggttgaaattcctgaggaaagtgaaaaagtcagtaacgagctcaagcttagaaaggtcgagagggacgaatcaaggatggaaagcctggtgttagaggataagttaaaggcttgtcagaggtcaaagagaagtttgatggaacagctaagcaaaatagaagagaatatgttaataatcattgatcaatataaggagaaggtgaaccttgctgttagccatggacagatgctggaagatgaacaggcaaagttattgcacggggaagccatgaaatggatgaatatattcgctctcactctgaatgagagtcaagagctgccaaggttgttagccagagccaaggcagtggctgacacatactcggcttccgacgaagtccacggtcttttcaatttctgttaa

SEQ ID NO: 19395 - DNA, 636 bp, Glycine max
  Peptide Sequence Number=SeqID_111080
atggctccgagaaagctttccacaaagcgatctaggaaggacgccgcggccgaagagactagtgccgctcccgagttcgacaaccatcgtttcaggagcgctgagcaccagcagcgtttcgaggccatcaagggatggtccttccaccgagagagacgcgtccagctcagggacgatgagtacacagatttccaggaggagatagctcgccggcgttggacgtcgctggtcactcccatggccaagtttgatcaggatatagttctcgagttttatgccaatgcttggcctacggaggagggcgtgcgggacatgcagtcatgggtaaagggccagtggattccttttgatgcagacgccctcagccagttcctgggatacccgctagtgttggaggagggccaggagtgcgagtacagtcagagaaggaaccgggccgatggatttgatgaggtggccattgcccaactgctatgcataccaggtcaggattttgcctggactgctgctgggagacgggtgcggatcatgcgcaccaacatgactacgttgacccagacatggatgacgttgctgctcagcaacatcctgcccaacgatcataattctgacctccctctgccgaagtgtcagctg

SEQ ID NO: 19396 - DNA, 405 bp, Glycine max
  Peptide Sequence Number=SeqID_111081
atggaagagaattccgaatcagctttgtctacgaacaaggaagctataagtaatgcaactaggaatctcatggagagttcgatcctggctcaggatgaacgctggcggcattgcccttacacatgcaagtcggacgggaagtggtgtttccagtggcggacggccacactgggactgagacacggcccagactcctacgggaggcagcagtggggaattttccgcaatgggcgaaagcctgacggaccaatgccgcgtgaagcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacggtag

SEQ ID NO: 19397 - DNA, 450 bp, Glycine max
  Peptide Sequence Number=SeqID_111082
atggctttggtgactaatcccttcctagggaggatttcatcaaaaaagaatggacctcaacatcggggaaaatcgtactcgaccccttctaagcaatatggtaaccgccccaacaataagaggattattgctttggggtttgctggtggtagtggtcgtaaacccgctactttctcaactcaaatcagttgttacaaatgtggtaagctagggcacatctcctcaaattttgctgataaagtcatgacctgtttcaattgtagacaaaaggggcatattcagagagattgttcatatcccaagaaggggcagagtggtggcggcctgaatgaccaaactagacatccgaagaccatggaaagattctttacccttaatggtgtcaaggctttgaaatccaaagatttaatccaagtgagtaaggatatgatgtttatctctgccaactga

SEQ ID NO: 19398 - DNA, 162 bp, Glycine max
  Peptide Sequence Number=SeqID_111083
atgcatgcaagcggtgcgcttagcaggatgagcccttgctgcaagagtggtgcactcaacggatggcttgctaagctggcagattggcttagcgagaagctaaaaatcaacacttcacaaacttgcctaattaacctgaaattgaaaggaaatgattattaa

SEQ ID NO: 19399 - DNA, 940 bp, Glycine max
  Peptide Sequence Number=SeqID_111084
aacttgtaaaaggaatttaaaagatagtggaactctcaagcgggttgcttggggactagatgtaggcacaagggtgtggccgaaccagaaaatcgtgcctgagaataatgttgtgctttattatactgagtttggtgaattcactgaagaacttgaacactggaattggcacaaggagttgacgaattttatggatggcagcattgatgtggccattgtgaaggagttctatgctaatctttatgatcctgaggataaatcacctaagcaggtgaaggtgagaggccatttggtgatgtttgatgcaaacactctcaacactttcttgaagacccctgtgataattgaggagggggaagagctacctacctactctaggtttgctttactaaggccagatcctcaggaattggcagctaaattatgcatcccaggtaaaggattcgagctcaatgctgatggactgccattaaaaatcccgaggaagaatctgaagacactggcccttacctctcatacttctgacatcactcttgacagggccaagaagatgctggatttccctgcccttatcactgctttatgcaaggccaggggagtcacttctgattcattgacacttgaaagcctcggtctagccattaatgtggcatatgtgaagaaatactgctggaacctcgatgatcccactgttactttcagagggcctcgcaaggccatggggaagaggtcagaggttctcccatcttttgagattcccccttctgcagctccttcatcttctaatattcctcctataccaacttcagctcccactttcttaccagctccatcagttccagttcctcctataggatcatcctccttcacatctgagacaatattttccatgctacagagcctgcacagaggccagatcatcatcatacagagattgtag

SEQ ID NO: 19400 - DNA, 308 bp, Glycine max
  Peptide Sequence Number=SeqID_111085
ctcaacttccattggtgagaaccaatgaggctgctccttcggagcctgcaccggcaggggttgaaccaatgccagccgagccacaaaatctagtggtgaatccacctccttctcctgagcttgaagtagttctcccatctccacctttgattatcatctctgatgcatcattagatgaagctgttgcctttcctaatacaccagttgaagaaacaactgacccccctgcttccccaattagaggaattgctaatctttctaattcgtcatctggagaagctgttgctctcactgattccccagtgtag

SEQ ID NO: 19401 - DNA, 414 bp, Glycine max
  Peptide Sequence Number=SeqID_111086
atgccaagcacctcacaaggaccaaagaaaggtcgcatgtcatcaagcagaggtccccggacgaaattaggaacttgtaaaaagaatttacaagatagtggaactctcaagcgggttgcttggggactggatgtaggcataaggaaaacccgcatgcaaatctttatagaggcaatagatttaaatatttgggaagccatagaacaaggaccttatgttccctctataatagccggaagtgcaacaatagaaaaacctagagcagactggactgaggaagaaagaagattagtacaatataatttaaaggccaaaaatattattacatctgccctaggaatagatgaatactttagggtttcaaattgtaaaagtgctaaaggatatgtgggatacactacaagtaacacatga

SEQ ID NO: 19402 - DNA, 336 bp, Glycine max
  Peptide Sequence Number=SeqID_111087
gtgctccagtggcttctgtttctatcagctgtccctcctgttcagctactgacgggggtggtgcgtaacggcaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 19403 - DNA, 346 bp, Glycine max
  Peptide Sequence Number=SeqID_111088
gacgaagcgctgccggccaggcccgcgcctcagggccaggtcggcggcgcctggtgcgttggcgtcaggggcaggtcgagtgtgggagccgggtcggcggggccggtgggcagaccccagcgggccagcgcttcgcgtgtcaggtgatgccaggactgcaccgcgtgcagggcggcgtccggcttggctaccggccagcgcaacaggaagctgcggccgtcgtcgcgatagcccgccgatggcactcccgccagccggaacaccagcgcgctggacagcgaatccggcaacaacaggccgcgggcgcgccgcccctcggcgcccagggcgcggcgatgggcgctga

SEQ ID NO: 19404 - DNA, 207 bp, Glycine max
  Peptide Sequence Number=SeqID_111089
atggcggagaagacaaagaaaagactagacgaagttgcccagtccggaagcactaagggcgtcattgaccgtccatctcccatcagacgccacgtaaagtggaagatggcccgcaccaagaaatctgggcagacgacgtctgaggcagcaaagaaaattgctgagaagattgtgtcacagggatcgttcgtcccccagggacgttag

SEQ ID NO: 19405 - DNA, 243 bp, Glycine max
  Peptide Sequence Number=SeqID_111090
atgaagaagaattacacgacgtggatatggcatggtgaagtgactgacatgcagagtgggtcccaatctgaaccgtttgatgtagaaatgggagatcgcttggaggacatgattcgtgaccttggacaagagtgttttcaagaagcacacgcccttgtgccaggtatgggtggagtggacaaagtttcacctcactacttgagtagtgcacaatctgctttcagaggacaacacactgcctaa

SEQ ID NO: 19406 - DNA, 285 bp, Glycine max
  Peptide Sequence Number=SeqID_111091
atgtcaggatttacacgcgatcctcctcaaatttcagccagcccacatcaattagaccttgcaccttacgcttcagggccctacaatgctcaatggaatgtctcggggcttctccatgacaagcacacgttgcgttcgagtcgtattctcagagaaacgaaggttgatgaaccttggctagggttatggcttccattgaattatcaagtggtgtttagcattggtcgtgtgttgcatcctatccgaagtcattatactgacccgcctaatgaaggcaaccattag

SEQ ID NO: 19407 - DNA, 256 bp, Glycine max
  Peptide Sequence Number=SeqID_111092
atggatcaacttgatccatatgatttacggaccaccttcgcgcacacctatcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 19408 - DNA, 213 bp, Glycine max
  Peptide Sequence Number=SeqID_111093
atggcggttgctacaagaggagctagaggtggatctagttttcgaagcttgttctcgttccggatcttcatttctgccatgttttctcttctcttcgttgccaccctttcggtcctccttaccaccaacccctccacatcgaacgatgaccctggatcttcccacccactggtaatgcatacgtgcataggaaaccctttttttgggcattga

SEQ ID NO: 19409 - DNA, 525 bp, Glycine max
  Peptide Sequence Number=SeqID_111094
atggtggcacgggtaatgctcgggcacggttacgagcccggaatgggtctgggcaaggacagccacgggaatgccgatgtggttgacattaggggtaacccgtacaaatgtgggttggggtatgagcacgggaaacctggaaggaggaatgcaccatcaagactccgggcagatagggcatggcccggtcatgttagccagtgtttcacaagtgccaggataatgttcgaggaagaggtggcggcaataggagaagaggctccacaagatccgccgagttttgtgcgaccgtgtcatcccaatttccaagtggggaactggcacgtgatgagccagtcagaagtctatactgctgattcaatatgtgaggatcgatcctttgaggatcctaacaacgagggttcgataatcgattttgaccgagaagtaagtcaaacaataaatgaagaagaggaaaaagacgtcctttcaccagagttggagaggttgatcgctcaggaagaacgcgaaatgaagcctcactaa

SEQ ID NO: 19410 - DNA, 252 bp, Glycine max
  Peptide Sequence Number=SeqID_111095
atgaccaaactggtcttctgcttgtcatcgaggcccgccgcctcttggatgacaaagggtgcggataaccgtaagggtgcggataaccgtaaggtatctccgcgtgtcatcgggcccgccgccctctggatgacacaagggtgcatgtcacatgacctcagggtcagtatgacaaaagattatggggcggccgacaaaagcaaggctcttgctcctacgtatcctcccaatgaggaactcagacctacgtag

SEQ ID NO: 19411 - DNA, 546 bp, Glycine max
  Peptide Sequence Number=SeqID_111096
atgggtcaacttcaacgacaagccttccgcaaagcctatggtaagatttgggacctagctagggtagaagtctccatggaatcgattgcatccctttcccagtattatgaccagcccctaaggtgcttcacatttgaggacttccagctagtgccaactgtgaaagagtttgaagaaatcctgggatgcccactgggaggaaggaagccatatcttttctctgggttctatccctccacgacaagagttgccaaggtggtgaaaatctcagcacaagagttggaccgtgcgaatgggctttcttttattgacatcttggcgcttttgatctttggagttgtcctctttccgaatatggaagggttagtggacctagcagcgattgacgctttcctcgcctttcatcatggcaaggaaagcccgcttggctaccccatgagaggagcgccattagacgaaagcatcacgcctttcatcgcacggggttttagtgaccacaacgcgagggtactccaaggagttcgcaaggcatgggatgcggcgtga

SEQ ID NO: 19412 - DNA, 354 bp, Glycine max
  Peptide Sequence Number=SeqID_111097
atgcaattaccgcgagagcccttgaataagagaccaagagggctcgcaaggaagagtatggccggaataaatttcgcggagctctatggggtagcaatagtgaactcaagctgcgaagggaagagagggaccagtcgcgagcacatagcatgcgtttatgcgagacggacgcccaacatgctagctatcatcgccaagtaccaagaagagttaggtctagccacggcccacgagcaaaggatcgcggacgagtatgctcaagtatacgcggaaaaagaggctagaggaagggtgatctcgactctttacaccaagaggcaaccatgtggatggatcgatttgctcttaccttga

SEQ ID NO: 19413 - DNA, 258 bp, Glycine max
  Peptide Sequence Number=SeqID_111098
atgagtctgaaatggaggcaatttaaatatgaactgaaatcaaaaggatatgatgagagcagaactaaggaggaaatgattgctcacatcccagatccaagggttgatccttctcaatatcgtgatttagtacattattggtgttctgagaaaggacagaaaataattcaaaatgatggtcaatcacaagcaaaaggagccgcaaatcaattgaaagcttgcatactgcaagtgaaccaaaataacaactcttcctaa

SEQ ID NO: 19414 - DNA, 203 bp, Glycine max
  Peptide Sequence Number=SeqID_111099
cgtttgacggccatgagccatgggcgcctgtatcaacaaaggataaagaacgcgttcgacaagaaggtgcacccccgcaagttcaacgagggggaccttgtgctgaaaaagatatcccacgggctctggtgctcatcaacatggatggcgaggagctaccctcacccgtgaacttcgatgttgtcaagaaatactacacttag

SEQ ID NO: 19415 - DNA, 721 bp, Glycine max
  Peptide Sequence Number=SeqID_111100
ggccgacaggttcgacgaggaggccattgcccagctattgtgcacaccagggcaggatttcacccggaccgctgccgggagatgggtgcggatcatgcgcaccaacatgaccaccttgacccaaatgtggatgacgttgctgctcagcaatgtcttgcctagtgatcataactccgatctccctctgccgaagtgtcagctggtgtatgccatcctaacacggatgagcgttcacgtggctcaggtgattgctgatgccatctatttgtttgcagatatgccatccaccaggcaccctctagacccggataagtctaacagggccctggggtttccagcattcatcacgggcctctgccagtcattcggggttcccatcacacctagtaaggtgatccgaccgccaatcactcaggccttcattgagaagtattgcacgcctaggcaggtgcagggtgatgcaccacaggccgcagacgcatcgccaccacctcatcaggctgatcctgttgggtcattaggcatggagcgggccaaggttcgttccttttgcgtgtcctatccagatcagtttagggctgaggtcgcatggcccggatattggcccgaggcccaggcaggggaggcgcctgcaggatccccgagcgatgcagaggaggcctgcatggatgaggagatgacggatttgctcggtttcttgggagggagcggagccacatga

SEQ ID NO: 19416 - DNA, 237 bp, Glycine max
  Peptide Sequence Number=SeqID_111101
atggaacaactacttcagacacaagtttattcaaccaacgaagaaaatcaaggaagaggacaaggtcatggacaaggacaaggccatgggcaaagctcaataaatttcaaagaagagaaatctcaacaagaggtcatggccaaggcaactcaagatcaagatctcctagcaatgatagagttgaagaaaaggaaaactaagttgaagaacaaagtaaagaaggtgaccctttattga

SEQ ID NO: 19417 - DNA, 204 bp, Glycine max
  Peptide Sequence Number=SeqID_111102
atggctctgaaaaagctttccgcgaagagatctaggagggacaccgcggttgaagggaccagcggggagacgggtttagtcagagaaggaacagggccgatgggtttgacgaggaggccattgcccagctgttatgtataccaggtcaggattttgcccggaccgctgcagggagacgggtgcggatcatgcgcaccagcatga

SEQ ID NO: 19418 - DNA, 219 bp, Glycine max
  Peptide Sequence Number=SeqID_111103
atggcaccagtgactatgggtgagtactgtcattgttcggttcaatgctggtctggatcgttccaattcatcggttcgcaagaagccccaaatgctgaatgtcctctttcatcagtaaagaggatcaatgcagaggaagatgatcaagccactagtaggagacctgcaccaagggcaccagaacctgctccaggtgacctcattgacctgaagaagtag

SEQ ID NO: 19419 - DNA, 213 bp, Glycine max
  Peptide Sequence Number=SeqID_111104
atggagctggaactgctgatcaaaaggctctcagagagtggcattgatgatgaagaagcagctgaggaagaaggagaagcagctgaagatgatgaagaagcagctgaggaagaaggagaagcagctgaagaagaagaagaagctgctgaggaagaggaagatgcagcagaagagacagaatcagatgatgatgattctgaagccaccccatga

SEQ ID NO: 19420 - DNA, 853 bp, Glycine max
  misc_feature (846)..(846): n is a, c, g, or t
  Peptide Sequence Number=SeqID_111105
atgagatcctcggttaggggtcagtggatcccgttcgatgccgacgctatcagccagctcctgggatatccgatggtattggaagagggccaggaatgtgagtatggccagaggaggaaccggtctgatgggttcgatgaggaggccatcgcccagctgctatgtataccggggcaggattttgcccggactgctgcaggaaggcgagtgcgaatcatgcgcaccaacatgaccaccctgacccagatatggatgacggtgggtcctcagcaacatcctgcccgagcgggtatggcgcccactaggcaccctttggacccagataagtccaacagggccctgggattccccgcactgatcacaggactctgccagtcgttcggagtccccgttgcacctactaaggtgattcggccgcccatcacccgggcttttattgagaagtactgtacccagagacaggctcagggtgatgctccacaggccgcaggcgcgccaccaccgcctcatcaggctggccaggctggggcatttgacatggagcagtatttacggcatttggttcgccagcaggcggccaatcaccgagcacatgtacagacccatgattgtctgtaccagatgagccttagcatgcagagccagggcttcgcttctttttcatgccctactccagaccagttcagggcagaggttgcatggcccggagattggcctgaggcccaagcaggagaggcacccccagaagctcccggcgatggagaagaggcccacgaggacgaggagatggccgatttgcttgacttcttgggagggagtggagatacgtggctgggagatccccangattcat

SEQ ID NO: 19421 - DNA, 702 bp, Glycine max
  Peptide Sequence Number=SeqID_111106
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcagttcatcatgccgtttgtgatggcttccatgtcggcagaatgcttaatgaattacaacagtactgcgatgagtggcaggcggggcgtaatttttttaagcagttattggtgcctagaatatttatctgattaa

SEQ ID NO: 19422 - DNA, 878 bp, Glycine max
  Peptide Sequence Number=SeqID_111107
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaagcaaaaacgtgttaataaatcaagttccgacaaggttccggtgagcaaagctgtttcacctatgaagcaaattgcatcagataagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 19423 - DNA, 185 bp, Glycine max
  Peptide Sequence Number=SeqID_111108
ggaacctattgggtgagaacttctaatctgcccctaggttcacttgaggctcatgcacggtgcccctcattgccccagtgtaaggctttgaggtttttgcatggtgcctttcgttgccccagtgtagggcttaaaggtaccaagtgttgtctttcgtcatggccttgtaggagggaacctattgg

SEQ ID NO: 19424 - DNA, 123 bp, Glycine max
  Peptide Sequence Number=SeqID_111109
atgggcaagaaactcaagataagggtatgggaggctgaagggaaggggttcatcacccttggcaagcatgtttcacttaaaattagtgaaaagaaggagaaagaagaagaaaatcaaggctga

SEQ ID NO: 19425 - DNA, 222 bp, Glycine max
  Peptide Sequence Number=SeqID_111110
gcttgtagtgagcttcaaaacaaggaaagggagggaaggctgaaaagggctatcaaaggaattaattcaaggaagcatcaacaagaatcaagccaaggctattatgcaaacaatcaatggggcaaagcacaccaaaagattatgatgatggatggctcaaattctcacaaaggtaaacttatcacttccaaattgagctttcaaaactatcatggcatgtag

SEQ ID NO: 19426 - DNA, 414 bp, Glycine max
  Peptide Sequence Number=SeqID_111111
atgagaaccctaaggccttcttcagcagctctagcccaatcctcttggagcctcttgctcatggctctagttactggtcccttcctagggagaattgcatcaggacagcaagccaaagaggttccatcgtgccacatcagtagaagctttgtgagtgcgggtttaagacgcgaaggacaagtcgtcgcgatatgcgatgaggactccctgaggaggtcgaatttggtacagccatgccctcccagcttccaactagggaattggcgggtggaggaacgcccggaggtttacacgacaagcataatatctgatgacgaagatttcaagaaagaagcgagtcagacggaggatgaagaagacgaagatgtaggacttcccctagagctagagaggataattgctcaggaggattga

SEQ ID NO: 19427 - DNA, 219 bp, Glycine max
  Peptide Sequence Number=SeqID_111112
gttagatgggatgcctccgtgttcggggtcgttaatccagatttccccctctacataaagcacgaagacctctccgaaatcgcacacggtggtcaatgtctcagcatatcagtgttacagttgcatctcactgaaacatgtatgcgagtggggaattctgatatctatggattccgcgagccacagtccattcagaagtctggggcaatcgcagtttga

SEQ ID NO: 19428 - DNA, 273 bp, Glycine max
  Peptide Sequence Number=SeqID_111113
ctgaaatacatagccagggggctgagggatccttcgaacagcccccttcagcctttttataggaaaaagggggaggaggttgccgcccagctcgcccaggcgaccttagctcgcccaggcgagctgggcggcaacctcctccccctttttcctataaaaaggctgaagggggctgttcgaaggatccctcagccccctggctatgtatttcagctgttttgggtgaaaaaaattgtttccgtgaagaaaatccaagccgaggtgcttccgtaa

SEQ ID NO: 19429 - DNA, 206 bp, Glycine max
  Peptide Sequence Number=SeqID_111114
gagcaaggacgaaaggagaacaagtcgcaggagaagcgttgaagaagcaagccataggcaaaccttcacgatcgatagccttttatgaatacgaccctcgtgctcgagaggcggatccaaaggcagtcgcttacctaggagcatacttcggtgtagcatatatagcggcatacccctttgacctaggtggaaaagagatctattga

SEQ ID NO: 19430 - DNA, 363 bp, Glycine max
  Peptide Sequence Number=SeqID_111115
aagagcaagaacatcgcttattctgcagcaaccttcctttatgcctctgtcgtcgccgggctaaggcctgctgagacaatagatagtcaggcagaccggggattccatttcatagagaaagctatcgatggtcgcattgggacgggaacaagagcaattcttggtcccaccaaaccatgccatgaacagtcgactcaacaagagcaggggatatttaaactaagactcattccgtctattgctctaccttcctccaacagattgaattgcatcgtttattccccggcaaaactagctgctgactcaacctcccctcgggtctacgccctctttgttttagcatcggcgattgaaagagagtag

SEQ ID NO: 19431 - DNA, 159 bp, Glycine max
  Peptide Sequence Number=SeqID_111116
atgggtcaaggtgtcgaggaaaggagcccaacatatgaagaacctccggatttgagtcaaatcctttccaaggtggaggggatgatgcaatcctacctcccaagggtattggatagaagactccaagatggtgggctagagcttctaaagaagccctag

SEQ ID NO: 19432 - DNA, 240 bp, Glycine max
  Peptide Sequence Number=SeqID_111117
gccggtcccactggatcactaggcatggagcgttatctacaacacttggggcagagttccaccccctttgtgtgccctaccccggagcagtttgcggctgaggtcgcatggccgggagattggcccgatgcccaggcaggggaggagcctgcaggatcccccggtaggatggacgagccccgcatggacaaggatatgactgacctattcgatttcttgggagggagcggagccacatga

SEQ ID NO: 19433 - DNA, 407 bp, Glycine max
  Peptide Sequence Number=SeqID_111118
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgctaaaggcccaagtggagaaggacgaaggcccaagtggagaaggacaaagcccccgagtggagaaggatgaaggcccaagtggagaaggatga

SEQ ID NO: 19434 - DNA, 168 bp, Glycine max
  Peptide Sequence Number=SeqID_111119
gggttgaacccaaatcaggagggagcggctctgacggactcttcggagtgtaggccttgggagtacacccagtttgagtgctcctttaagcctgtgtcgattccacataattggagcattctcgcaaaacagcatgaccctgactggtctcgctatgattttacttag

SEQ ID NO: 19435 - DNA, 261 bp, Glycine max
  Peptide Sequence Number=SeqID_111120
gtcgactctagaggatcccaacattaaagaaactttccctcttagacaacctccacattttctcttttgtaaaaagacacttgctagcattgctacacctcttgggcttgagtttattcctcaagtaaagaagttgttggatgagggtttcgtttgcaagagcttaaatccttgtgctttgttggtgtccaaaataggtgttgacggaaggagcccagagtatgaagaacctcgggatttgaggtcaaatcctttcccaag

SEQ ID NO: 19436 - DNA, 330 bp, Glycine max
  Peptide Sequence Number=SeqID_111121
atgatgacaaaaagcccaaagaatgatttcaagattgagtcaacaagttcaagatcaagtttcatgagaagaaatcaagaagattcaagaatcaagagaaagggtacatctacttgggttgttgtgactaagaacaagagagggtacatctcttgtggatcagttcaagtggagggtacatccacttggttgttcaaagagaacaagggagggtacatcccttgtggatctttgcttgtaaaggtttttacaaggttgaaaagaaatctcaaggaccacaggtcgcttgcggacaggatgcagacacaggttgtttccaaaccagtataa

SEQ ID NO: 19437 - DNA, 441 bp, Glycine max
  Peptide Sequence Number=SeqID_111122
atgaccatgattacgccaagctcgaaattaaccctcactaaagggaacaaaagctggtttgtaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19438 - DNA, 396 bp, Glycine max
  Peptide Sequence Number=SeqID_111123
atgactggccaattgaatgctaagagtgatgtatacagctttggtgttgtccttctagaacttttgactggaaggaagcctgttgatcatacactaccacgtgggcagcagagcctgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccggtgcgtcagcagaatatgtgatacaggatatattccgcttcctcgctcactga

SEQ ID NO: 19439 - DNA, 282 bp, Glycine max
  Peptide Sequence Number=SeqID_111124
atgttcatgacccctaggctatgcatttcggctattttgggtaaaaaaacatgttttcgtgaagaaaaatcgagtcgaagtgcttccataatgcttctgagacgtttccgtgtgcaaatatgtgaagattttcctctgttcttcaccgttcttcgtctattcttcgttcgttcttcgttcttcaaccggtctgattttctcatcgccattgaggatacgcaggagcaaaagccccacttttgtcgtccaccccaagagatcgttaatggtccaacaccttaa

SEQ ID NO: 19440 - DNA, 825 bp, Glycine max
  Peptide Sequence Number=SeqID_111125
atggctcaacctccacctcgtgagaggactcttagggagatggctgcacctgatttcacttatgaaagcttgtgcattcaatatcctgatgagggtgttccatatgttctcaagactggactaatacatttgctgcccaagtttcatggtcatgtaggtgaagatcctcataagcatcttaaggagttcaatattgtttgttccaccatgaagccccctgatgtccaggaagatcatatatttctaaaggcttttcctcattctctagagggagtggcaaaagattggttgtactacctttctcccagcaacctggagaggagtatgattaatgctgccagtggtggagctcttggtgatatgacccctactgaggctaggaatttgattcagaagatggcttctaactcccaacaattcagtgcaagaaatgatgctattgtccttagaggagtccatgaggtggccacggattcatcttcatctactgaaaataaaaagcttgaaggaaaacttgatgtcttggtcaacctacaatttggagtcaatgagcaacctgaagcttatgctgcaaacatttataatagacctcctcagcagcaaaaccaacaacaacagaataattatgacctttcaagcaatagatacaatccaggttggaggaatcatccaaatctgagatgggcaagtcctccacaacaactgatgcaatcctaccccgtaagggcattggatagaaaactccaagtagattgggccagagatgcaagagaaggccctagggttcttatgagccttagggtagatttcgggcccatgggctaa

SEQ ID NO: 19441 - DNA, 216 bp, Glycine max
  Peptide Sequence Number=SeqID_111126
atggatagagctaggttggtctatggcttggtgactaacatggacatgaacatcagagcccttatcttaggtcaaatttcttctattgctcagagtaactcctctaggcttggatttccagccttgatcattgccctatgcagagctagaggagttacctctgacagtttgacttatgagagcctaagcctgaccattaacttgggcctacattaa

SEQ ID NO: 19442 - DNA, 234 bp, Glycine max
  Peptide Sequence Number=SeqID_111127
atgattggcactctggcttctcctcctgagtctaccggcatcattctgctctacatgcccaaaccacctaagttcggtgattttccaccatcttctccaagaggctttactccaaccactctctcaatagcttcgtttatgttgtatcctgtcgagtcttacccactccaccgccttaacattacctcattcttttcacgcttacacctactttacttctcatgttgctcttga

SEQ ID NO: 19443 - DNA, 860 bp, Glycine max
  misc_feature (13)..(13): n is a, c, g, or t
  Peptide Sequence Number=SeqID_111128
tgcaagggatctntgagtcaaagccaacgacattccgaggctcaggaaacacagattccctcctccatttcctcttccttgctgttctcatcagaagaataatggatacggaatttcagaactcaaatctcattccttttatgtctttgaaattgcctgtctattctgaattagttaaagccttttattctaacctcgaaattcaagaaagcattttgatttatgaggtttttggaataaaaatggtcattgaccaatccctattctatgaattgacccaattatctagtgaaggcgtaccatttgaaggtacactgaatgatgattggaaatttgatttctctgtgcatgatgcccgctggttggttcgcaccaaccaagcggatatgatcggaaggctgcttgccggatcatcggctcttgaaagccgcatccttcactatctcattgatcttattgccatgtgggcttttcataccggaagacaaattgattgggcacacttagttcgatatcgcatgcataaggcattgcgattaaatgctccattgccatatccacacctagtcactctcttccttcaacactttaacatccctcttgatactgaaccttatgttccaatcaagagaacctttttgattggtgctgctgtgattgcatcttttggttaccgcaagagcatgatggctcttgggttcgatggtcttcaaacctatgttggtgaaaggtttgatgctttggaactacaagtggacatgcgattcgacgagatggactcaaggatcaccaaagttgaaggagatgtcacttacatccgcacatgctttgatataccaccaccaccgccatcatcttag

SEQ ID NO: 19444 - DNA, 240 bp, Glycine max
  Peptide Sequence Number=SeqID_111129
atgacaaaaagctcaaaaggtccaatccacagaataactcaagtgaatcaaagatcaattcaaagaacaactcaaagtggaatcaaagaacaatttcaagagtttcaagataaagaattcaagaagaaattcaagacttcaagaagaaaagttttagatacaaagaattcaagatttcaagggttcaaagatctcaagaatcaaagatcaaggttccaagactccaagattcaagaatga

SEQ ID NO: 19445 - DNA, 273 bp, Glycine max
  Peptide Sequence Number=SeqID_111130
cacttaaccgacctacaacctcctgaaagcaaaaaccccgccgaagcggggttttttaagaagttgaagctgaccgataagccgggttctgtcgtggacagtcattcctctaggccagcaatcgctcactggctcaagcagcctacccgggttcagtacgggccgtaccatgtgaacccctatttggccttgctccgggtggagtttaccgtgccacggaactgttaccagccgcgcggtgcgctcttaccgcaccctttcacccttacctga

SEQ ID NO: 19446 - DNA, 1018 bp, Glycine max
  Peptide Sequence Number=SeqID_111131
atgggacccctccaaaggcaagccttccgcaaagtttatgggaagattctagatttgaccgtagcggaggtatttacggaagccgtcgtatccctcgcccaatactacgaccagccgttgaggtgtttcacgtttggggacttccaaatggtgccaactattgaggagtttgaagagatattaggatgccctctcggggggagaaaaccgtatcttttctccggctttcttctttccttgagcaaggttgcggctgtgattggagattcagcaaaagagttggatcgcataaagcaaattcgaaacggcgtagtgggcctgcctcggaaatacttggaagacaaggcaagggatatggcaagccaagagaagtggggggcgtttgcggatgttttagctttgctgatttttggggttgtcctctttctgaacgttgacggcttggtagatttagccgccattgatgctttcctcgcatatcaccatagcaaggaaagtctagtcgtggctatctcagatttgttcgacacctttgaccggaggtgcgagaaaaacagtgcacggattgtctgttgtttacccgctctctgtgtatggttgatttcacacctattccgacaagacacgagacacccatgtccgcttcaaagctatcgctcatgtgctgaaaaaggaagagtcgtttgggaccaacatttggctgggatagggggcagcacgatcaattggtttcctcgttggaaggaaggcaaggaaggagttcttttctcgtgtggggactatcctaatgttccactgatagggactaggggttgtattaattataatcccgcactcgccataagacagctaggatatcccatgaggggagcgccgaccgaagaaagtctctcgcctttccttatgagagatctaggcgcgcaaggtctcaaggttatacaaagaatccacaaggcgtggaggagtccgttgaggaaagacaaggagcttagaggcatccgaaacggcgtcatcggag

SEQ ID NO: 19447 - DNA, 456 bp, Glycine max
  Peptide Sequence Number=SeqID_111132
atggcggatgcacttgctacattggcatctatgttccagctaacaccgcacggggacctaccctacattgaatttcagtgtcgtggcaaacccgcacattgttgccaagtggaagaggaacgggacggaaagccctggtattacgacgatcaagcgatatgtcgaaagcaaagatacccgccagagatttgtgagccgttgttacaactcttgcataaaacaactggatcgtggatgaggaggttggcagccaggctttttctgagcggaaggcacaatataagagtgcctaatgaatcctcctgcgatgcttatgccacgacctggaaggcaactctcattttgtacatgacaatcttgaggacgagtccaatgagggctcgtatgctggaacgcacgccaaccatgactaatccgaggaagatcttaagagcaggctgtattacgttaccatga

SEQ ID NO: 19448 - DNA, 309 bp, Glycine max
  Peptide Sequence Number=SeqID_111133
atggcaatggaccataggtcattgccacgacatgggaaattttcttctaccccaaatgcatatataataatagtcattttgatacccggatcaaaagttatggccattttaagttttgctaaaaacaagttcccaaaatttttgtctctctcaaattcaaccacaccaagtgctcctggcctaggatcttcttcatcaatggattccttttcttcttggaagatgaatggcagcggaatggagaaggaagagagagaggagatgccacttcaaggagaatatgagtctagaataagctcaccactatag

SEQ ID NO: 19449 - DNA, 186 bp, Glycine max
  Peptide Sequence Number=SeqID_111134
atgacgaaagacaacaattggtacctcaaagccttacactggggcaatgaagggtaccatgcaaaaacctcaagcgagcctaggggaagattagaaccttacactggggcaatgaagtggcatcggcatgagcctcaagcgaacatgggggcagatcaaaagttctcacctgtcgatgttttttaa

SEQ ID NO: 19450 - DNA, 321 bp, Glycine max
  Peptide Sequence Number=SeqID_111135
atggatggattcattgaactgatgaaagaacataatttggaaacgttggctttactaagctttaaaagattggctaagattttgttaaaacataagcacttagacaatgaaggaaagctggagttgctgcacatgatgtccaacgttatgtcaaagaataagatcgggctgcacaatgcacaaggcaagatgaaatgtcaaatgaagaatcgaagctgcaggattcacgatgtcggatacaatatccaggacatcctgcccgaaaacactggaggtgctgtacaatgtacaatgcaagataaaagtcaagtgaagaagtga

SEQ ID NO: 19451 - DNA, 402 bp, Glycine max
  Peptide Sequence Number=SeqID_111136
atgatggattacattgccatcaaaataacaacctacccgaacaatttttctgcacaaaattacccttgccatgtcatgaaactcctaccagaggatcatagaaattttccctgtctgttcaatgatgaatatgaaagttgggatgtacagggtaacacacagtaccaatacagcctcatgagggcacaaatacaagggtaccaatggttcttctcagaatcagacaaacgagagtttgacctaataagagaaacttatgacacaaagctcttccaaccatcatactatgggaagttcttcattcccttcccagttgatcacaacaaaaaattggtccaattcttccaaaaagagaagaaagataaagagatttacgaagccagtggatgtcatggacaatag

SEQ ID NO: 19452 - DNA, 814 bp, Glycine max
  Peptide Sequence Number=SeqID_111137
ggtcaaggaagtgaagagatgggggtgtgaagaaaatggaggagaaagagaagaagatgacagtgggtgggaagagaaggaggagggacgagggtgtagggaaacttccaacaggggtagttctgtcaatatcaaagaatctgaaaaagtaggggtgaatagtaatttgaggggcaagatgaggctcgaggagcaaactgtcaaacacggcacaaagctggaagggcacaacactgaagtggtagataggagacacactggaacgcgttacaggaatccttccatgacctatgcgaaggactccaaagcgaaggagatcatgtcggaagaactccaacacggcacatctccattttattcgctacagaaatggaacccaatgatgaggcccggccatagactcatatgggtccaatgctggtgtgttcctcttgaagtctgggacatagggaactttcaaaaattggtggctgcagtcgaagacctcattgagatcgtcgaagaagggtcgagcgacgttggaatacgtgcccctcaccatcgaggtgccatagaatctatagaggagatcgactccgatgataatgacagtgacatatcgcgcgcagtgatggcgccaacccccaactttcggcacctgttgaaaggcttcgacggagaccggaatgccgacaacgacgaccactggtcccagccgttactcgatggtccgagccttatggattatccagtggataataaccaggacaactggctccacctacctagcatcgacatccgcgcgaggccagaaatgaagaaaggaaagaaatag

SEQ ID NO: 19453 - DNA, 405 bp, Glycine max
  Peptide Sequence Number=SeqID_111138
atggtgaatatccacacactggtgaagaaggcacattgccttgcaatctctcatcttgttctccttgtggatagctttctacgccttcgtggcccctttaggaaggcttgggtagcattcttccacgatgtccatgacatcttgatagtcgaggatcgccttcatctggatgcaccatctttctcaattgttgccatcgaggatggggaggacaatgacaaagcttccagtgttaagagtcattcttgcaacagagtctccctggaattccttgctctgataccaaatcaagatgctatggaagcagaagccagagaagctctgtggcgggaggagttgattgaggagatagaacaaaaggttgaagggttgagagaacttgaagaagctggcaagaagaactag

SEQ ID NO: 19454 - DNA, 444 bp, Glycine max
  Peptide Sequence Number=SeqID_111139
atggttgctgatggtgtgacacgagaagttcttgatatcctcaacgatgaggacaataatatgatttttgatagagccactgcggagaaggtttttcatacatctcatattctaaaagcttatgaagaggtggttgaaggtcatgagaggtacttcggggttcctactctggtggaaaaatccaaaacctatatcttcacttttgtagagatagaatttggaaaaatctcaaagggccgaaggagtttaagaccaagttacacgtggacgagcattaatggttccatgtggattatggaggatagatggatatcaaggcttcctagggcaaaaatctctcccctaaaaggcacccttgttcttaatgagttgagggttagtgatcttatgaataaggacaagaggggctggaatggtgctattttaatgagcctctttgaatag

SEQ ID NO: 19455 - DNA, 2532 bp, Glycine max
  Peptide Sequence Number=SeqID_111140
atgaatcccgataagttcacccacaagacaaacgaagctctggtgagtgctcacgaaatagcaacaagcaacggtcacgcgcagttcacccctcttcacctggcgtcctctctgatttccgacaaggatggcattttctctcaagcgctttcaaacgccgccggcgaagaatccgcgcgcgcggcggagcgagtcatcaacaatgcactgaagaagctgccgtctcagtctcctcttccggacgaggttcccgcgagcaatgccctcgtcaaagccatccgcagagcgcagactctgcagaagaaacgcggcgacacgcacttggccgtcgaccaactcatcctcggccttcttgaagattctcagatagcggagttgctcaacgaagctggcgtggcggcttcgaaggtcaaatctgaagtggagaggcttcgtggcaaggaagggaagaaagtggaaagtgccactggtgattcaacctttcaggctctgaagacctatggaagagaccttgtggaacaagcaggcaagcttgaccctgttattggaagggatgaggaaattcgaagggttgtgaggattttatctagaaggacaaagaataacccggttttgattggagaaccgggagtgggaaagaccgcagtggttgaagggttggcacagagaattgttaaaggtgatgtacctagcaatctttctgatgttaaactcattgcattggacatgggtgcattggttgcgggcgcaaaatacagaggggagtttgaggagcggttgaaagcggtcttgaaggaggtggaggatgctgaggggaaggttattttgttcattgatgagattcatttggttcttggtgcggggaaaggtgaaggttccatggatgctgctaatttgttcaagcctatgcttgcgaggggtcagttgaggtgtattggtgccaccacgcttgaggagtataggaagtatgtggagaaggatgctgcgtttgagagaagatttcagcaggtgtacgtggcagaaccgagtgttgttgacactattagtatacttcgtgggttgaaagagagatatgaaggtcaccatggtgttcggattctggaccgtgctttggttgtagcggctcagttgtctagtcgctacatcactggtcgacatcttccggacaaagcaattgatttagttgatgaggcttgtgccaatgtgagagttcaactagatagtcatccagaggaaattgataaccttgaaaggaagagaatgcagctagaagtggaacttcatgcactagagaaagagaaggacaaagctagtaaagctcgtttagtggaagtgcggaaagagcttgatgacttgagagacaagttgcaacctttgatgatgaagtacaaaaaggagaaggaaaggattgataatatacgacgactaaagcagaaaagggaagagctgaacttcgctctacaagaggctgagaggcgatatgatcttgctagagctgcagacttgcggtatggggcgattcaggaggtggaatctgcaatacaagagcttgaagggaacaatgaggggaatgtaatgttgacagaaactgttggacctgaacacatagccgaggttgttagccgttggactggtatacctgtgacaaggcttggccaaaacgataaagaaaggttgattggtcttgctgacagattgcaccagagagttgtggggcaagaccaagcagttaatgctgttgctgaagctgtgctgagatcaagagctgggcttggaagacctcagcaaccaactggttccttcttgttcttgggtccaactggtgttggcaagactgagctttcaaaggcacttgctgagcaactcttcgatgacgaaaatcaattggtgagaattgacatgtctgaatacatggaacaacactctgtttcgcggttgattggtgcaccaccagggtatgttggacatgaagaaggaggtcaactaactgaagctataaggcggaggccttatagtgtggtactctttgatgaagtggaaaaggcacacacatctgtgtttaacactctccttcaagtcttggatgatgggaggttaactgatggccaaggccgtactgtggacttccgaaacactgtcattatcatgacctccaaccttggtgcagagcatctcctcactggactttcaggaaaatcttcaatgcaagtagcccgtgatagagtgatgcaagaggtgaggaggcattttaggccagagttgttgaaccggctcgatgaaattgttgtatttgatcctctttcacacgagcaactaaggaaggtcacaaggttacaaatgaaggacgttgctagtcgtcttgctgagagaggaatagcattggcagtgaccactgcagcacttgactatatccttagtgagagctatgatccggtttatggtgcccgaccaattaggaggtggcttgagaggaaggttgtgactgagctctcaagaatgctcgtgaaggaagaaattgatgagaattcaaca

SEQ ID NO: 19456 - DNA, 1473 bp, Glycine max
  Peptide Sequence Number=SeqID_111141
atggcaaaacagatcatggttaggaccagaggattaggtcgtgccttaggtcagcgtcgacagcctactgcatccgcatggaggcagcgagtcgctgtgattgcggatcacgtcgatgagccagtcatccctgtgccagatgttcaggatgacccgataaaggcaccagctgctatagaggacattcctgcggacacaggcgcagaggctgctgaggacgcgcatgagggatttccgggtggtccgagcgacccatccgtgttgaccctgtatgcggatcacgttgcttgctgtgtgtggacgggagaggagcgtcctgaattgaagctatcctctcatgggaggaagggacttttgttcgcgtttgtggagcggtggcaccaggagacgtctagtttccatctcccggtgggagaactcatcatcacattggacgacgtctcctcgcttctccatctttccgttattggcgacttacacgcttttgagcccttgcacgtggacgatgcggttcagatgctggtggacttattgatggtctctccagagtctgctagggccgagacagcccagtgttgcggaccgtacgtacgcctgcaacgggtacgtgatatatacgagcgccgatgccagacaggtcattggacagctgcggctcgcgcatatcttcttcaccttctgggttgcactctgtttgctaacaagagtgcaaccaatgtccatgttgtctacttggaggcccttcgtgacctcagtatgacggagatgtacgcttggggagtggctgctttggtgcatatgtacgaccagctgaacgatgcatctatgagccacagccaacaactcgggtgctggatttacgagcactttccgtcggtcgcggactccactgctgataaggagtatgacgaggattctccgcgtgcgtgtaggtggattgcgaccaagaagaccgtgaagagcattcgtacgctgacgtacagggagcgcctagaccgaatccggattccggatgtcctggacttccacgtcagatcatgctattccggtctcttgcgctgggggcctgttgttgtttattaccaaccggagagggtcgtgcgggagtttggctacacgcaaaccattcctgctcctcatgtcgattcatgggtctcgtatgatgatatacacggcaggtggatgcactacgaggatcatatcgttccaacaggtgaggccccgcagacggatatccctcgcgtgccggagccagaagcatcgttgacatctgcggtggagcctagacatgtagtggaagtttgtgatgacattgctgagaggttggagcgccatctgagtctaggggtggtcacgcctggctcatcgacacatgaggtgatcgaagaatgcctcaggttggtcaggagtgtgacacagaactatcttgtatatgttaggtctagacgcaggcggcgcacggatcaggagtag

SEQ ID NO: 19457 - DNA, 291 bp, Glycine max
  Peptide Sequence Number=SeqID_111142
atgaagtattcagagaagtttagaactgttattttttctactgtagttcctttattaaatagcaaagcctcaattttggacttgagagtggaatgtcaggatttggaaagatattctgtcatcaatcgatttgccaagttccatggacggggacaaaatgatggggcagagacctcatcatcttctgatgcaaataataatgctcaaaaatcgttccccctaaaatatgttactgcagttccattgcctaggaatctcccagacagggtacaatgtctttcacttggataa

SEQ ID NO: 19458 - DNA, 363 bp, Glycine max
  Peptide Sequence Number=SeqID_111143
atggttagaactagaggcttaggtcgtgccttaggtagggttataggtagagccctggggagagaggatgatcatcattcggatagtgcccatgttgctgaggatgagcctgtggtagttgcagacatagatgcacctggtgcagacgctggtcatgatgctgagggatttccaggtgggccacgtgacccatcagtgcttaccgagtatgctaaccatgttgcagaccgtcctgaattgaagttatcctcccatgggaggaaagtgcagaaatttggtaggcctgctcctgacgttgagggcctaggtactgccacaagactaagtcctttgatcacatgttcaatagacactagcgattga

SEQ ID NO: 19459 - DNA, 363 bp, Glycine max
  Peptide Sequence Number=SeqID_111144
gaccgtcctgaattgaagttatcctcccatgggaggaaagtgcagaaatttggtaggcctgctcctgaaattgagggcctaggtactgccacaagactaagtcctttgatcacatgttcaatagacactagcgattggagacttatatctgcgttcgtggagaggtggcacagagaaactagcagtttccatcttcctgtgggggaggttagcatcaccctggatgatgtggcgtctctgctttatcttcccattgttggcgccttccataccttcgagcctctgcacgtcgacgaggccgtgttgatgttggtgaagttactagaggtcttcggagaggaagccagggccgagacagcatag

SEQ ID NO: 19460 - DNA, 615 bp, Glycine max
  Peptide Sequence Number=SeqID_111145
atggcttgtttgcttgagggttgtaaccttcatggttgcatcaaacaagctctgaatatcattggcaaagatttctcgggctttattcctaaaggaacaacatggttccagaaaaagagaaagcagggccagcagaagccatttcagatcaatgataaagaccctaacggaaaaaaaggtagaggaaagcacgagttggcacacggacttgccgaaatcaagaaacaacacttggaacgtactcaggggaggacgatgaagctgccaggacaaatcgggcaagcttccggtgaaggggtggatcgcgcttttcacggcgatcctaaccctggtctcgccagagagaatggcggctggcgacggcggcgacagcggatggaacccgctttgatgccaagcgatgtacttggacaattgattggggcaagagatgaatctaaaggattggatgaaggaggagacacgggtttgggtcaagcttgttgctgtgcgaacaacgaattaatgattgaagctggtgcaacaaagggaatagaggaaacaatccgggatgggagttctgtgggcagagtagcattgttctcagctgaaggagaaggggctggtttcgaatga

SEQ ID NO: 19461 - DNA, 1113 bp, Glycine max
  Peptide Sequence Number=SeqID_111146
atgggtgagaaggatctgtggtttgaatttaagaaatggggggacgttagagaggtcttcattgcgaagaaaaaaaacagaagtggtcggaagtatggctttgttagattcaaaggagtggttgacatggggatgcttgaacgtcagctggacaacatgatcattgtcatggacaagatagcagaggatgagcagcgacagggcaaaaaggaaacagaacacacgttcaggaacaaaggactactgaaacaacacccacaacgaatgcaaccaccagtctcgtatgcgacagtggtggcgaaaggaaacaacaacacgaagaagagatggtttccaaggcacgcgattctaacgagatcaatctctcatttgacactgcagctgaatatacccatagaggaaactaaatggtacagtaatgcatgggttggaagattaaggaacctggtgctattcgataaaatggaagatgaaatcatgtgggttggaggagaagacatcatgccaaaatacctaggtgatgatatggtattactgacgggactcactgatacaagagctgaagaaatgtgcaaggagggagcttgttggggaatcccattacacgcatgggacaaggagaacatcaagaagattgtgtgggtggtaggggaaggagtggaggtggatgacgaggagtatacggttcatatggcagaggagacatgccacagtccagacaccaataaatggcgtatgaggagcatgatggggtcatcagaggaaattagctctgatgagagcgaaacggggctgccattatcggcaacctatgagtcatcggaaagcaagtttccgatgaatatcaacaatgaaaatggaggaaaactgggaggagctgctcgtgataagcaattgtccgacggacaatgccccacgcttggatccaagggtaataccctatgggtgctgacacaacgaccacaacaacccaggcatagggacgaaagctgtggacagagcgagacagcagggaacgctgatagtggtataagcaaacctatccaacaactacagtctggaggcaaggatacgaaacagacagcaaccagaggtcacaaggaagagacatga

SEQ ID NO: 19462 - DNA, 72 bp, Glycine max
  Peptide Sequence Number=SeqID_111147
atggcagttttcaaggcatacatccacaaagacacagacattgtgtattgtgcacaaatgccacatttatga

SEQ ID NO: 19463 - DNA, 747 bp, Glycine max
  Peptide Sequence Number=SeqID_111148
gatgttacaaacccaacattgaaatgggagggggaaaaggagaatgcctattacgacttgggtattgacacacgattattccttgaagttgtcgacctgatacacgatattgagtattctgttattttgcttaaaatgtggtggaaatgggttgatgttgattataaaagcttaagatatttgtccaacgatcaagacgctatggatttggcaaggggtgaacttactgggggtgaggagttgttcaatgaccaacaaattgtagagtttgaccatagtgtagatgatttgtttgattgggacaatgctatggcatttgatgacaacaatgagtcatccaggaagcaaaatgagcctacagtgaaaagcaaagtgagcaataaaggaaaatataatgcttctaaatacgaagatccttctattgaaaatcctggtcggtgtgatgaagacctagacgggattgacgatgacaatatgcctaaccaccccatgaggaaccttatacaaattttaaggagatgcacaatttggaggctagctatgaaactgatgagttgtacaatgatgttgaaagtagcaagaaacattgttgtagctgttggaactgagacacaagttgctgaatatgaaattccaacagcaggaaacaatgttgcaaatgctagatctgcagtaggaggactaggatctacaattccaataggaaacaatgttgcaatgcctactgaatctgatattccaacgtag

SEQ ID NO: 19464 - DNA, 789 bp, Glycine max
  Peptide Sequence Number=SeqID_111149
cgggctcacatgtcttcagacagtgatagcagcatctctaacggttccctgagatcccttcagttttttcctctaactgctccgatagagttcccaaacgtcagacagacagagaagggattgaagtctccacttgtactgtcttggtgcgattcctttttctctctccgtgaatattatatcacaaataccaacggtgaagaccgttttgggtttctgcgggaaaggaaaaagctacgatgcgaaaggtatttctctcagctcaaacatgttatcgaaattccaaatgatgagaatgctcggaattgggttgcgaacatggtgctcaaatttcatgacgatccaacgttgaatgagtccaagatcgtcgtttttctgagacagggagatgaagaaaagaaagatcctgagccaaaggggaaatcttttctcaccaacaacaccattacaaggaaacccacaaaattcatgaataaaaaacaacccaacggattggagttggctttgggtacacgtggtaagtctttctctgttgttgaagcttattgtttggcttctatagctttgatgcgaggtgctgatgcaaatccatcttcagtttctccaaatctttttgaaagtgttgcaccttcatgtgctttggctttctcatggaggttgttgcgcgaaagggtgccaaccagagttgttctatcacacagggaggctgttgtgtttcaaggggtagttccagatgttcagactgtcattcatcaaattcagggactgtcgggtctggttttgttataa

SEQ ID NO: 19465 - DNA, 315 bp, Glycine max
  Peptide Sequence Number=SeqID_111150
atgagagtgcttattgaatattcatactcaactttcaagaattctcaacctgaaaaatctaatggatcaaatcaacttagtgctatggcagatcttcaggtgttgatgaaagggatcacctattttgtcgtcgtttctgtcaacaaaaacttccaatcaaaaggagaagaaggagaaggggaggcggaggccaaggttagtgctaagggcagagtcaacgacgcggttggccatggtggcattgggttggatgacggtggtggcgtggggtttttttctgttggagaagggaaagaaggagaattgaatttttaa

SEQ ID NO: 19466 - DNA, 699 bp, Glycine max
  Peptide Sequence Number=SeqID_111151
atggaggctgcgataaggattaggcatcgaaaggagattgttgattctattcatcatggcttattggtattgaagtctgataaaaatgcttcaaatgctcagtctcgcatgcctagttatggaacacaggtgactgttcaaacagaatcagaaaagcaaattgacaagcttcgacgcaaggaggaaaaacgaaatagacggggagtagaacatgctggtgatggtgaattgtctgcactggatttctcatctttacatcaagcaagtgagaggaaaaaaatgtttgatgagatgattggttctggagataagttcgagtcaatagctgttactgctcttcctgaaggaactgtaaggaagcattttaaggggtatgaagaggttaatattcccccaaaaccaactgcaccattgaaacctggagaaaagctgattgaaatcagggagttagatgactttgcacaagctgcgttccgtgggtacaaatcacttaatcgcattcagagcaggatttttccaactgtttatggaactaatgagaatattttagtgtgtgctcccacaggagcgggcaaaactaacatagctatggtttccattttacacgagaataagcgagggaaatggtataagggggataacgtgactgaggaggcagagagaagatttttggaggtaggaagctcagctctcgcctga

SEQ ID NO: 19467 - DNA, 375 bp, Glycine max
  Peptide Sequence Number=SeqID_111152
atgaaaggagaccctgtgaatgtatttaaagaccctgcaccactcataatagaagtggtcaggtcgtggaagagttggggtattcttccttcattgggcagactgtatgtgtcaaggtttgagaagagtttgggcatttggggagacttgttaaatcctacttatggtgttaacgagcaagccattgttcccagtggcaggcttcatcagattacccttgataaaggaaagcttctagaaggaaaaaatgactcaattgagacagctcagcagaggggaatatttgtcaaatctaccatatccactatgggtaacagaaagagtgtgagagagagaaaacccaactctaggtgggtggattatgtaaccaactaa

SEQ ID NO: 19468 - DNA, 405 bp, Glycine max
  Peptide Sequence Number=SeqID_111153
atgaaatatagcctcactacgtgggagagagcacacttgaccctcttaaccaaggggacattcatgtcctttactgcatacttgatcactttggctctaggtagagccaagttgggggatgctcctgctgaagttccagaaaagaaagccaaagaaaaatatatagcacctcacttgagagctcgtgctggcaatgaacctgaagaacatactcaaattcgaatacgtgtgcgaggccttcttaacaggctttctgaatctaatgttgagtcaattactggggaattgtccttgatctttcagatcttgactgaggaagtcttggcatcatgttctagtggtcctcgtggcaatcaacagttaaggatttttgccttactattttactcttacctccctcagtga

SEQ ID NO: 19469 - DNA, 396 bp, Glycine max
  Peptide Sequence Number=SeqID_111154
atgtgtacatttagtgtctttgtaagtattcccccctccctcaccgtgagcaacctcttgtcaaatccggtaagaacatttgacacccatcgtgagacgagggaaaacttttccttcgaccacattatcatcaatgctgcaaatggtgacaacacctctgtagccaaccagagactaccaccactggggcaggcggccaacttgtttggcatgcccgccataggaacccctgaaaatgagatcccaacaaccatggtgaagatcctgtgtcaggtgcttaacgatcattccttgatcgtcatcttgcaaaaagagatgaatgccatgaagcaacagaatactcaagaggtggaatacctccaaaaggagaatgttgtccttcgggaacaatactag

SEQ ID NO: 19470 - DNA, 300 bp, Glycine max
  Peptide Sequence Number=SeqID_111155
atggagatggctgtaaagtttttacaagatctagaagatatcagcatccacccggaccgagaagacaagtggatttggaaggaagatgcatcaggtgtctattcagcagggagcgggtacaagaagcttatgtcaacccaaactgatgaaaatcaggatggtgtttttattgagttatggaagcaaaatactgccactctggtgggaattagtatcgtggacaaacacttcaggaccacttctacagctcccaataatgcatttcctccagcacgtggtttggaatcaaaatggctctag

SEQ ID NO: 19471 - DNA, 555 bp, Glycine max
  Peptide Sequence Number=SeqID_111156
atgtcatatattgacttgatgaaggtgattaagtctatcgggtacaaagcattcaagtgcttatggtacaggcaccccctaaaagcactttgtagagggtcgaagcaacttaattgtgactctgatattttgcaattggctgaagatgtttctaggttaatgtggttgaagttggaggttgaatcagttgtggagggtgaagatgaggctgaggttgaggtggaggctgaggttcagctttatgaggaaggtttggtggaggttgttgttgagggtgtggatgatgatgatgtgggggctgaagaaactcatgatgatgataatattggggctgatgaagatgataatgatagcagcgactgtagtgaagtttcagatagtgactttgaagaaagctcggattggactttggatactccatctggaagtgaagatgaaggtcccccaaaagttagatttccttgttttaaggtgcctgaaaatgatgaagatatgaagtttgatgttgggttacaattcagtagtaagaaacaaattctagaggaggctttgtaa

SEQ ID NO: 19472 - DNA, 736 bp, Glycine max
  Peptide Sequence Number=SeqID_111157
atgaaggtatcggtgttcttgggcttgaaccagtactttgttgcttcagatgttggccatggcaagatgcggtggtatgctttccatggggaacccccttcaagtgaccctttcccaaaaggtgatgcagcacatccaatgcaaccaaatcttggtcaaggagggtgtatggcaatagaggcctctgattttgtgccaaaagttgtggatttagcagccagagaattaatagcaattgcatcaccgggacaaggtttaatctggcttgaccatgccaagacatccacggagtctgcagttgtaatgaatttagagtccagatgtctaggaattcgtcctggagttatggatggggccatcagtatatctgctgttcagaagcacggatctacggaagatttctcaagccttccttacatttgcacattgcttaattgttccttatggacttactatggaatcataaaggctagagagtacctcgtggctactgccgatggctttggcattgtggtggagacaatctatgttattctatttctcatatatgctccaaaagggataagggtgtgtagtagaactgtcattttggttgtgattttggatgtggcaatttcgacaatagcagtagttactactcaattagcattgcaaagagaagctcgtggtggtgttgttggtgttatgggagcaggcttaaacattgttatgtatttctcacctctctcttgccatg

SEQ ID NO: 19473 - DNA, 1629 bp, Glycine max
  Peptide Sequence Number=SeqID_111158
atgagattccgcattgcattgtttctctttttggcttctcttcaagccactttaagtcaagatattgaacatggttcacttctagtagatggagctcagactaaggctgaaacaggtgataactttatttgtgccactattgattggtggcctcatgataagtgtgactataaccattgcccttggggatattcttctgttgtaaatttggacttgtctcatcctttcctagccaaggcaatccaagccctcaagccattgaggataagacttggaggttctttgcaagaccgggtgctgtatgatgtaggaagtttgaagtctccttgccatccccttcaaagtgttaaaggtgaattgtttggattttcaaaaggatgtttacacatgaaaaggtgggatgagctgaatcagtttttcaacgagacaggggccattgtgacatttggcttgaatttactccatgggaagcaccagattagtcataatgtttgggaaggcgcctgggaccctacaaatgcttataattttatagagtacactatttcaaagggatacaagattgattcatgggaacttggtaatgagttgagtggtaagggcattggtgcaagtgttggtgttgcacaatatgggaaagacttgataaagcttaaacaaattctaagcacattatacgagaactccaatttcaagccttcacttgtggcacctgggggattttatgaaaagcattggtatgacaggcttcttcaggtttcgggttcaggcataatcaatgttctgactcatcatatatataatttgggcccaggtagtgacgagcatcttgaaaggaagattctagatcctgaacgcttgagcagggtggaatcaattttcagcaatctttcagaaaccattcaaaaatatggtccttggtgttctgcatgggttggagaagctggaggggcatacaacagtggtggcaatgatgtttctaacagatttctaaacagcttttggtacttagatcaacttggaatggcatccagctacagcactaaagtctattgcaggcagactttaattggaggaaactatggccttctcaataccaccacctttgctcccaatcctgactactacaggcaattaatggggaagaaggttcttgcagtttcaagtgatgtttcttcaccctttttacgcacttatgcccattgtgcaaaggacagagcaggtgtaacgttacttctgatcaacctaagcaatcagactgatttcatactcactgttcgaaacccggtgactgcaagtgttgtagaaaatgaagtggccacaggcacccataaggaaagttcattctttgataaactcaagaaaacattttcttgggttggaacaaaagggtcagaggtcacattcagagaagagtaccacttgactccaaaagatggttacctcagaagccaaaccatggtgctgaatggcattccattggagttaacagacgaaggagatcttccacggttggatccagtgcgcaataacttgcgatctccaatatacatgactcctttgtccattgcatttgttgtataccctaactttgatgctccagcttgtgctactcacagaaaactttag

SEQ ID NO: 19474 - DNA, 297 bp, Glycine max
  Peptide Sequence Number=SeqID_111159
atgggcagagctgattttcgaggtctcaaaaaaggctacctatggaaagttctgatcgatggagggagaaaagattgttgtcgcgctattgttgaagaaggagatggcctcgacggagttgtcatggacccaccagatgcggagatagttgccggaggtgacaagaagatcaaacacggagattggggattttgttcttcacgagaaagggaaagagaaaaaaaataccgagatgcacatgtccaacttttagaagtgatacataagacacataggttcagatttgtccaaacttaa

SEQ ID NO: 19475 - DNA, 2787 bp, Glycine max
  Peptide Sequence Number=SeqID_111160
atgtctacattcaatcctatggcctcttgcaatcctcgggccatgactattggttccacagctggctcatccagcaactggtatcctgactcaggtcctgaccaggttgttgtaggcaatggtcaaggtttgcctactcactctactggctccactttcccttttaatagaagtactagtctcatgcttcataaactcttgaatattcctactatttccaaaattctactcagtgtctcccatgagattcttctcaaaggtcatctagggtctgatggattgtatacattcccttgcatgctgtcttcttcaagtgcttttacctccatcttatttaggaatatgtctttgaattctgttttaccttcttcctctgaacaagctgattattctcttgtcagatctgcttctcttaattccattacagcaagcacttggcgctctagattagggcatccaagtgctgattctgagaatgaccacatctaccactctgaactctttacgctgacaaagcgaatggctaggggtgaaccttacaagctttccttcaccgtaccaatatttgaaccacatccaccacaatattacattcatgctatttctgattcttggcttcatgccgaggcattctacactattacttttcacaatttaccattgccagaggctcgtactgctcacacagaactccttgatttaaaaccgcttcccatgtcttcccttggcaacagtacttatgaagcattatataaattttcacattttaatcctatacaaacacagacttttcatgtcctgtatcacacggacaataatgttctgttaggagctccaactggaagtggaaaaactatatctgctgagcttgccatgcttcgtctttttaatactcagcctgatatgaaggttatttatatagctcctttgaaagctattgtcagggaaagaatgagtgattggcaaaagcgtcttgtctctcagctagggaaaaagatggttgaaatgactggagactatactcctgatttgacggctctcttgtcggccaatatcatcatatctactcctgaaaagtgggatggaataagtcgtaattggcatagccgtagctatgtcacaaaggttggacttatgatattggatgagattcacttattgggggctgatcgtggacccattcttgaggttattgtttctaggatgagatacatatcatcccaaacagaacgtgcagtacggtttgtaggtctttctacagctctggctaatgctggtgatctagctgattggttaggcgttgaggaaattggactcttcaatttcaagccaagtgtgaggcctgtacccctggaagttcatattcaggcaagtggatttggtgttccacatagatcatgccttaacatgtccatttctttgtctatttattatataaaaaggggttatcctggaaaatattactgcccaaggatgaatagcatgaataaaccagcatatgctgcaatatgcacacattcacctgcaaaaccagttcttatatttgtctcatcacgacgccagacaagacttactgcacttgacctaattcagtttgctgcatcagatgaacaatccagacaattccttaatttgccagaagaaaccctacagatggttctgtctcaagtctctgacctaaacctaaggcatactttacaatttggcattggattacatcatgcaggcctgaatgacaaagacagatctctgatattggtttgtaccagcacattggcttggggtgtgaatcttccagctcatctagtgattatcaaggggacagaatactatgatggaaaagcaaagaggtatgttgattttccaatcactgatattttgcaaatgatgggtcgtgctggacggcctcaatttgatcaacatgggaaagctgtgattcttgttcatgaacccaagaagagcttctataaaaagttcttgtatgaacccttcccggttgagagtagtttgagagagcagttgcatgatcacattaatgccgaaattatttctggaaccatttgccataaacaagatgcagtccattatcttacatggacttacttatttcgtagactgatggttaatcctgcttactatggattggaggatgctgaatctgaatttctaaatacatatttgtccagcctagtacagaccacatttgaggatttggaagacagtggatgcataaagatggatgaagacaaggtggagcccatgatgttgggtacaattgcatctcagtattacctcagctacatgactgtatcaatgtttggttcaaacataggtccagatacatcacttgaaatgaggcttctctcccttgcccttggtgccaacctagtttggattaagggagtctttttgcatattttatctgctgcttctgaatttgatgaactacctgtgcgtcataatgaggaaaaatacaatgaagcactgtctgagaaagttaaatatccagtggataagaaccgtctagatgaccctcacatcaaagcacttcttctatttcaggctcatttttctcaattggagttaccaattagtgactatgtcacagacttgaaatcagtattagatcagagtatacgcgtaattcaggccatgattgatatttgtgcaaacagtgggtggctttcaagctcaattacttgcatgcatcttctgcaaatggtcatgcaggtattcattccgatttgttctgcagctgatctgtcttctttcatggccattggatag

SEQ ID NO: 19476 - DNA, 1311 bp, Glycine max
  Peptide Sequence Number=SeqID_111161
atggaggttgaaggtatttcttatttagactcatctttgaacagtgataattgtgaagagcaatctgcacgcagagatgcagtaggtgaaacacaattggataagcaaccttctgcagaaaattcaaatgaatccgaagcaaatcgagatgataaatctgatgagacttttcttaataactcaattcagagttctaatattatggctgaaaatatttcctgccaagatttaggcaaggcttcagtactggatggaacttgtgatgttgatgtttttgatggcatggagagatgtcctgaaaagagttttgaagatggagatcaagaaatacgggatttgaaaaaaatttcaacaacagaagcagatgacaaccagtctgttaatctggttgaagtcaatggacattgttctaatcaagttgattttcttcgatttgaggtgagcccatacactggaaggatccacttgtatacttgcattttgggtactgataaaagaccacagccacttcatgaaaattttcgaccagaggaacttgagttgttaagttctgttgctgatgatgagaaacaggctcatgatgagaaacagaaaacagagtttgtaactgtgaaggacaaccccgcatataggcatgctcttatggcttttgcagaagagtggaagaacttgaggtcaattgaacgcaggaagttacttggaaaaccattacaacttcctttggctgttgaattatgctacttgagtgaaagcaataaccacaacaacaagggattattaaatggtggaagtaaaagacgcaggacgcccttaatggagattagctatcctttaccatcagatgctgtttggagaaaggtatctctgcgaagtggccttggtaaaaaggaaaaagaatacactcaaggctggagtgtgacagatgagccactctgtaagctttgtcaaaagcagtgcctggctaacaatgccaagacacctgaattttttgaagatcttttttgtaaccttgtctgctatgaggagtatcgaatgagaactagcaacagattcctccgtgaggaacttttcaaaattgaacatggagtgtgcacaaattgccaattcgactgtcataagctcgttgaggatataagacctttgtcattggaaaggcggcgtgagtacatagagaaagtagcaccgaaagttgctaaacggaagaaaatgtttgagaagcttgtcaatgaaccaactgaaggcaatgcatggcatgctgaccatattgttccagtatatgacggaggaggtagaattcattttaaagtttaa

SEQ ID NO: 19477 - DNA, 999 bp, Glycine max
  Peptide Sequence Number=SeqID_111162
atggaactcaccgaagaacaacgacgccaggtagaagcaaaccgcgccgcagcgatcgcaaaacgcaaagcattccttgaatctagagaagaagaacaacaacaacaaaagaatcccgaaggagaaaacaacagcaacaccaacccgaacccatggaaccttttcaagtgccaaaagttccccctttcccccaaaccccaacccccaaaattcctcgccagactcgaaatatgctcccccgattccttctccataacgccccttcctctctcttccttccctttccctggtcaccaacattgcctcaacactctaagctccactctctcacaacaacatgtggtgccttcgcattacacgcagactagtgagggcgagaaggtgtgcgtgttcaagctggcggagtaccgcgccgtgctgaagcagctaaaggccgcggcggcggcggaggtgctgctggtggaggagatcccctgggcgacgttcaacgtcgtggagtgcctctcgcgttccttcgcggctgggcggtgggcgcccgtgcggccggagcacctgcccgacgacgaggtggaccgcctgatcgggaggcttccgaggacgctcttggaaaggttgctgcctttccagcatgatgggctgagattcgcgttgagaagaggtgcaaggtgcctcattgccgatgatatgggcctcgggaagacgctacaggctattgctattgcagggtgttttgtggaggaagggtctatacttgtggtttgtccggctgtgttgcggtattcttgggcggaggaattggagcgctggcttccttcctgcttgccggctgatgtccatctcgattatgttaatggaagtgttgtgttgaatcttttcataggatgcacaatgaaaagatatgcgtcttcggaagatgcacatgctaaagttggtttgggattgggagatttgaattataagagaaaatatggttttgcgtttggttcttgtaagaaatag

SEQ ID NO: 19478 - DNA, 783 bp, Glycine max
  Peptide Sequence Number=SeqID_111163
atgttgtggattactctcacttcatcttcattcacatcaccaaaatcaaaggtggaaattaaggaaaagtttcaaagaatggattataggctcaaccaaagaagagtgtccttttctgatccaaattcacgacaacacataccagatgatgagcgtgtaactgcagttgcagctgctgcattttccattcattcactagaagaagcagggttacttaatttgcagaaaatgaaagaatctcccaaatttccaaggaccaaaactgtgagagaaaaagagtggaaagtatctaggcaaccaagtcatggggaaatttcaacaagaaggtcattgggacaagaactcgctagagcaacagaaagtgctattcctgctagacgcccaagtggtgtatccccggcagcagggtatcaaaatcacaaagggaatcaagtaatacaacacaaaaatgacaaggcaacactatgggaaaaggccaagatagagaggattcaaaagaggtatgagaagacaaagtccaaaatccttgcttgggagagttatagaaagattcaagccaaaatgcagatggacaggaagaagagtgaatgggagcacaaaagggcaatagaaatgcaacattacaagaacaagatagcaaggatagatatgatagcacaaggagcaatatcacagttggaagaccacaaaagaaaacaagagtccaaagcaaaggaaaaagcaaagaaaatcagaaaaacaggaagggtccctgtcaaatgtttctgcttcaaatctttatag

SEQ ID NO: 19479 - DNA, 311 bp, Glycine max
  Peptide Sequence Number=SeqID_111164
ctgccgcttgggtcgaggtgaaagtgttatgggtcggtggtgattattgcggtggttggttcatcatcagaggtacaccagatcaatggatgtatgatagtataatgtctgaagaagttgatatggatgatcaaaatgaagaagagtgtggtgtgtttggtacccgagataatgttttgcagtgggttcgatcagttgctcatgaaaacggatttgtggcggaagaaaagactttgttagaagagatactgggagtagaaaatgtgggtgtcccttcaagcttcgtgggaaaccagtggttggggggcaag

SEQ ID NO: 19480 - DNA, 1188 bp, Glycine max
  Peptide Sequence Number=SeqID_111165
aattatgaccggatttcagagctgatatgggagaatggccagctatccatccatgggcttggtgggcttcaacctactaaccctactcaggaaaagcccatatcaagtggggcccacgacacattggagtctatcgttcaacatgccacgttccaacgttatcaaccgtcaaaattcactagggaagaaggccatgcccctactagtaatagtaaaaacaacaactccattggtgcaccctattatggtggtgaggttcaaggtgtgctatcctcgacgaggaaaagaacatggtccaatgctaacaacagcatgttggaagaatgtgacatccttagtggttgtgctagtgctggtgctaccttttgtagggacaatgatacaaccatgatgacatgggtctctcttgatcagtctggtcgtagcttaaagactatggaggaagattctgcttgtcactgtggatcggaaattcgagacaaccaagatgacagagacagcaaagcagaagtaggccaaagcaactcaaaaagaagaagtcgaactgctgccattcataaccagtctgagcggaaaagaagagatagaattaatcagaagatgaaagccttgcagaggttggtgcctaatgcaaataagacagataaagcttcaatgttagatgaggtgataaactacttaaagcaactgcaagcacagatccaaatgatgaacatgacaagcatgccccaaatgatggtgcctttggccatgcaacagcagcttcagatgtcaatgctagcaagaatgggtgttgctgggcttggcatgggaatgggcatgaacatggcagcagcagcccaaacagcaggtggcccaattaggtcactcccccaattcattcaaccaacaacaactacagtttgtgctccaccacctgccactgcccctgtgtttgttgccccttccttcatgatgccaccttccatgatccaagcacctccaaagccccaacaattacctgcatcctcagcctccattgcctcaattcatttgcctcatccatatagtgctgctggtctcacccaaccaattaacatggatatcctcagcaacatggcagcactttatcaacaacagataagtcaaaacaatcatcaggccctgagcagcagcatgccccaaccacaccatgagcaaggccgttga

SEQ ID NO: 19481 - DNA, 1479 bp, Glycine max
  Peptide Sequence Number=SeqID_111166
atgacaaaagacttgctggtattctactgcattggaacttttgagtcagcatgttcatcaacgctctcagccactgcggcaacgtcaggggcgccattcactgttccacaaagccaataccttcacaaaggacactgcgtgtattcctgcaatgccatattgggtgtcctcgtgagggccaactgtgtcaacattgccaaggccatctacgatcaggttctcacaaaagcaatattgaaacctgatgtttacacttatactaccatgatttgtgggttatgcaaagtgggcatggtcgagagtgcatgcaaggtgttcgaggaaattccctgtgaacccaacatggttacttacaacacgttggtccacgagttttgtaagaaaggtgatatggagggtgccacaagggtttttgatagactggttgagagtaagagttgcaagccgggagatgatggaaggtgttccccgaatgttgtgacctacaatgctttgattgaagatcttcgtttgagcggtgaagcggacgaggccaggaagatgatgagtaggatgcggttgaatggtttgaaagaagacgttgccaacaacactagcttgtcgaaggggttttgcattatggggaatgtggaagcaatgttttccaagtttattttgatgatgccaaagacccaagtcaagaatcaagagttaaacaaagggtacatctacttgggttgtaatactgagaacaagagaggatacatctcttgtggatcggttcaagtggagggtacatccacttggttgttcaaagagaataagggagggtacatcccttgtggatctttgcttgtaaaggattttacaaggttattggaaatctcaagaaccggtggttgcttggggactggacgtaggcacgggttattgccgaaccggccacttgttcgaatagggaagtctgatgagactgttgagcatttgagggaaatggttagtcgcgggatgaggccagatgtgaaagcgtatcgggttgtcgttgtcaatgagtattgcaagattagaaaaccaagtgaagcagtgttgcttctgagggaaatggtggtgaggggttttaagccaagtatgtcaagctttaatgcagtgtttagagttcttgtggatgaggggaagcttgataaaagagttcttcttttgaagcagatgcctaagatgggatgctcgcccaacttcttattttattgcacagtgatatgtggtctttgtaaagtgaatggtaggatgcaacaagttgaagagctcattccggatatgcttcagaataggcataacctggatgccactatgtataattgcttacttgcgggatattgtgaagatggggatgaagaaatgacaccaaagacaggaaaattgaaagatgcaaaaatagtatctgaggagatgtgcaggagatgccagttgaatgggaaagttgaggcaacgaaggaacattaa

SEQ ID NO: 19482 - DNA, 237 bp, Glycine max
  Peptide Sequence Number=SeqID_111167
atggcatcggtgcttccgacagcagaagcggcgggcgctggagcaggaacagaggcggtggcgcataggtgtctgtttccgacatgggtatggaagacggtgcttgttagtgttggggttgtgtggaggtcgagggagggtgggttagagaatgctatggcgttgttaggtttctttctttcaatgcttttgaatgccaagggacacaaccttttgtggataagaccaatgagataa

SEQ ID NO: 19483 - DNA, 555 bp, Glycine max
  Peptide Sequence Number=SeqID_111168
atgtggcttcatgtgaggttggttaggttagagcctcatcaaccttatctacctagttctcagcagcaaaaattgcagtggactcagccacttttcgtgctccagcaatcacaacaactgtttcaaaaccatcttgttgggtctagtcttttctacctatgcttcagcctttctcttagcagcagcttgccgtctagcttctgcatcaactttgtacttaacttcagtggccaattttgctttccaggctacttcatactgagcactatctgctatctacaactcatgaaagtgttggacctgaacttccaattcctatatgctcatctttttgaggttgaagacatgatgattgaagatgatgggcagcttcttctgatgctcgatgaggttgtcctcatggttcttcacagaacaagtgtttgcatcgtcaaagtggtataccttggttggacgcaatacttgaatagaatccctttggttgctagaaggcacatgttcatagttggaagggtctacacttttggcgtctttccacacggtatgattctatga

SEQ ID NO: 19484 - DNA, 1167 bp, Glycine max
  Peptide Sequence Number=SeqID_111169
atggataataataacaacaactccgggtttgttccgaataatgatactgatgatgactgtacatttctccaaaccttgttggaaatggacccccaacatttctatttacccactgaagaattcgattcactgtcccaacaacagcaacaaaaaaatgatccttttggcgttgaaaagggtaataaagtttccttcctgcagggaaataataataacgattttcccattggagaaggagtagttcctgatgttgttgatgtggaggaggaagagggtccaccgaggggggcgggtaaggaactgatccccgaaggccaaggtgatcgattcttcatacatggcgatgatatttttttctttggagaaggaggagttggtaataacgtggatcccccacaagagaatcaaactcagccaccaaataaccaagatgtgaggtcactttgtccttggcccccaccaccagagccattctcttgcagttgctgtgaagttcttagacaaataaattacaccaatggtgttaggtttgacaagcttgagattcatggaacagtcggggtgattaaccacgcaatatgccacgttgaggataagacatcgaatcgtcctccaagggacacttatcaaataatcgatttctgcaataaaaacacagaagaaataaggaatttcctaaatgtttactgtaaagagaggattgaagcagggttcattcccatagaagatccgtcgatgtctgccttttatgatgccctctgcactggaatggattggactgaagtttccaatgacgtagacgatgatttggcaaatggcacggagcaagagtcggagtctgaacctgaggctgggaatggaagaagggcttcaacttctaggcctagacgacgtgatatggcagttcagaggcagagagtaccaaggatgacattgagtgatttgagcggtgtcttccatttgactattagtgctgcagcggttaaactggacgtgcaaagccttgccaagaaggtcagagtactcgttagagcattgaattcgcctgatccaggggtgaagcgaagaactcaagatgaaattcgaagacttcagaaagaaataattgagaattgtggtggaattaccccaaccggaataccgatgctccaattcgatgaagaatga

SEQ ID NO: 19485 - DNA, 114 bp, Glycine max
  Peptide Sequence Number=SeqID_111170
atgagaactgtttggggggatacgagggaaaggtttagaattggaggtgttgatgaagaagaaggtttggctatggcttccggaatggctgagtggccattggcagcaaactaa

SEQ ID NO: 19486 - DNA, 936 bp, Glycine max
  Peptide Sequence Number=SeqID_111171
atggtgttagttgaaagcttgtcgtcgagggaatcggttggagatgagtctgaggaggcatctcgtgttgatggaaaagtgttcgcctcccccaatcaatcttccatagtatacgtgggtcgaaggagagacgtgctcgatcactctccatgtggttcaatcaaacgccactctgcctgtggagttcatgttcatgaaccaggaggggatgaactaagacttcttctacatccatctacaggagaaggcttggttggtatcactgatccggctaccgaagctagcgatgacataaattccatgtgccaggccaggcgagctcgaattgtcgttgttggtggaccttcccaactattgccaccaacccgacgcctagatcttgtgaggttctggcatatgtggtgcctctcgtcggcaaagatcccaaggggaaacaaaaacataagaagcaaagccaccgagaacattggagcgtttgcttcttgtatacgaggtaaaacttcagcggaggacttggctcctctggatttagagattgaggcaacctgtagaagaaataacacagctagagaaagaagggagctacaagaaaggtcagctgaccaaggcgacagaaggattctatcctctgaatcatcttcttcaatcccaaccaacttggaggagccagtgttgtctacctttgaggcaactattatggcagaagacataccactaagggtgacccttgaggactattccagttcctccatgcctcaattcttcactagcattgctcggccagatgttcaagcaaccaatgtttcatatccacactccctgattcagctcatccaaggaaacctcttccatggcctaccaaacgaagacccatatgctcacctagccacttatattgaaatatgcaatacgatgaagatagagggagtcccataa

SEQ ID NO: 19487 - DNA, 2823 bp, Glycine max
  Peptide Sequence Number=SeqID_111172
atggcattaatgggcatgagtgcaaacaggcaatgcaatagctatttcccaggatatcattccccaaggtatcttgtttttggtgccgaaggaagcacatgtacctcatctaatggtaacagtgaacgtgagaatgactgttaccaacttggttccttgccattgtcatctgcctgtcatcttttaggatacaacaaggaacttctgaaacaaacaatactccagcatgaagcgatatttagggaccaaattcaagagcttcaccgcatttaccagaaacaaaaggaattaatggatgaaattaaaaggattgaactccataaacgtagtttaaggttggagacatcattgtcaagttcctctttgtattactcacaaaacatgccttggttgactagtcaatcatctgttttaaatgccgagctcatccaattaccattggcttctatgcaagaaaagagcagggaattatgtcctactcctcttgctgttcctgctccaactgcaatcaaagaatctttagaagatactaaactatcagggttgacttgcagaaaagttggtaagaaaatactggatcttcaacttccagctgatgagtacattgatagtgaaggtgaatcttgtgagaatgaaagggttatcaaacagcccccactgtcaacttatacttcaaatggaatttctaaggttgtgtataacactgttgagaaaccatatagaatcaattctaatggttttgctgacttaaatttaccatttaagcttcaaaaagagacaggtgtggagtctgatgattttggggcctcaatccctcacagaaaccatacatttcatggtatgcttgggagaatgacatcgggttctcataattttcccaatgatgtcatcccgaatttgaaaagaagacaggatcatgaagcttacccagatctcccactaccaaatcaagggcagaaacatggatggctgccctcagggcaaaatggcagtaacttgggttttcttgctaaatttaatgatatggaaagccaatctgtttcaattgatttcataagtaagaagctgaaacaagttaacaattgtccatgttttcattcgacatctcaaattgtcccaggatctagaaccaagagccctgcaggaactcatgatcccaccagtggtggtttgcttggaccaagctatgcttcatgcacatgtgctcctcacaagcttgtttctgattctgatatgaaaagttctggtatttcaccatcagtgttatggaaaagtactacatctggccctaatttagatcgtcgaaactatctaccaccaattagtgctggtgatctaaacagcggtgacaactttggttcatcatcagctggccatgagcttaggaagtatgttaaggattcggaatatgtggggactcacaagagcataaacctgaatattatgcctactggttgttttgatacaacagctgcatcatttcaaagcgttcagattacaggtgaagaagataagtttcaagattcaagattgccttggctgaaagccaagcctgtacctaaaggaaagcccaatgaagaaagtcaaacctcaacccaagttgactccttccttttgaatccttataaatctgggtgcatgcattctgatttgatgttcagtaaggttgaaaaaagtgacttttgtacagacaagactcttgcatttgaccttaatggaaagcctcagacatccaaagtcttccagagcctgttcaagaatcattggattgaagaaattaagatatccaatgtaaattcactttgtgatagtgatcctgacatgggggaacaggcacctgccatcgaacatttcatgaagaatgagaagaaacacaagcatttggcaggtattcttgacctaaattcatgcatgaacgaggatgagaatatgccaattgatattgatttacaagcacctgtaagtccagaaaacaaggagtgttctccacccagaggagaatctgatgaaaaccagcttgagatgctcttgcaattggcagggcaggagcaggagcaggaacaggaacaggagcaggatctggaagaacaagaagaccaaaccggaattgcagctgaggctttggtttccatatcaaaaactgtggcctatgatgacctccaaatgacaacttgtccatcatctgaatcttctgtaagtagttctctccattggttttctggaattgtttctacaatagtggatcattcacagtgtgaggttaaggaggatttcaattgtaccattaaagatcttgaggactttctgcctgctgactttgattactttgagttcatgtccttgaatttaaccgagacaaaggacctagattatggctgctataagagtagtggcccaaatgagcaagaaggtggatctacttcaccaattcaaccaagaaagtgccgaacaaacaggaggcggcacggaaacgacttccaaagtgaaattctcccgagtcttgcttctctgtcacgatatgaggtgaccgaagatcttcaaaccatcggaggtctcgtggaagctgccagaagaactcattcagcaacaggttgcctaagaagcgctggcagaaatgcattggctaaggggaagagaaggtcttgtgcttcagcctctaacaacatcacagacttgctgttgaacttgaaggaagtaaatattgacactgaaattgccattgagaaaatgggattcataagttggggaaagatttgtagaaagccaagggggaagagagttcctaccaggaaacacttaatttttagccaagtacataactaa

SEQ ID NO: 19488 - DNA, 807 bp, Glycine max
  Peptide Sequence Number=SeqID_111173
atggctcgcattcctgataaaattaaagacatcaatggattaaaagaaactcttaaacttgctgtcaggataactgacctttggtttgttgggacgcccgacaagtctgaacaagctgagatgattatagtggactcgaatgtggtcttccagcatgtttcatcaaggagtacaagggttgtttttaaactgaaggatttgagtgaccaattactatcttgcactctatgggaagattattgcttgcagttcttggagtacttaaataaatgtcaaagtgatgaccccataattgttctgttgacccatgctagaattaaagaagcgcagggatcatatccaccgtcagtaagtaattctttgaaggcttcaaagttacttattaatcaacctatggccaaaattcaagaattcaaacacaggtatagacttgaggtgatggtcagccacaaggaggaaagcaccaaatttcttctcttggaccgtgaatgcgctgagttaattggacaatcaactgatgaagtgaataagttaaaaatagcagatggtgatgtcgatataaatgcatcaccagaagcacttgataagttgctcggttatgtgcttgcctttaaagtcaaggttcaaccaaagtttaggaatgttgttgttctaaaatactcacgtgacttaactttgattaacactataattgagttactgcctaatgctgagtcagtgactggtgtatcttttatgcaacaatccctgtctggaacagcagaccatgatccgcttctcggactcctcttaacaccaacaaaatga

SEQ ID NO: 19489 - DNA, 495 bp, Glycine max
  Peptide Sequence Number=SeqID_111174
atgtatatgtatggtgcggttagaggtcatttgtttgtgatgttgaaaattttgcatgtgttgttatggatgtatgacagtataatgtctaaagaagatgatacgaatgatgaaaatgaagatgaagctggtgtgaatgaagaagagcatgttgattgttctgatgcgttcaatacttttcagatgtttgctacccgagatgatgttttacagtgggctcgatcagtctcttatgaaattggatttgtggcgatgattataaggtcggacataaacactagtatgagaggaaggacttcatttgtgttaattggttgtgaaaggagtggtcagtataggcctaggaagaaagattttgttagaagagatactagcagtaggaaacgtgggtgtccctttaagctttgtgggaaaccagtggttggagggcaatgttggatggtgaagttaatgtgtggaagtcacaatcatgaattcgccaagtcattagtttga

SEQ ID NO: 19490 - DNA, 339 bp, Glycine max
  Peptide Sequence Number=SeqID_111175
atgaaggaggtttctgatgagaatcatgaaactggccaaatacaggctaaaggcccgagtggagaaggacaaagcccccgagtggagaaggatgaaggcccaaataatccttgtggcgtctaccctgacttatcttccttcactggaagtggcgtctacccagacttatcttccttcactggaagtggcgtctacccggacttatcttccttcaccggaagtggcgtctacccagacttatcttccttcaccggaagtggcgtctaccctaacttatcttccctctttggaagtggcgtcaaccaaaaactctacagcctgtatcaaacgatccacccc

SEQ ID NO: 19491 - DNA, 552 bp, Glycine max
  Peptide Sequence Number=SeqID_111176
atgaaagatctgtctgaaattgcacacggtggtcaatgtctcagcatatctgttatacagttgtggattctgcatatgactgagacaagtatgcgagccgggaatatcgatctgtatggattcctcgagccacaatctatccagagatctggccaatcacaatttgaatcagaaaattacattaagaactggatgcaaaattcaaaatgggatgtgtacctaggagcctacctgaatggtgcacattggcaaatggttgtcattttgcctaaggaaaatgttgtcatttggttttgttcgttgcataataagccagacaactacctcaaagacataattaataggtcagtgttgtttttcaatacatttgcattagcattggtcagtgctttgaaagggcttgacgatactcaacaaagtaaatccaagcctccagctaggtggattgttgttaaatatttcactgatcctagaccattggaaccagagagattgaaggcgcttcgcaaccagtggacaaagtactatttgaaagtgaaaaatgaaacttag

SEQ ID NO: 19492 - DNA, 893 bp, Glycine max
  Peptide Sequence Number=SeqID_111177
atggagggaagtgggtcagaattcagtgaagcaaagaccatttcttgggcaagaaaggtggaactacccatctttaacagaagcatagaagagggaactaatttgaagggtagtagttttaagtgtgacaaagaaaccaaaaatgatgaagcagaattagcaagagaaaaaaagattgaaaaggttatggaggaagaagtggatctattgataaaagggaaaaagcacaaggaaaatagattgacgaatgtgggttgcgaagacgattttcttgataacccaatttcaaatttgatcaagaatgaagtcaaatttgatatggatgacaactcgacattggagccaaggcagaagggaggtactgagacaatcatgatgattcaagttatacggagtccacccttatccccatcaccactgaagccgccagagctgagtttgcatgaagttgccagtaggttcacagttgatcccccatggaatgacgccaaagaggcacaccctgttagtgtaaatgattcaattctaaaggatgagaaagaggaagggggagttttggaattctgcaaaggaggtccaactttttacatagtgggtcctgcccaaatgggctatagaaatggaattcataagagaggagcaaaaacttggaattcaaactgggtggcaggatgtatactgctaaagttggatgtttgtgtgcttgatgacatgttaaaagagcataggtggaaagagattgaagcgcccacgaagaagtccaaaggtgcacttagcgcgacatccagcgctaagcgcatgatcgccttgctaagcccagatgtgccatgctcagcgtgtgatcagccgctaagccctgaaggggcgcacttagctcaaaggcaatgtaaaaa

SEQ ID NO: 19493 - DNA, 627 bp, Glycine max
  Peptide Sequence Number=SeqID_111178
atggaggccgcttgcaggaaacggcaaggagaagatgaagaagaaccgttttcgtatttgaggcaacagacaccgcgttgcaccggagtcgtacccgtttgtgtgttcggtgcgcctccgatgcaggatgtggcacttcagcggcgtcacgatctggaactcgacattgtcggtggagttggggtcggggagttcatcggtcttctcatagagctccttggccttgatgccttcgtggataaggagggtagcatcaccatcgtcgtcgacgatgagggtctcccccttccaggcaaagacagtggcattgtcacgggcaatagtgacggcggcgtggtcctgggtggagaagatgttggaggagcatcaacggacctcggcgctaagggcggtgagggtctcaatgagaacgacggtctagatggtcatgtggaaggaaccgaaaccaagagctgtcttggtaaaactacgatcccggttttgttaaccgttggattgtcggagaaaaaggaatcgcatgaagatagtccaaatggaggctttaatcctttctccgtttctctgacgtttgggaactctatcggagcagttggaggaaaaactggaggaatcttaaggaaccgttag

SEQ ID NO: 19494 - DNA, 513 bp, Glycine max
  Peptide Sequence Number=SeqID_111179
atggagctcgctgaagaagaagaagaggcactcctaggaagacggaggaagacacgggagaaaacggacgaagacgcgggagaaagaaacagcagctcgtgggagaaggaagaagacgcggatgaagtgcacttgtgtgttcctcttctccttctcctccatgaatctctcatcctcccatggtgtgttttgaatccatggctccttcgcgtacgtggtttcttctccgtgagtctcctctcttctgccgttatgagtagtgttgtgtcatcaacggatgttgagaatgtggataatgctgctaatgagcctcacaaggagcctcatgatccagttacaaaggatgaacgtattgagttgaagttggcttctcatggaagaaagttggagaaatttggaaggcctacacttgagattgaagacatcgtggttgctataggattaagttctctgattacatgtttattggagacaagtgacaagagacttttatctacttttgcggggaggtga

SEQ ID NO: 19495 - DNA, 90 bp, Glycine max
  Peptide Sequence Number=SeqID_111180
atgatgacatttcccgtgcttttcagagctcctcctcagattgctctgtttgatttgggaagaacacctgttttgatgtgtgttgtctaa

SEQ ID NO: 19496 - DNA, 597 bp, Glycine max
  Peptide Sequence Number=SeqID_111181
atggaaatgatttccaagagatttgaagagcttgatgtttatggcaaagttactttgaagagtaaacttcgagaaattgcttaccatgatctaaactctatgtgtgctccttcagaaatggtgaaaacaaaaggtgctcaaaagagaccgatgaccaagcaacaaatatctacacaacgtgatccctcgtattggaagcatgttgatgcattacattccgagcagaatattgttgccctattaggtatgggtgaagattcatggtcattggagcgcaaccatttgcttaaagaacttacaaaatggtctgatgactatataaacttggttggtggtatagaccgatttgaggaattaaagcggtccctacttgttgatggattatccatggttatcatggacaagtggatgaatataactaacatgagatatgtcattgcatcaagtcaatcaccaacagattcttttgtgcatcgtgtgatatgtatcgatcatgtgtatggtaatcattttgttcaggtatttctaagggaccgttgttcgttaccgccagtagtattgttatggtctacacattgtcatcatcaggcaaaatag

SEQ ID NO: 19497 - DNA, 258 bp, Glycine max
  Peptide Sequence Number=SeqID_111182
atgggtcgaaataatgactttgaccaagctaggaaacaaattgtttacgaaacacttgacgacgataatgatgaacaaatcatgagctatttacgtgcgatgcaacaacaagaaggcaacaacagtcaacaaagaaggcctagaagagtcattaattgcaatcgtgaagatggacatctacaattgatgaatgactacttctcagaaaatttgatatacatcaagactcaattccgatgtaggttccgaatgcggtga

SEQ ID NO: 19498 - DNA, 435 bp, Glycine max
  Peptide Sequence Number=SeqID_111183
atgacaaaaaataatttgggcatgcaaaaatccaagggtcattacaagcaagcgtttattgaaaattgctctaaaagaacaaagaattctacatttgggacatattcatcgtcatctaatccaaaaacatcgatcgaaaatgctgaagctgacacatcgtctccaattgtccgtccaatggggcaaaaggcaaccaaaaggaagaacaaggggaaaggagtaggaacatctactaatcttgtggacttgaccggtgtggaggaagcaatgaggaaaagaaatgttcttaacgctaaattagtagccttaagggagaaagaattggaaaaagaatattacgacattctaatgaataacatatttacaatgtctgaaactcaacttgaagaccatcaagccttttataaaataattaggcataaactaggaatctag

SEQ ID NO: 19499 - DNA, 612 bp, Glycine max
  Peptide Sequence Number=SeqID_111184
atggcaagggataaactagactcttctgcagtgtgtgacctgaaactaaaactcattagtgacagacaaactgatggcagattatataatttgccaaatgcttctgaagtggctgctttaattgttggtgatgagcatacaacaaataacaaagatatcatcattgagaagcaaacaggcatgctacaaagaataaatgaacttcatcctacatatttacctttgcaatatcctcttttgtacccacacggtgaagatggctacagaccaaacattcttcataacatcatccgcatagccatgctgcaaagaggaacaaagatgcaatcaagggataatgaagcacaaacaatacttcattcaagaagattgtttcaccaatgggttgttgatgggtattgtatgattgagtctcaaaaactaaactatgttagacaacatcaacaagaactccgagttgccaagtacatcaatttaaattactgtaataatcagcccttaacccaaggtaatgaaaaagttgtttacaccattgagtggcaaaaaagaggattgtctcatgctcatatcttaatctttttgcatccttcaaataagtatccaaatccataa

SEQ ID NO: 19500 - DNA, 291 bp, Glycine max
  Peptide Sequence Number=SeqID_111185
atggattcaccatgtgtaagtttgagtcaacttagtgatggtgcaattagtgcggaggttgattttcttgaagttacaccaaagaaaaagatagaacggactaaagattacaaggagaagacaattgaatcaaaccacgagaagactaattttcatgcagaagttaggaaaggagttgccacaggacctagagtcatgttcagatgtcatgaaggccaaattttggctacaactactcatttccttccacattcttacaatatccatgttaaggccctagcattgagatga

SEQ ID NO: 19501 - DNA, 855 bp, Glycine max
  Peptide Sequence Number=SeqID_111186
atgtgcagggtccaagaaacattgtctaagcatagccaggtggatgcatcatctgaaaatcaatccttagctccagctgtggatgcatttaagagaaggcggttgacatttgcttggcttgatggtgaaaagcaaaaggattactgccaattttaccttggtcaagcggctagcgaacacacttgtggccaacgacggggtgtgactgatattcctcggttatttgttattcgatacctgaggaatagtagtgctgttgatttgagaacagaagaaaagacaaagtggaaatcattactggtccaagatctaatcaatgattctgatcagacaggccagtttgtagctgggtacaagggagaagatgatgtttcacagataacccactggcttgcaaatattatttctgatggtgactccagggacttgccattctttacactacgaactcctaagcttgttccggatgacacagaacctatttggtccatgtctgcacaaaatattcctttgcaaaatctgaagcagagtgttctcggtgttcttagtggactctctgcataccgtgaggatccaagagttggtccgtttttgcttctaggtgcattaatttctttgggaactatctggctgcgaaggagccaacaagttcagtcacctgaattaaaccaacctagtttcaatcaaccatctgattcaaaccaaccaagtcaacctagttccatggatgaaagaaaacagaaaccgagcgaccgggttcggagacggccaaataaaaaaccacccccatctatgacagatttggaaccgtcagatgcttaccagatgccactatcagattctgaatctgagtag

SEQ ID NO: 19502 - DNA, 477 bp, Glycine max
  Peptide Sequence Number=SeqID_111187
atggctgaacttcagtttgactccaaaattaagactgttcaaacagactggggaagggagttcagacctctcactaattttttagcaagccaagatcctaataaccccatctctttcattccctccatccctattgttcctcaacctatttcttctctttccccctctagcaattctgttgctagtcctacttctgttaatcctactgctgattcaaattccagccctagtccttctgtccatgctgagtctagtcctactgttgcatctgaggttcctagtcctactattgatactggatccacttctgttgcagcattggagattgtttctacagttaattctcatcctatgcagaccagatcaaagtctggaattcatttaccaagacttaatccaaccttgttacttgctcactgtgaacccaaatctgtgaaggaggcttcggctgattcaaacaagaatatgaggcactga

SEQ ID NO: 19503 - DNA, 63 bp, Glycine max
  Peptide Sequence Number=SeqID_111188
atggagctaggctgtgatcctcatggctattctcgtgctggttatgatacagtaacatggtaa

SEQ ID NO: 19504 - DNA, 851 bp, Glycine max
  Peptide Sequence Number=SeqID_111189
tgagtggggtgggggatgaagcctctacaacatttctactcacccttcctctgttcgctctcttcttcaaggaacccatcattgctgcgaaagggttacacaccgctagtgcatcgaagctctacctgaaccttgccaacctcaactacgacaacaccaacattgccatcaacgttgcagaatgctccaaacacgccttgatcaacaaattgaagatgaagggagtagaaccaaattttcgggcgggggcttgttacgggttaagggtttggaatgaaccaagttttgataatggggttggaatgagggaccgtgagagtggaagtgtgttattttgtttagggtttgtgttgaggagtgtgaggatttgggaatgtgggattgaatttgggggatctatgcttccgttgaatctaagatctacttctttcggtggagatgctatagaggcttactcaagcttgaggataaagacttcccaagctatttatcttctctctcagagaggcttactcaagcttgaggatagagacttcccaagctatttatcttctctctcagagaggctctctacttggattgactcattttacggtggctcactcaagcttgaggatagagacttcccaagcaatttatcttctctctcagagaggctctttacttggattgagtcaccctatggtggctcactcaagcttgaggatagagacttttcaagctatttatcttctctctcagagaggctctctacttggattgagtcaccctatagtggctcactcaagcttgaggatagagacttctcaagctatttatcttctctctcagagaggcttactcaagcttga

SEQ ID NO: 19505 - DNA, 249 bp, Glycine max
  Peptide Sequence Number=SeqID_111190
atgaaacgacatgagtttctatgggagccttacacaataaatgttatgtcagtgttgcctccaatttctttagttggaagcgtagtgtggtgcgtggtggtgccactgatttgtttccaagttattgagtggcaccaacccgatagagtattgagacaatttgaaatgcaacaaccaattctagggtgtccttcgcaacccttggatattcatgacataacactgaaagacaagcatgatgaaaattag

SEQ ID NO: 19506 - DNA, 309 bp, Glycine max
  Peptide Sequence Number=SeqID_111191
atggaagtgggaggtactgttgaagaagaaggtgttggtgcctctgatgctgaagtggaaggggccttagatctcttaccccaggccttcctgggtcctctaaaagcgaggactttgagtcctgtgaaagataaaagtgaggactttgagtcctatgaaacaagccaacagcttataggcctaggatcttcttcatcaaatgattcctttgcttcttggaagatgaatggcagcagaatggagaaggaagagagagaggagacaccacttcaaggagaagatgagtctagaagaagctcaccaccatag

SEQ ID NO: 19507 - DNA, 507 bp, Glycine max
  Peptide Sequence Number=SeqID_111192
atggggacgaggggttgcatctgttacaatcccgttcatgctataaggcaacttggctacgctatgagaggggcaccactagaggaagagctcgcgcctgtcatttcacgaggtttcaataagaccaacgtggacacacttcagaaggtccgcaaggcatgggaggtggtgcaaaagaaggacaaagaactcaggggcaataacaatgggcccatcggtggctaccctaagtggttgaaatcccacgtgcaaggattggattgtctcccgagtttgagaaccgctaaaagggaagaagttgaggcaccggaggaagacgaagaggtgcaggcccttagggcagaactcgagcaagcccaaatagtcaaagaaaggttgaaatcagcagctcttaagatccgaaaggagaatgccgaactaagagatatgaatatagctaccaccaaggccttggaacaagagaccaagagggctcatagggaagagcacggccggaacaagttatga

SEQ ID NO: 19508 - DNA, 654 bp, Glycine max
  Peptide Sequence Number=SeqID_111193
ttagatgaggcttctaggaccaccacacgacagcttgcgaggtacttgacgctattacagtgctggatctatgagtacttccctagtttgcaccagtgcgtgacagatgatacataccaggagacgtccccacgtgcttctcggtggttgacgtcgatggcgcacatgaagggaatcacaggagcaccttacagggcacattgtgatgctttgaccgtcacagatgtgtcctggttgccgtacacggagcatcgggggagcatccctccgccgcctgttagtgctcgattgtcacacaatgatatagatgacaggtggatgcattttgcggagcacgtactacctgcgggtgagctttgtctagtgcctgggcaggtgacccagctgagagatgcaccagctgtagaccctgaggagtacatacagccgcccagcccccaggttccagtggcatttgacccccttccacatgtggatgattacgacggatatgaggcgattgcacagaggttggagcgtgtgctcaaccttaggatggtcactgcaggcacagagttatatgagatcatgcaggactacctgacgatcaccagagggggagccagtgctgatggaagtgtcaagactcgtcagagacgccgcacggagcattga

SEQ ID NO: 19509 - DNA, 801 bp, Glycine max
  Peptide Sequence Number=SeqID_111194
ttccgctccggagtaggagggggcaccgctttaggagtgctgtacaccagcagcgcttcgaggccatcaagggatggtcgtttctccgggagcgacgcgtccagctcagggacgacgaaaatagtccttgagttttatgccaatgcttggccaacagaggagggcgtgcgtgacatgagatcctggggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaatatgaccgccctgacccagatatggatgacgttgctcctcagcaacatcctgcccaccgatcataattccgacctccccatgcctaagtgtcagctggtgtacgccatcctgacacggatgagcatccatgtggctcagttaatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgctcatcacccgggcttttattgagaagtactgtacccagagacagggtcagggtgatgctccacaggccgcaggcgcgcccccaccacctcatcgtgctggccaggctggggcatttgacatggagcagtatttacggcatttggttcgccagcaggcggccaaccaccgagcacat

SEQ ID NO: 19510 - DNA, 342 bp, Glycine max
  Peptide Sequence Number=SeqID_111195
atgacactgggcttagcgacacaggagtgccgcttagcggaaatgctaggttacagtgtctgcaaagttagcttagctggcaaggagcccgctaaggcaaagggctgctcagctcagcagatgccgcaaggaatttcgcttggcgcagaagatcctggcttagcgcgcgaccaatcaataaaaaattttacgaagttacctaggcttagcgaattaggctcgcttagccacatgtactatactaggcggatgagtgttcatcctcaagaaataaactcgcttagcgcggcaggcgcgctcagcgagttctttaggaaaacacctatatttaacgaatattga

SEQ ID NO: 19511 - DNA, 606 bp, Glycine max
  Peptide Sequence Number=SeqID_111196
tgatctcgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggtggtgtaagcaagagagagaatgtgagatcaaacgaggaatataatgacgtagccagacacgccaacacgcgcaattttcagaagcactcccttgagttagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 19512 - DNA, 531 bp, Glycine max
  Peptide Sequence Number=SeqID_111197
atgaagcacttcactgacaccctcatcagtgccaacatagtaagcccagtatacactccgctagcgcccaatacgcaaaccgcctctccccgcgcgttggccgattcattaatgcagctggcacgacaggtttcccgactggaaagcgggcaatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19513 - DNA, 588 bp, Glycine max
  Peptide Sequence Number=SeqID_111198
atggcagaagatctccacagaggccattgcctccctcgccaatattatgatcggccgttgaggtgcttcacctttggggacttcccagttatcaccatggtggaagagtttgaagagatcctgggatgccctctagggggaaggaaaccatacctcttctcaggattctatccctctttagctagaatttctaagatagtccaaatcttggcaggcgaatgggccccattcatagacatcctcacgcttttgatcttcagaggagtcctctttccaaatgtggatgggttggtggacctagcggtaatcgacacttttcttgcctttcatgaccgcaaggaaagcccggttgtcgctatcctagccgatctatatgacaccttcgaccgaagatgtgaaaagagtagtacaaggattgtttgctgtactccggccctctacgtatggttggtttcacaccttttccgccaagaggtgagacatgcttgcccgctagaaagccaccgttcatggacagagaaaggaggggcaaattgggaccgactcttagcaaacaaagaaggagcgtctgccaactggttcccttga

SEQ ID NO: 19514 - DNA, 231 bp, Glycine max
  Peptide Sequence Number=SeqID_111199
atgaacttaatcactgttatcaaaaggaaagaacacgctttacggtgcccttaccgaacccgtgctagagctagagtaatgggtgaagtagaggaggtgcaaaagcaaatgaaggccaacatggaggccatgaaagagcaaatggccacaatgatggaggccatgatgagcatgaagaagataatggaagccaatgcggttgcagttgccgataccaacgttgttgctaag

SEQ ID NO: 19515 - DNA, 309 bp, Glycine max
  Peptide Sequence Number=SeqID_111200
atgtcggatacaatgtccaggacatcctgcctgaaaatactggaattgctaaaagcattgaagctgcaggatccacgatgtcgggatacaatgtccaggacatcctgcccgaaaatactagagttgctaaaagcattgaagctgcaggatccacgatgtcggatacgatattttcaggaaaatgatagatctcatccagcacaagcagttgcagcccagaaacgcacattgctatataatcatggaggctgcacgagttctgtaccaagtccgggattgaagagttattttgtgagttttgggacttga

SEQ ID NO: 19516 - DNA, 717 bp, Glycine max
  Peptide Sequence Number=SeqID_111201
gtcgactctagaggatccccagataaaggcgagtgggtcccgttcatagatattctcgcactgttgattttcgggggagtcctctttccgaacgtggatgggttggtgggcctggcagcgatcgacgcttttctcacctatcataaccacaaggaaagtccggttgtcgctatgctagccgatccatatgacaccttcgaccgaagatcatctgtcaactggttccctcgatggaaggaaggaagaaccggagttcttatttcatgcggaggatttccaaatgttcccttgatggggatgaggggttacatcagctacaatcccgttcttgctataagacaacttggctatcctatgagaggagcaccattagaggaagagatcgtgcctgtcatttcacgaggtttcaataagaccaatgtggagacacttcagaaggttcgcaagccatgggaggtattgcaaaagaaggacaaggaactcagaggcagtaacaatgggcccatcggtggctatcgtgagtggttgaaagcccacgtgcaaggtttggattggctcccaagtctgagaaccactaaaagggaggaagataaggcaccggaggaagatgaagaagtgcaggcccttaggacagaactcaagcaagctaagacagtcaaagaaaggttcaaatcagcagctcttaaaattcgaaaggagaatgccgaactgagagat

SEQ ID NO: 19517 - DNA, 734 bp, Glycine max
  Peptide Sequence Number=SeqID_111202
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacagtcgcttcccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 19518 - DNA, 456 bp, Glycine max
  Peptide Sequence Number=SeqID_111203
atgaccatgattacgccaagctcgaaattaaccctcactaaagggaacaaaagctgttctgatgttggagttaaatcagtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19519 - DNA, 564 bp, Glycine max
  Peptide Sequence Number=SeqID_111204
atgccttcacattcggggaccttcccaattagtcccaacccatggaaggaatttgaggaaaattctaggatgtccctctcggggggaaggaaaacccatatcttttcttcccggggtgtctccccctctttgagcagaattgcaaccgtggtcaaggattcagccagaggtttggacccgcataaaacagactcggaacggcatagcgggcctgccacagaagtacctagaagacaaggcgaggggtatggccaatcaaggagactgggtcccgtttatggatgtgttagctttgctaatttttgggtcgtcctctttccaaacgtggatggtttgatagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgttccgctcctgagccatcgctcatgtactga

SEQ ID NO: 19520 - DNA, 810 bp, Glycine max
  Peptide Sequence Number=SeqID_111205
atgaccggccctctcgatgagtcgatctcttgctttctcaaaagggtggacccttgggtactagtacctatcacctttagaggactacacgtcctcgccatcagaggactacacgtcctcaccatcagagggctgcacgccctcaccttcagagggctacacgccctcaccttcagagggctgcacgtcctcaccatcagagggctgcacgccctcaccttcagagggctagacgttctcgcctttagaggactagacgtcctcgtcttcagagggctgcatgccctcacctttagaggactacacgtcctcgcctccagaggactacatgtcctcgcctttagaggactacatgtcctcgccttcagagggccacacgccctcgacttcagaggactacctgccctcgcctttagaggactacctgtcctccccttcagaggactacacgtcctcgccattagagggctgcacgccctcaccttcagaggactacacgtcgtcgccatcagagggctgcacacttgcgctcccggttatggggccagttgtttccttttatcagttcttgggccaccctatgatattggagggcgaccaactgtgcgagcacaaccagagaggaaggctattatgcagctactatgcataccggggcaagatttcacccgtgccgctgcaaagagacgagtgcgggtcatgcgcaccaacatgaccactcttacacagatatggatgacgctgctacttaacaacattccacccgatgatcacaatgccgatctcccccctacggaagggatcctctag

SEQ ID NO: 19521 - DNA, 564 bp, Glycine max
  Peptide Sequence Number=SeqID_111206
atggttgatgtttcaccaatcaaggctgacatagtggaacagattcgaacaactggactcttcaaacacgtcacaaggtggttggattctgaaagttcatgttgtaatactttagcaaaccttggtgacaaagatatgttaccagcacttgctgccagtgtttgctgccaagcagcagatcttttgactgtttgtgggaagctgaaaactcttactgagagtaccatcagagaaagagctttaacagcacaacatagttccatgatcactatctcaaaatttgagtatgagtatctaacaaatcatgtagcctcagtagaagaaattgctgataaaaaagtagcagcaactgaggcatggattgaagctctcaaggccaatgagaaggaaatactgatggaaacaaaaatagctcaaagacaactcaaagaatcaaaattggagcaagagctggaggtttacaccaaagagaagatgctttcaagaagagttagtagtagtggggagcttgacaattggccaagaaaacacgagaagagttcatccaagaacttcatagtttaa

SEQ ID NO: 19522 - DNA, 330 bp, Glycine max
  Peptide Sequence Number=SeqID_111207
atgggccccgacgggtgcagagaaacgcgagggacgggaaccagagaaacggtatgcaaaccgaggctggatcttagcattcaaaagaaaattcagaagctcttcttctcatctcccacgctgcttttcttctccctttctcctccaccattgttgcccattaaagctccaaactttgctcatcatttctactctagattgcaaagggaagccatttttgaagtcgtgaagcgcacctctacgttgtgggacttcgaatttcagctatgggtggacttcttctcacatgaatttcgtgggtattgggtttttgggagatatgatgggtag

SEQ ID NO: 19523 - DNA, 495 bp, Glycine max
  Peptide Sequence Number=SeqID_111208
atgatgaaagctattgtatttgcttaccatgatattggctgcgccggtctgaaagcgctgactgaggcgggttatgacgtgcaggccgtgttcacgcacaccgacgaccctggcgagaacaacttcttctcctccgtggcccgtttgggcgccgaattggatctgccggtctatgcgccagaggacgtaaaccacccgctgtgggttgaccgcattcgcgcactgcagccggacgtgatcttctcgttctattaccgccacatgctgagcgacgagatcctgtcgctggcaccgcagggcggtttcaatctgcacggttcgctgctgccacgttaccgtggccgtgcgccggtgaactgggcgctggtgaacggcgaaaccgaaaccggcgccacgctgcacaagatggtgaaacgcccggacgccggggacatcgtcgggcagcaaaaagtggccatcgccgacggcgataccgcgctgacgctgcacaaaaaa

SEQ ID NO: 19524 - DNA, 237 bp, Glycine max
  Peptide Sequence Number=SeqID_111209
atgccgattgagacaggtagattgaaagctaactatctccctattgctagcatggcggagacagaaatagccactaatccttctccttggcggaagaaaagagtagccgatttctttatccccgggcaggcaatcgggagtctagtctggctaccggtggagcttattcctgctttagcagagaggttgccttgccgccctatccctctccctttcgtctcgtaccctcctatctaa

SEQ ID NO: 19525 - DNA, 744 bp, Glycine max
  Peptide Sequence Number=SeqID_111210
atgcagatccttattgaagccatagatttaaatatatgggaagccattgaagttggtccttttattcctacaaaggtagtgggaaatgcaactatagaaaaaccaagagaagaatggaatgatgatgaaaaaagaaaggttcaatacaatttaaaggccaaaaatataatcacttctacattaggcatggatgaattttttagagtctcaaattgtaaaaatgcaaaagaaatgtgggatacattgcaaatcttattaacaaaagtgttgagatgtttaagcaggcaaatgacaaccaaaagtaacaggcaatttgcaaaatcaagagatctcgctaatatgcctcttgccactctcttttggaaaacttcagaacatgaaatggaacttatgagacttcatcaccatgaagagaatgatataaagagaaaaggaatagcactcagaacctcatcatcttttattcaagaagaaagtgacaaagaggacttgactgaaacagaagaagatgatgatgatttcagactctttgtgaaaaggttcaataaatttctgagaaacaaaagaaataaaagaaaatcaaacatcaatacaaagaagaaagaagaagactctttcttagccccatcatgctatgaaagtaatcaaccttggcacatgagatccgattatcttgtctttgaaagaagaattgaaaaatccgacaagaggaatctcaaagaaaagaaagaaaagaaagcatag

SEQ ID NO: 19526 - DNA, 144 bp, Glycine max
  Peptide Sequence Number=SeqID_111211
atggaggccattacaatggagaaaggattgccgccaaggtcctccaatctgaggtgtgataattgtcaaagaacaggtggaatctccaaaaggaatggaatgtcaatgcagaacgttctagaggttgaagcttttgactgttga

SEQ ID NO: 19527 - DNA, 696 bp, Glycine max
  Peptide Sequence Number=SeqID_111212
gacgatgaggatgagacgacgcaatcgagggcgctgattgaagcaccggcagccgctcgtgccgttcaggttaccgaacgcatcgtcgagaaggttgtcgagaagatcgtccacgaacgcgaaaagctgccgaaccgccgtcagggttatacccagaaggcagtcgtcggcggacacaaggtctatctgcgtactggcgaattcggcgacggacgtctcggcgagatcttcatcgacatgcacaaggaaggcgccgccttccgcgcaatgatgaacaacttcgccatcgccgtttcgctcggcctgcagtatggtgtgccgcttgaagaatatgtggaggctttcaccttcacaaaattcgaaccagccggcatggttatcggcaacgatgccatcaagaccgcgacgtcgatcatcgattatgtcttccgtgaactggctgtgtcctatctcggtcgcaacgacctcgcccatgtcgatacgagcgatttcggcaatacggcgttgggcaaaggcatcaaggaaggcaagaccaatctggtttcgaccggttggacgcgtggatacaagcccacgctcgtgacgaattcgaacaacgaagccaagggatcgacgagttctgcgccgcaggcctccaacgtcaccaccttgaagtcgacctctccggcgggcaatcgcccggcaacgatcggcttg

SEQ ID NO: 19528 - DNA, 249 bp, Glycine max
  Peptide Sequence Number=SeqID_111213
atggagacaaaagcagagatgaggcatttggtcagccctgacgccaggagtgtagaggctaagaaacatcacaaaaagagtaatggtggtaacgggagggctgacacatatgataagcctatggacagtgaaatggaggggcacccaacaaacaacattctctgttgggctagacggaaatcagtggcaagtttattcaaggaagaagaggtcccaaaagcaatcaaatacgggcctcctcccctctaa

SEQ ID NO: 19529 - DNA, 213 bp, Glycine max
  Peptide Sequence Number=SeqID_111214
atgtatgatctggaagacaagtcgccaaaacaggtcaaggttagagggcaatggattccatttgactcagctgccctcaactcttttttagaaacaccagtgattatagaggaaggagaaagtcttccggcatatgcaagacttgtgttgttaagaccaaactcacaagagttagcagcctatttgtgtattccaggcaagggattgaattga

SEQ ID NO: 19530 - DNA, 480 bp, Glycine max
  Peptide Sequence Number=SeqID_111215
atgggatcaagtcaaaagccttcgtttaaaaagaggttctatcaagtcaaaatcaagagcttagaggtcactagtttacgagagttggggcaattaatgggtcaacttcaacggcaagccttccgcaaagcctatgcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 19531 - DNA, 443 bp, Glycine max
  Peptide Sequence Number=SeqID_111216
aacagcagctggcgcagatcccgctgcgggccgcgcggctcggtgtccagcgccgccgccgccacgatctcctcgccttcgaaccgcgcgaagaacgcgccgccgcgatcgaagcaggcttcgtggatcggcgtataggtttcccggtcgtgcggatcccaacctcgcacgtcgtagtagtccgggtaggcttgcagtttaccgtcctgcaggcgatacaggtctgtggccggtaactttccggcaaatcgataataaaaccgatgccgcgatcgtcgaggccttcggtgacgcgcagctgcgcgccgatcttgtcggccaggttccgggcgatggccaatcccagtccgctgccggtctgctgcgtgccgggcacgcggtaaaagcgttcaaacaggcgcggaaggtgctcttcgctcactccggggccgttgtcgcgcaac

SEQ ID NO: 19532 - DNA, 852 bp, Glycine max
  Peptide Sequence Number=SeqID_111217
atgacgtacgaagacctcttgccatccctcgtcgccaaccagatggctgtgatatctcccggaagggtccaccagcctcctttcccaaagtggtataaccctaacgcaacctgcgcagaccatgggagaacctcgggccactcaatcgaacagtgcatggccttcaacgcaaggggggctgttaatgtcgtcgagtcgggtaggccacgtaggtccaaacctttgaaggatgtaacaacccccacaaggtttatctatgaggccctacaaaaagggggcataattccccgcggtgggcacgagaaggattcttatttgatgcatcctagcgcgccacatagcatggaagcatgtttagcagtaggagacctattgcaacaaatgatagaccaaggccggctggaagtcggtgatgaggggggtgaagaacagcatatatgcatacaatccacagatgaggaaggtcttagaaagcctaaacctttggtgatacatttcaccagggacgcagctcgccaaacgccccgacacccctcagtagttagacctattccatttccatacaaaaacagccacgcagtttcgtggaggtacgcgcctccaagtgaaaggaaggaaggagccaccgacatcagctcgctattggccaaagtaaccaatatcacggggctgagcggcatgacccgcaatagtcacgtattcgcaccccctgacctgccgacacaacccgcaaacactaaagggaaggcaaggatgacggaaggtcaaaatgtcaaagtgatccccgctccggacgaggatgtttcgatgaaaggtctttccgaggaaagagatggttgtgacaagaaagag

SEQ ID NO: 19533 - DNA, 291 bp, Glycine max
  Peptide Sequence Number=SeqID_111218
atgggggtgcaaatagcaaccaggcccacttgggccctccagaagattcctccagaaggctgttgcttctggaggaagcaaccctgctcgcctgggcaagctggtgaagtgaaaaagggttcagcccctgaggcacttctctctctttcgaatttgcttggaaaaattgtttccgtgaagaaaatccaagccgaggcgtttccgaaacgtttccgtgaggaatttcgcgaaggttttgaccgttcttcaatgttcttcattcgttcttcatcgttcttcgatcttcaacag

SEQ ID NO: 19534 - DNA, 444 bp, Glycine max
  Peptide Sequence Number=SeqID_111219
atgaagcacttcactgacaccctcatcagtgccaacatagctgaaattgaagagcagagttctcaagaacctcagcacaatcctcactcccagcatttgttgctccaactgatcgaattcctgcagcccgggggatccactagttctagagcggccgccaccgcgtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtgtggtggttacgcgcagcgggaccgctacacttgccagcgctga

SEQ ID NO: 19535 - DNA, 295 bp, Glycine max
  Peptide Sequence Number=SeqID_111220
tcccgagacgtgtcagaaatcaaaaggaagtaggttagcgcaatccgtgaaattccgtgatgtggcggaaatcgaaaagagatccttcctccagaaggctgttgcttctggaggaagcaaccttgctcgcctgggcgagctgggtggcaagctcctcccctattttgctataaatagagggaggagtgaagaagaaaagggttcagccttcttcgcacttctccctctctcgaaattgctgaggaaaattcttttcgtgaagaaaatccaagccgaggcacttcctcttcaacgg

SEQ ID NO: 19536 - DNA, 1304 bp, Glycine max
  Peptide Sequence Number=SeqID_111221
gttttatcaagtcaaggttaaaagtctagatgtcactagcctcaaggaattgggacgattgatgggacccctccaaaggcaagccttccgaaaaatcaacgggaagattctagatttgaccgcagcggaggtatttatagaagctgtcgtaaccctcgcccaatactatgaccagctgttgaggtgtttcacgtttagggacttccaaatggtaccaactattgaagagtctgaggagatattaggatgccctcttggggagagaaaaccgtatcttttctccggctttcttccttccttgagcaagattgcagctatggttggagattccgcaaaagagttggattgcatgaagcaaattcggaacggcgtagtgggcctgcctcggaaatacttggaaggcaaggcaagggatatggcgagccaagagaagtggggcccgtttgcagatattttagctttgctgatttttggggttgtcctctttccgaacgttgacggtttggtagacttagctgccattgatgctttcctcgcatatcaccatagcaaggaaagtccagtggtggctatcttggcagatttgtttgacacctttgaccggagtgtgagaaaaatagtgcacggattgtctgttgtttacccgctctctgtgtgtggaagagtcgattgggaccaacatttggcggagatagggggcagcgcaatcaattggtttcctcgttggaaggaaggcaaggaaggagttcttttctcgtgtggtgactaccctaatgttccattgatagggactagggggtgtattaattataatcccgcgctcgcaataagacaactagggtaccccatgaggggagcgccaacggaagggagtctctcacctttccttctgaaagatttaggcgcgcaaggtctcaaggttatacaaagaatccacaaggcatggaggagtccgttgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaagtccgagctctaaaattggagctagggaaggcaagactcgccaaggagaagttcaaatcagctgctacacacatccagaaagagtacactgagttacaagaggaaaacgcggccactgcaagagcccttgaacaagaaaccaaaagggcccgcaaggaggaatatggccgagagaaattccgaggagcattgtggg

SEQ ID NO: 19537 - DNA, 258 bp, Glycine max
  Peptide Sequence Number=SeqID_111222
atgatgcgcactaaatcgtctaactattaccgtctagaaggcctttcggaagaacattccttatctctatttctcaaatcggcttttgatgatggagaagagagaaaacatccacaattggtggagattgggaaagaaattctgaaaaaatgtggagggataccgttggcagtgaaaacattagggagtttactattctcaaaggttgatagaaaacagtgggaatctataagagtgtgtttggatgggggaatttaa

SEQ ID NO: 19538 - DNA, 570 bp, Glycine max
  Peptide Sequence Number=SeqID_111223
atgacactacacgctttatatcagaggtcgcttaggagtgatatgaacaaaatgaatgcttccctctatgtgactgaatatgatgagttccgtcgggagctcgagaggcgtagttggcataaagccttgactaggaaacctgaaggtcacattgatgtggccctggtcaaagagttttatgccaatctatttgatccagaggataagtccccgaggcaggagctcgccgctagactatgtattccagggagacgttttgtattgaatgctgagggagcgccttggaagctcctgaggaaggatctcaccacattggccctaacctggagtgtattatcatactccaacctcgcccccacctctcatacgtccgatcttaatatggacaaggcgaggttggtatacgggttggtgatgaagatcgacatggacttgggctccatcatctctggacagatctcacagatggcccagtcctactcctctcgactaggcttccctgcactcattacatgtttttttgcatcgccagaggagtggtccctgactcaatcaattttgagtccttga

SEQ ID NO: 19539 - DNA, 1026 bp, Glycine max
  Peptide Sequence Number=SeqID_111224
atggatggcatgttcagcaacaccgactcgcgccagccgtttgcaccggcacagggcaccgccgtgcacagcgggcaactggagggcagcaacgtcgatgctgctgagccaacagcatgctccgcctgggcagttgacggatttcgggcgccgcccgggcgcggcgctggcacaccgcttgcacatccgctaccaagggccgcattgcgcggccggcttcacccagacaggactccgaagatgaaccaggcattgtggatcgcgaaaaccggactggatgcgcagcagatgcgcatgtcggtggtttccaacaacctcgccaacaccaacaccaccggcttcaagcaggaccgcgccagcttggaggacctgctgtaccagcaggtgcggcagccgggcggctcttcgtcggagcagacgcagttgccgaccggcctgcagctgggtaccggtgtgcgcgtggtcgccaccgccaagaaatttgagcagggtggccagcagcagaccggccgcgcattggacgtgatggtcaacggccgcggcttcttcgaagtgcagatgcccgacggcagctcggcctacacccgtgacggctcgttcaagatcaaccaggacagcgaactggtcaccaacagcggctacccggtgcagcctggcatccagattcccgaaggcgcgcagtcggtgaccatcggtaccgacggcaccatcagcgtgaagatggccgacggtgcggcgtcggtggaagtgggtgcgctgaccctgaccgacttcgtcaatccggccggcctgcaggctcgcggcgagaacctgttcctggagaccaccgcttccggtccggcacagaacggcaaccccgggctcaacggcctcggcaccgtggtgcagggcgcgctggaaggcagcaacgtcaacgtggtggaagagctggtgtcgatgatcgaaacccagcgcgcctacgaaatgaacgccaagacgatctccaccaccgattcgatgctcggctacctcaacaacaagctctga

SEQ ID NO: 19540 - DNA, 457 bp, Glycine max
  Peptide Sequence Number=SeqID_111225
ggtgctccagtggcttctgtttctatcagctgtccctcctgttcagctactgacggggtggtgcgtaacggcaaaagcaccgccgggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 19541 - DNA, 543 bp, Glycine max
  Peptide Sequence Number=SeqID_111226
gcctgcacgtccttgccttcagaggactgcacgccctcgcctttagaggactacatgccctcaccttcaaagggctgcatgccctcgtcttcagaggactacatgtcctcgccttcagcgggctgcacgtcctcgctttcagagggctccacatctgtgtcttcataggacttaaggggccagtagtctccctttatcagccccttggtcacccccctgatctcggaggagggccaactgtgcgagcacaaccagagggaggatatcgtgcaaccactatgcatactggggcaagatttcactcgtgccattacaaagagatgagtgcggatcatgcgcaccaacatgaccactcttacacagatatggatgacctctggttacgggcctctgtcagtcctatagggtgcccgtcccccccagcaagggatcgcgcccgcaagacacccagtggacccggagaagtccaacaaggtcttggggtttccagctctgattacaggcctctgttagttctacggagtgcctgtcgcccccaacaag

SEQ ID NO: 19542 - DNA, 132 bp, Glycine max
  Peptide Sequence Number=SeqID_111227
ggatcgcgcccacaagacactagtggacccggaggagccaacagggccctggggtttccagctctggttacgggcctctgtcaatctgatggaagcttgcttgagtggcttctatggaggctggatctttga

SEQ ID NO: 19543 - DNA, 534 bp, Glycine max
  Peptide Sequence Number=SeqID_111228
atgacttgtaggaaatgcaaaagtattggttcaagacccacaacacaatatgatacaaaaaggttttcctccttagatgcttggaaccgatacacagataatgttttggggagaaacatcttacctgaaaggaaggtagagctctatcacactgagctagatgattttaaaactgaattagagaggcgtaatttccataaatgcctcaccaatttggttgatgggagcatagacttggctttggtgagagagttccatgcaaacttatacagctctgagggaccttcaccaaagcaatccagagtcagaggtcatttagtgaagattgatgctgacagtctcaacacattcttggagacacctgtggtattggcagagggtgagactttacccacatactccagatattgcaggctgcccatagattacagagagtttgtggttgccttatgcataccaggccaagggttcatcttgaacactgagggccatcctgggaagattcttaggaagaatttgactactctagcttag

SEQ ID NO: 19544 - DNA, 141 bp, Glycine max
  Peptide Sequence Number=SeqID_111229
atggggagagcattttcgaagctggattgcttctggggtctgggcggcaacctcctccccctttttccgataaataggctgaagggggctgttctaagggctcggatccccctggtgatgtatttcagctgttttgggtga

SEQ ID NO: 19545 - DNA, 290 bp, Glycine max
  Peptide Sequence Number=SeqID_111230
atggatatcaacccgacttataggctgtctattggggcatccatggatccactcagtgggagtcgtcccctccacactccaccagaagctgaaatttgtggtggaaggacatttggccatagtatggggctaggaagacgtcctggtggtaaccaatgcctccatagaatccctcccaaggtagccccggctgtctggcgcggcaatgatggtggccagggtaatgttagggcatgtggtacaagcctgaaatgggtttgggcaagaataatggcggcagggacagcctg

SEQ ID NO: 19546 - DNA, 188 bp, Glycine max
  Peptide Sequence Number=SeqID_111231
atggacgctcatccttgtcaggatggcatacaccagctgacacttcggcagagggaggtcggagttatgatcattgggcaggacattgctgagcagcaacgtcatccacatctgggtcaaggtggtcatgctggtgtgcatgatccgcacttgcctcccggtagcggttcgagcaaaatcctgacctg

SEQ ID NO: 19547 - DNA, 708 bp, Glycine max
  Peptide Sequence Number=SeqID_111232
atgaccaccctgactcagatctggatgactttgctgctcaacaacatccagtccagcgaccataattccgacctccccctgccgaagtgtcagctggtgtacgccatcctgacgtggatgagcattcacgtggctcagttaatcgctgatgccatctatatatttgcaggtatggtgcctaccaggcaccctctggacccggataagtccaacagggccctgggatttcccgccttgatcgcaggactctgccagtcgttcggagtccccgtcgcacctagcaaggtgattcggccgcccatcacccgagcctttattaagaagtattgcacacagagacgtgttccacaggccgcagacgcgccgccacctcatcaggctggtccagccggatcgtttgatacggagcagtatttgcggcatttggttcgccagcaggcggccaatcaccgggctcatgtacagacccatgattgtctttaccagatgagcctcagcctgcagagccagggttttacttcttttccgtgccctactccggaccagttcagggcagaggtcgcatggcctggagattggcctgaggcccgggcaagagaggcacctgcagaggaaccagcagaggctcccgacgaggcagatgaggctcgcgaggacgaggagatggccgatttacttgatttcttaggagggagcggagccacatga

SEQ ID NO: 19548 - DNA, 219 bp, Glycine max
  Peptide Sequence Number=SeqID_111233
atgagtattaaaggtggtgccggtggagctagcggaggtgttagaatctcaacctccagggaagccggtgggtctactactggtggttgcgactcagctggtgcaggctctgtccttgttggtatgggactaaggggcacaacctcgggagatctaaaaattgatccatggatactattggcctgttatgagacaactgctgctggttgtagacaataa

SEQ ID NO: 19549 - DNA, 135 bp, Glycine max
  Peptide Sequence Number=SeqID_111234
atggagaaaaatgaagaaacaacaatggaggagaagtgctatccactagggaataagccatggaagaaggagttttaccaccaagagtatgccttggataagaagcttatagaggaagcttcaatggaggaatag

SEQ ID NO: 19550 - DNA, 318 bp, Glycine max
  Peptide Sequence Number=SeqID_111235
atgggctcgaaatctaccctaaggctcatgagaaccctagggccttcccttgaatctctagctcaatctacttggagtcttctagccaatgcccttgcgagattaaccgtagggaactggttatgtgactcggatctagttaatcctacagggattgaacaagtttttactgaaaaagaccttctagccgattcatattcagacctagaggcttctatccttgatgaaaatgaatttcttctattgaaggctctgataccagagatcagcggcggagagggatcaaacggactaataggaagtaagaatgcaggatga

SEQ ID NO: 19551 - DNA, 339 bp, Glycine max
  Peptide Sequence Number=SeqID_111236
atgggttttagccccattctcctaaacaactcaagtacttctgggggcgtcaacccttctgtaagcagatcccgcaatattgtttttgaccttgtcgcaacctacccttcgacgggagggcgaggcgaaaagccaaaggagcgtcttctcatgaagaaaacgcgcggagtcgccaccaatgtttattcgaggaaaacgttagaaaaaccaaaaaggggtctacgaatattgaaaagaagggttcgagagttgtttactcatggggaatgtattagcaccccacgcgcctgtcacgagggatggcagcctaggctagccaaagtccggaaagctggttaa

SEQ ID NO: 19552 - DNA, 810 bp, Glycine max
  Peptide Sequence Number=SeqID_111237
atggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtggccaaaataggtattattaggcaccaaatccctaaaataggtggtgtgaggaatgctttgggtggtgcaacactcttttgtaaaattactcatgcacccaacatcttcatgatttgtgtacatagggactcattaggtagggttcccatgaaccctaagagaataaaggtcattcctgagtggcccgctccaccaagtgtaagaaaaatttggggcttccaagacttaacaacttttacaaaggtgttgaggaaaaaacccagagtttcaagaacctcgggatttgaggtcaaatccttttcaagggggagggaacatgatgtaagctccattggagcttgtaggcctaggatcttcttcatcaatggattcctttgcttcttggaagatgaatggcagcggaatggagaaaggaagagagagaagagacgccactttaaggagaagatgattctagaagaagctcaccaccataggaggccatggataagagcttggaggaagaaggagatgaatgaagggagagggagagaagagcacgaaattttgtgctctaaatga

SEQ ID NO: 19553 - DNA, 522 bp, Glycine max
  Peptide Sequence Number=SeqID_111238
atggcagaatcatcgaagaagcaaaagggaacgtcttccaccaccgctgctgctggccatcgccgccacggaccatctgaagcacccacagcaccaattcattcttccttatcatctctaagatcatctactctattttcttcagatgatcaacgtctacggtacaactctcaattttcttctaggatcatcttagaccctaagtacctagacacagatttctttaatgatgagacatttgactgttatcaagtgtttcaaaactctggattggttgattttatgtccttaaaattgccttactatcctgaacttgttgaattcttttacagcaatttaacaattcatgatggcattatttcttctgaggtgcatggtatttctatgatcattgatcaatctctattcttttcattgactaaattacccagtcaatgtgcaccttttgagggcaccattgttgatgactggaagtttgattattctagtcatgatgctcgttgtatggtttgtaatgactag

SEQ ID NO: 19554 - DNA, 831 bp, Glycine max
  Peptide Sequence Number=SeqID_111239
caccggaagaggatgaagaagtccaagctctcaaaagcgacttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaaggtccaaaagaagcttgtctcagtgtttatgcgagacggagaccaacatgctagctatcatcgccaagtaccaagaagagttaggtctagccgcggcccacgagcataggattgcggacgaatatgcccaagtatacacagaaaaagaggctagaggaagggtgatcgactctttacaccaagaggcaaccatgtggatggatcggtttgctcttaccttgaacgcgagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaatgcggccaccgccgctgctgcca

SEQ ID NO: 19555 - DNA, 570 bp, Glycine max
  Peptide Sequence Number=SeqID_111240
atggcctccatgatggaggccatgttaggaataaggcagctcatggaaaagaacgcggccaccgctgccgctgtcagttcggctgccgaagcagacccaactctcttggcaattgcgcaccatcctccctcaaacatagtaggacggggaagggacacactggggcactatggcagccctcacctgggatacaaccgagcggcttacccttatggattgctgcccaactactcaccacccgtcttgcaagacgatgcgggccatattgcttctcccgtccttgaaagagagcctcctcaacagcccgaagaagtccccaaagaccctcaagactatgctcaaagggatgtcgagttctatcccccgatccccgaagggccggcacccagcacgttgcctcaacccaacatcgcgacacaaccaatagttttgtccacggaaggaccgcccccggcaaccgaagaaaagaggaagcttgatctcctcgaggaaagattgagagccatggaaggatttggggactatccgttcgcagacatgacggatctttgcttagtaccgatgttgtaa

SEQ ID NO: 19556 - DNA, 421 bp, Glycine max
  Peptide Sequence Number=SeqID_111241
ggagctcgagatatgtgctcatggagtatgggccagtaagatcccctttgatagagatgccctcaaccatgttcttgggccagccactttggaggaaggtcaacagtgtgaatatgacgagaggaggagccaggtttccggctttgacgaggatgccatcgctcagcttttgggcataccagggcaggatttcgcccggaccgctgcacggagacggatgcggatcttgagcttagctcatcagtgggctaagcgtgcatccaccgctaagcgcagcttcagtgtgacaaaagaatctggcagagcatcaatatcaacgccacacgctaagcgtgagatcaatgcgctaagcacaacagttgtcttcaaccaggctcagcgcacgactagcgctaagctcaaatccacttactcgcactaa

SEQ ID NO: 19557 - DNA, 174 bp, Glycine max
  misc_feature (8)..(8): n is a, c, g, or t
  Peptide Sequence Number=SeqID_111242
atggcccnggagattggcccgaggcccaagcaggagaggcacccccagaagctcccggcgatggagaagaagcccacgaggatgaggagatggccgatttgcttgacttcttgggagggagtggagatacgtgactgggagatccccagattcatcgcatacatttttgtttag

SEQ ID NO: 19558 - DNA, 282 bp, Glycine max
  Peptide Sequence Number=SeqID_111243
atgaatgacgaggaacagttgaaaatctttgcgaaattacccacgaaaatcaaaataggggaggagcttgccacccagctcgcccaggtgagctcagctcgcccaggcgagccaggttgcttcctccagaagcaaccgccttctggaggaagaatctggaaggcccaagtgggcctgacttatcaaggtaatccttgtggcgtctaccctgacttatcttccttcactggaagtggcgtcatccaaaatctccgtagcctgtatcaagcgatctgctcctag

SEQ ID NO: 19559 - DNA, 440 bp, Glycine max
  Peptide Sequence Number=SeqID_111244
agaccgacaaaaggaaaagaagcatagcactcaaagcctcctcaatacaagaagaagaagaagaagaagaagaagaagaagaagaagaagaagaatctgatgatgaagaggacttctcactctttgtgaagaagtttcataaattcgtcaaaaatagaagaatcgagagaagccgtaacttcaacaatgggaaaagatcccaagaagtttctccaacacttaaattctataagtgtaatcaacccaatcacatgaaagcaaattgcccctcaaatgagtcatggcaccgagagaatgagaagaaaagctataaagaaagaagatccaagaaggcgtatgttgcttgggatgacaatgactcatccgatggttcggagaaggagatcaatcttctatccaaggactatggaagtgatgagaacatctctcaagaagattaa

SEQ ID NO: 19560 - DNA, 1300 bp, Glycine max
  Peptide Sequence Number=SeqID_111245
atggacaagaaaatccgcagtattgtgagtagcattctgaaagatgcttctgtgcctgatgctgagaaagatgttccaacatcgtccaccccaagtgtttctgtgcctgatgctgagaaagatgttccaacatcctccgctccaaatgctgaagccttcccttcacccagtgaagaggaatcaacagaagaagaggatcaagccgcagaggagacccctgcaccacgggcaccagaatctgttccaggtgacctcatcgacctggaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgctatcccctccaagaagaggaaagaaatttcctcatccgattctgatgaggatgtcgaactagatgtctcgacatctaagagggccaagaaatctgggagaaaggtgcctggaaatgttcctgatgcaccattggacaacatctctttccactccattggcaatgttgaaaagtggaaatatgagatcgtggatctcatcaaggctgctggactgctgaagactgtcagcaagttgggagagtgctatgaaggcttagtcagggaattcattgtcaacattccctctgacatatcaaacagaaaaagtgatgattatcaaagagtgtttgtcagaggaaagtgtattagattctcccctgctgtgatcaacaaatatctgggcagacccactgatggagtaatagatattgatgtttctgagcatcaaattgccaaggaaatcactgcaaaacgagtccagcactggccgaagaaagggaagctttcagcagggaagctaagtgtgaagtatgcaattctacacaggattggtgctgcaaactgggtacccaccaatcatacttccactgttgccacaggtttgggtaaatttctgtatgctgttggaaccaaatccaaatttaattttggaaactatatctttgatcaaactgttaagcattcagaatcatttgctgtcaaattacccattgccttccctactgtattatgtggcattatgttgagtcagcatcccaatatgttaaactacactgactctgtgatgaagagagaatctcctctatccctgcactataaactgtttgaggggacacatgtcccagacattgtctcgacatcagggaaagctgctgcttcag

SEQ ID NO: 19561 - DNA, 2536 bp, Glycine max
  Peptide Sequence Number=SeqID_111246
atgctggtgccggtggaagaggcgaacgaagccgaaacgctttcgccggtgaaatcgctgctgcgccatcgctttgcgctgccgggcctgttgtccgcgggcgtgctggtaggattgtgcgtggggctgctgatgtccgggggcgacgatcctgcggcgccggcagagacggtgcaaaacagcgcgccagctgctgatccggcagtttcaccttcagcgtcgtcagcgccagccgcaacggcagcggtaacgccggaaaaaccgcgcgaagcggagccgcagcctgctccgccgccggagccggtcgcgcaggtttacatcaagctgcagcagggcgaacgcgtccagggatttattatgttctcacgcatcaccgcacagctgccgatggacggcctgctgttctggaaactcaccggcgccgaggcgctgtcgcagtcgtttgagctgaacgccgagctgctggccacggacgcgcgcatcgaccggcacgcgctgctggggcagccggtcacgttcacgctgccgacgcagagcctgctgtcgccgcgctacctcaacgggaaaatcacgcgggtggcggtgcgcagcgaggagctgagcgggacgcgctacgcggtgtaccagctgcgggtggagccggacctgtggccgatgcgccgggaccgcaacctgcggatattccagggtcagacggtgccgcagatagtgcagacgctgctgcaggagaacggggtgaacgtggagacgcggctgggcagcagctaccgggtgtgggagtactgcgtgcagtaccaggagagcagcttcgacttcatcagccggctgatggagctggaggggatttactactggttccgccacgaggcggagcgtcacgtgatggtgctgtgcgacggggcggaccagcacgaggcgttcgcgggctatgagacgataccgtaccacgtgacggcgtcgggggggagcgtgacggaggagggcatcagccagtggtcgctgtgcgagagcgtgacgccggggatgtacagcacggacgactacgacttccgcaagccgaacgcgtggatgctgcaggcgcggcagaacccggtgtcgccggtgccgggggcggtggacgtgtacgactggccgggccattttgtcgaccacagccacggggagttttacacgcgcatccgccaggaggtgtggcaggttgcgcaccacagcgtgagcggaacgggaacggcgacgggcatcgcgccggggtaccggttcggcatcgtgaacgcgccgcacttcagcgacaacggagagtacctggtgacgtcggcgcggtacgacttcgaggagaacgggtacgcgagcggcggcggcggggcgcggcacaacatcgcattcacggtgctgccgtcgtcggtgacgtaccgggcggagccggcgacggcgtggccgaagacgcacggtccgcagacggcgaaggtggtgggcccggcgggtgagtcaatctggacggaccgctacggccgggtgaaggtgaagttccactgggaccgcctggcgaagggcgacgacacgagctcgtgctgggtgcgggtgtcgagcgcgtgggcgggccagggcttcggcggggtgcagatcccgcgggtgaacgacgaggtggtggtggacttcatcaacggcgacccggaccggccgctgatcatcggtcgcgtgtacaacgaggcgagcatgccgccgtgggcgctgccggcggcggcgacgcagatggggtttttaagccgttcgaaggacggcacggcggacacggcaaacgcgctgcgcttcgaggacaaggcgggcgaggagcatctttggatccaggcgcagaaaaacatggatacgcacgttaaaaacgatgccagccactcggttgccaataaccacagccattatgctggcggcaatgagctgtaccgcgttgagaccaaccgtgtacacggtatcaaaggcggcgaggagctcctgaccggacaaggcaagctggatgcagcagtctcatacctatgttctgggatccggcaccaaactgcgtctggaggtgatggccatattacaacatccggcggcaagctgaacctgaatactgacggtgcaaagcccggcaccggtgcgcctggtgccgatcacaaacagaatatcagtaaagcggtggagaacctgttcccaccgaaacagaaaggacaagcggctccagctgcgccgaaagctgcggtctctgctgccgctaagccgactgctgcacctgtagcaaatcacccggctcgcaaagcacgcccgttaccagcagataaacaagctttttttgataaggtctatgctgcagctaagatcagtgaaaagaaaacgggcgttccggcagaagtcactacggcgcaggcgatccttgaatcaagctggggagatttggttccatttgataagaaaacgaatacaagtagtaacaatatctttggaataaaatcatttggttctaaaaatgctgcggaaaccgtaacgcatgagtatgtcaacg

SEQ ID NO: 19562 - DNA, 745 bp, Glycine max
  Peptide Sequence Number=SeqID_111247
ctgggcatcctgctggtgctgctgttcagcctggcgctgggctggctgccgtcgtcgggcttcgtgccgttctcggacgacccgctgcagcactgcctggcgctgatcctgccgtcgctcaccatcggcctgaacttcatgggcgtggtggcgcgcatgacgcgcgccagcctggcggacgtgatgggccgcgactacgtcaagctggcccgcgccaagggcatgccgcgcggccgggcgatcctgcggcacgcgctgccgaacgcgctggtgccggtcatcgccatcgtcggcgtgcgcgccggcaacctgctgggcggcaccgtcatcatcgaggcgctgttcgattggccgggcctgagttcgctgctggtgagcgcggcattctcgcgcgactaccccgtgatccagggttcgctcctggccatcttcgccttgttcatcctgatcagcctggtcatcgacctggcgcagggcttcgtcgacccccgtatccgcaggccttccgcatgatcgcatcgctttcgtatctgcaagaccggcgtggcggtccggctggcgctcggcttcctggccgtggtggtactggccgccatcctgggcccgacgctggacctgggccgatccgtaccgcatcgacgccgccaacctgctgtcctcgccgtcctgacggcactggctgggcaccgacgaaactgggccgcgacctgctggcgcgggcggttcacggcgctcgggtgtcgct

SEQ ID NO: 19563 - DNA, 165 bp, Glycine max
  Peptide Sequence Number=SeqID_111248
atggtgggagcaggtttgaaaaaggatcttagagtgtctagggttgtgccaggagggtctcttaatgccttcctttttcttctcatcggagttatttcacaaagacttgccatgggcggtaatgatagtatcttgtacctgaacccggtggctcactttttctaa

SEQ ID NO: 19564 - DNA, 752 bp, Glycine max
  Peptide Sequence Number=SeqID_111249
tcctcttttcgaatgtggatgggttggtggacctggcagcgatcgacgcttttctcgcctatcataaccacaaggaaagcccggttgtcgctatgctagccgacctatatgacacgttcgaccggggatgtgaaaagagcagcgcaagaattgtttgttgtgcactggctctctatgtgtggttagtttcacacctttttctccaagaaggtaggcccgtctatccgctacaaggtcaccactcgtgcgtcgaaaaaggaaaggcgaattgggaccaactcttggctagcatggaggggcgtctgttaattggttccctcgctagaaggaaggaagaatcaggattgtatcttcatgcgaaggatgtccaaatgttccctggatgggaacatggggacagagagcttaggggaagcagtaatgggatcatcggtggctatcataagtggctgagagtccgaacacaaggattggattggctcccaaatctaaagactgtgagagacgatgaggttaaagcttcggaagaaagtgatgaggtacaagccctaaaggcagagcttgaaagagccagggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctatag

SEQ ID NO: 19565 - DNA, 58 bp, Glycine max
  Peptide Sequence Number=SeqID_111250
ttcgaaaaagagagttaggcaaggtaagaggccgaaaggcatagaagaaataaaagaa

SEQ ID NO: 19566 - DNA, 678 bp, Glycine max
  Peptide Sequence Number=SeqID_111251
atggcgaaagtgctgattaaagagctggagccgtatcgcccgctgttcattgaagagcccgtgctggccgagcaggcagagtactatccgaaactggcagaacagacgcacattcccatcgccgcgggtgaacgcatgttctcgcgcttcgagtttaaacgtgtgctggaagcgggcggtattgcgatcctgcagccggatctctcccacgcgggcggcatcaccgaatgctacaaaattgccggaatggcagaagcctacgatgtggcgctggcgccgcactgtccgctcgggccgattgcgctggcggcctgtctgcacgtggattttgtctcccgcaatgctgtgttccaggagcaaagcatgggcattcactataacaagggcgcagagctgctcgactttgtgaaaaacaaagaagacttcagcatggaaggcggtttctttaaaccgttaacgaagccgggcctgggcgtagaaattgacgaagccaaaggcatggtgagcggcttcgctatgcccaaaatctggagacagattgcgatggatattccagttactgctgcaaaaatcgggcgtcgccgctacctgacgctcatcatgatctttattaccgtggtcatttgctatgtcgaccgcgccaaccttgccgtggcatcggctcatattcaggattga

SEQ ID NO: 19567 - DNA, 349 bp, Glycine max
  Peptide Sequence Number=SeqID_111252
atggagagcgattcgctgtctactacatgtgagtatgaagtgtcacgacctagcccaaacctggttgatatccaagatggacccattgatttcatcctagtggcgatcaattccctaagtacagtctttgagaagcctgctcatcacagggcggatcgcccgcctctcaacgactatcaacccatgcatcccgagttcccggatgaggacatcatggccttgtttgaggaaaagctagatgaggaccgggacaagtggatcgtgtggtttgatggagcgtcaaatgttataggccatggtgttggggcagtattggcaacaattgactccaatgtcaagctactccaag

SEQ ID NO: 19568 - DNA, 294 bp, Glycine max
  Peptide Sequence Number=SeqID_111253
atgagacgagtgattccaacttatcagggtatagaacaaccaccggcagaaattaatcctttattacagcagtctggattatacacaacaataaaattgtgtagaatcaaaatcaatggagaaattgccaccatcacactacaagatgtgtttgtgttgctaggtcttccggtggatggcaatcctttaattggcagcacaaatattgatgggattgatatgtgtgaacaataccttggagtcaggcaaaatgctaatgcattggctaacggaaacacattgaaattaagctag

SEQ ID NO: 19569 - DNA, 165 bp, Glycine max
  Peptide Sequence Number=SeqID_111254
atgccgggtcacgaattatcagactggccacctggagtgatggctggacggaatgatcgtgcgatagcagatgcccttcaagccttagctcaggccatagggaatccgaatagaggagaagttggtggagctgttgagtaccaggggttggatcacttccaatga

SEQ ID NO: 19570 - DNA, 366 bp, Glycine max
  Peptide Sequence Number=SeqID_111255
atgactatgagtaaaaggtttatgaaagctgaggatgaagggagtgtgttgtacaaggagcaaatgggtgaaaagacaagtgctaaggttaaggaaaatgatgtgaagggtaaagagaatcaggaaaaagggaagaaaataatggtccaaaataaagagatgaagaaccaagaaaaagaaaaagaaggagaaaaagaaatagaaaatgagaaaaatgaaaaagaaaaaaaaaagatttttgagaagagtagaagtggaaaggttgtggaaaaaggtgtggaagtaccatatcctgtggtaccttccaagaaagaaaatgatcgtcatttggcaagatttttggatattttcaggaaattgaaataa

SEQ ID NO: 19571 - DNA, 441 bp, Glycine max
  Peptide Sequence Number=SeqID_111256
atggaaaaagataatttaaacgacaccctcgaagctttattgcccaaggagctcgacgacatcatcactcagaatcggcacatgatgcagttggattatgcgagtgcagaggatttagccaaaatgcataaggacatccctgtgacaaatctgaggggcgttctaactcaggcatttgtctataaacgcatcgttccaagcaagaatgctgaagttttttgtcttgttggattcaacagcgatcaggaggccttccacacctcacaagttgttgcatacgataacgttaacaatgtggctttgaccgcttccggctcacattacgtggttgagagcttcaagactggagcgccagatcttttattgctgctccacatttgcttcatgtttcaccgcgatggcattggtaactattttggcgctcagccagtttcctattga

SEQ ID NO: 19572 - DNA, 318 bp, Glycine max
  Peptide Sequence Number=SeqID_111257
atggattttggctcacccccttttccggatgttcacctcttcatacaaaaacttcaagatcggctaccttttgttccttttttattggtgaaagtgtccttgttggtcgacttagagaaggccaagagctcccttgactcaactcttcatgccaatatcactttggctgaagctgagatgaaggtgtttgagaaatgggcgctaaatgtcaacacttcagaaaagtttactatagacgaagtggtgaggttggaatctactttgactttggccaccgctgagagggaaaaaggtgctcaaaaggaggagaagctttga

SEQ ID NO: 19573 - DNA, 282 bp, Glycine max
  Peptide Sequence Number=SeqID_111258
atggaaccagctttagacgagttgattaacaaaacagaactctttcctaaaataatcccaacgtcatcatgttggcttggcagttccacaaaagaatctcacttcacgtactctactgatgcccgtctgctcccacgaatgaaggttcacgatcatcacaggtaccaaccacacggaaatagcctaagcgtgtccacgcaacactctcacttaggaaaactaagcaacaagtgtcgaggttaccctgtcgtgcataggcaactcccctcccccctatggtga

SEQ ID NO: 19574 - DNA, 396 bp, Glycine max
  Peptide Sequence Number=SeqID_111259
atggagttttatgcaaatgcctggcccactgaaggagtcatggataagccctcttgggtgcgaggccaatggatcccctatgatgaagatgctattaaccagttcctggggcatccgttggtcctagacgaggggcagcattgtgagtacaacgagagaagaagtcaggtcttaggatttgatgaggaggccataggacatctactatgctcctcggggataggactttgcacgaagcgtgatgagaagacagtttgtaggtatcacactttcaagacacctagtggacctagaaaagtccaacagagcactgggatttccagctttgatcataggtctctaccagttctatggggtgccagttacacccacaaagctcatctgacctcccattaa

SEQ ID NO: 19575 - DNA, 438 bp, Glycine max
  Peptide Sequence Number=SeqID_111260
atgacgaaggatgcgatccactgtcacaactttgcagcacccgggctccattttccatttccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19576 - DNA, 462 bp, Glycine max
  Peptide Sequence Number=SeqID_111261
atgacttccttgacccagacatggatgacgttgctgctcagcaacatcctgcccagcgatcataattccgacctccctctgccgaagtgtatgccacctaccaggcaccctctaaacctagataagtctaatagggccctgggttttttggcattgatcacgggtctctgccagtcgtccggggttcctgtcacacctagtaaggcggccaaccacagggcgcacgtgcagacccatgactgcctctaccagctcagccttagcctgcagagccagggtttccctccttttccatgccatactccggatcagttcagggcagaggtcgcatggcccggggattggcctgaggcccaggcagaggaggcacccacagaggctcccgacgatgcagatgaggcccgcatagacgaggagatgaccgatttgctcgatttcttgggagggagcggagccacatga

SEQ ID NO: 19577 - DNA, 300 bp, Glycine max
  Peptide Sequence Number=SeqID_111262
atggatgtcttgtgtcttgttggaacaagtgtgaaaccaaccaaacacagaggggcgggtaagcaacagatgatccgtgcgctactcttttcgcaccttcggtcaaatgtgtcaaatagatctgccaagacagctaccaccggacttttccttgctatggtggcccgctatgccgttccgagtctgttttatgcggtccaaacctcttgcggaatccttgaccacagttgcaattctgctcaaggaggggagacatccggaggaaagatatggttttcttcccccgagaggacatcctag

SEQ ID NO: 19578 - DNA, 242 bp, Glycine max
  Peptide Sequence Number=SeqID_111263
ggatttcctatctgttgtatctctcgttacaatctttcaaagaaatgaacgtggattcgaggcttttagtcctcacgagcaccttgggctaccttctggagtagagacaaaacatgaatggcagaaaccaatcaaggtagggtacttaaggacgaacgcaagtgggggatggggtcacgaccgaccgatcgttgcccttctctgtgcgaaacaagcagagaatgtcgctgcaaggcagcccc

SEQ ID NO: 19579 - DNA, 237 bp, Glycine max
  Peptide Sequence Number=SeqID_111264
atgctcgcaggcgcagacacgccgccacctcatcaggctggcccagctggatcatttgatacggagcagtatttatggcatttggttcgccaacaggcggccaaccatcgggcgcatgtacagacccatgattgtctttaccagttgagcctcagcctgcagagccagggttttacttcttttccatgccctactctggatcagtttagggcagaggtcgcatggcccagagattag

SEQ ID NO: 19580 - DNA, 321 bp, Glycine max
  Peptide Sequence Number=SeqID_111265
atgggcatctggctgctgattgtcagcgcgctcaacctcggtttcctgccgctggtgtttggcgtggcaatgttcattggctgcgtatcgaccgtctcctccaatgcgatggcggtgatccttgacgaatttccccatatggccggcaccgcatcctcgctggccggtacgctgcgctttggcgtcggtgcgctggttggcgcgctgctgtcactggtcagcgtcaacagcgcctggccgatggtcgccaccatcgcgctgtgcgctaccgtctcaatcgtgctgttcagctacgccgcccgtccgcgccacaccgcgtga

SEQ ID NO: 19581 - DNA, 411 bp, Glycine max
  Peptide Sequence Number=SeqID_111266
atggactcgggaaggttccaagttagtgtaccaggtaacagctaccccagtgcagttgtgggtgatactgagggccctccaaagggttttgtagggtataccaccaactgcttgcccttcagtggtatatccgagccaaggctcgaagtccggctagattgtggatggggaattttcatgggtctcttccacgggttaagagacatgtgcatgatcagtttggggttgctggctttcaatgagtataggagtggagtttttgacattcttattgggagtgtacgccgcattgggtggcgtatagttgagaggcaagccatatggcggggaggcgtgctcgttttgaatatgtacattatgggggctgcccgtacttccaaatctttgcctaccatatctgaggttggatga

SEQ ID NO: 19582 - DNA, 288 bp, Glycine max
  Peptide Sequence Number=SeqID_111267
gctcatcttggtggtgaagctccttcttccatggcttattccccagtggatggcgccgccttttacctcttcttctttgtcttccgctgcatctccatgggtgctcaacccattgatgaagaagaacatttacatggtggagaagattcctctcttcttcaaaagattttggacatgttctatggtcttcaaacctttgttggtgaaaggatcatcaaggttgaagaagatgtttcttacattcgtacaagctttgatctaccaccaccaccgccaccatcatcttag

SEQ ID NO: 19583 - DNA, 672 bp, Glycine max
  Peptide Sequence Number=SeqID_111268
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcacaagagcttaaatccttgtgctttgttggtgcccaaaataggtactattaggcaccaaatccctaaaataggtggtatgatgaatgctttgggtagtgcaacactcatttgtaaaatcactcgtgcacccaacatcttcatgatttgtgtacatagggactcattaggggtttccatgaactctaagagaataaaggtcattcctgagtggcctactccaccaagtgttgaggaaagaagcccagagtttcaagaacctcgagatttgaggtcaaatccttttcaagggggagggaatgatgcaatcctaccccgcaagggcattagatag

SEQ ID NO: 19584 - DNA, 555 bp, Glycine max
  Peptide Sequence Number=SeqID_111269
atggagagaagtatgatagatgctgccagtggtggagcccttggagacatgactcctgctgaagccagaaatttaattgagaagatggcttccatctcccataagaagcttgaaggcaaactggatgcattggttaacttggtaacccagctggccttgaatcagaaatttgtacctgttgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagaacaattatgacctttccagcaacagatacaaccctggatggaggaatcacctaactcagatggtccagccctcagcaacaacaacagcagctgctcttccttccaaaatgctgctggcccaagcagaccatacattcctccaccaatccaacaacaggaacaaccccagaaacaaccaacagttgaggcccctccacaaccttcccttgaagaacttgtga

SEQ ID NO: 19585 - DNA, 177 bp, Glycine max
  Peptide Sequence Number=SeqID_111270
atggcaggaatgggaaagttggatcatcttaaaggaaaggctcagggcccattgaaggaggtgccggactttggcaagtacaaggggactactcgctccaagaaccatctaaagatgtactgtcggaagatgggggcatacgcaaaagatgagaaactgctgatacatttttcctga

SEQ ID NO: 19586 - DNA, 612 bp, Glycine max
  Peptide Sequence Number=SeqID_111271
gtgctccagtggcttctgtttctatcagctgtccctctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggttggactatcatctggattgtcttgcaagcaggaagatcgagagagaatggtggttcgaaggtttaagtttgaggacccacgtattgagcaaattcaagatcttgagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 19587 - DNA, 321 bp, Glycine max
  Peptide Sequence Number=SeqID_111272
atgggattagtgggagaacgctctcagacagctgataagtctcttgctaggacattaatgagtacactgaccaccatgaagtttgatgttcgggaagaaacgcttaagaatcaaggaagtcactcagtccattatgtaagccaccaaggaaatcaaggagctgaaaagaaatttatgaggaagcatgataaaggcaaagggtcattaaagatcaatgacaactctttgcaaatccagaagaagatctcaaagggcaataatttccaattttatgtgaaatatggacacttccataaggatttcctaaaacataagtcttga

SEQ ID NO: 19588 - DNA, 576 bp, Glycine max
  Peptide Sequence Number=SeqID_111273
atgactacctcaccaaaagaaacttcagcttctggttcaccctctgtgccatcatctccgcaccaggaacaacctgaattcaacatccaacccatacaaataattcctggtcaagcccctgttcctgagaaactggtccccaaacgacaacagggagtgaagatttctgaaaaccctagccttgcaacaagtcctagggaagtagacacggagatggacaagaagatccgcagtattgtgagtagcattctgaaaaatgcttctgttcctgatgctgatgaagatgttccaacatcttccaccccaaatgtttctgtgcctgatgctgataaagatgttccaacatcttccactccaaatgctgaagtcctctcttcctccagcaaagagagatcaacagaggaagatgatcaagccacagaggagacccctgcaccacgggcaccagaacctgctctaggtgacctcattgacctagaagaagtagaatctgatgaggaacccattgccaacaagttggcacctggccattgcagaaagactacaaagccgaaagggaaaaacccccatcactag

SEQ ID NO: 19589 - DNA, 444 bp, Glycine max
  Peptide Sequence Number=SeqID_111274
atggtgtccggatgcgcgcgcccttggcgtgcccgaaatccggaggcaccgagtgcgcgctcctggcacgtccctgggtgtactctaaccgcattcaggctccaaggtcttgaaacacggcctaagggtcgatggaacaatgtagtgcaagggaagtcacgggcgagtaaacgatccgtaactcggcgcaaggaagctgattggctgagggccccctgtggttgcaccgggggcccagtcccgaaccctgtcggttctgtcgagtggactgctcgagctgagagcatacctgtcgggccgaaagagcggaactggcgatgcgggatgaaccggaagctgggttacggtgcccaactgcgcgctaacctagaccccacaaagggtgttggtcgattaagacagcagacgtggtcatggaagtcgaaatccgctaagagtgtgtaa

SEQ ID NO: 19590 - DNA, 632 bp, Glycine max
  Peptide Sequence Number=SeqID_111275
atgggaacaaatcaaaacggaaaaaggttctatcaagtcaaaattaagggcctagatgtcaccagccttaaggagttgggacggttgatgggacccttccaaaggcaagccttccgcaaagtgtacggaaagattttagatttgaccacagtggaggtatttacggaagccgttgtatccctcgcccaatactatgaccagccgttgagatgcttcacgtttggggacttccaaatagtaccgactgttgaagaatttgaggagattttaggatgccctcttgggggaagaaaaccgtatcttttctccgggtttcttccctccttgagcaagattgcagctgtggtcagagattcggcgagagagttggatcgtatgaagcaaactcgaaacggcgtagtgggcctaccgcggaaatacttggaaagcaaggcaagggatatggcgaatcaagaggaatgggtcccgtttgcgaatatactagcttttctaatctttggggttgttctctttccaaacatggacggtttggtggacctagccgcaattgatgctttccttgcatatcaccatagcaacgagagcccggtggtggctatcttggcggacttatttgatacatttgaccgaag

SEQ ID NO: 19591 - DNA, 671 bp, Glycine max
  Peptide Sequence Number=SeqID_111276
atggcatccattgctgggtaccacgaatggcctgaaactctcaagagagccgagttaggtaagaggcaaaagctcgccaggagaagttcaacgcggctgctacacacgttcggaaggagtgcgccgcgtcagttacggctggaagcagcccaactctctggcaattactgcgcacagagctcccttgcaaacatagtagcagacgggtcgcaagggacaccggggcacgatggcagccctcaccggatacaaatttccgagcggacttacttatggggattgcccccaactaaggaactcaccacccgtcttgcgaagggagtgatgccttgtcctcaacagcccgacgaggtccataaagccaagacttgtctcgaagggatgtcgagtacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggctctcggctat

SEQ ID NO: 19592 - DNA, 615 bp, Glycine max
  Peptide Sequence Number=SeqID_111277
atgtttgggtaccctccacatgagaaaaggactccctcctttccttccttccatcgggggaaccaagtcaaggttaaaagcctagataccaccagcatcaaggaattagggcggttgatggaacctctccaaatgcaaatcttccgcaagacttacggaaagatcttagagttgaccatagcagaggtatccatagaagccattgcatcactcacccaatactacgaccagcctttgagatgcttcacgttcggagacttccaattggtaccgaccattgatgaatttgaggagattctaggatgtcctctcgggggaagaaaaccatatcttttctctggttgtctcccctctttgagcagaattgcaactgcggtcaaggattcagcaagaggggaaaccaacaaaggagtaagtcatgtcgccaactgtcgcaacctatccttcggcgggagggcgacgcgtgactcgcgggatgcgtgttccacgaaaggaatccccagtggagtcgccaactgtcgcaacctacccttcggcgggagggcgacgcgtgactcgcgggatgcgtgttccacgaaaggaatacgcgcggagtcgccaccaacgtttatttga

SEQ ID NO: 19593 - DNA, 444 bp, Glycine max
  Peptide Sequence Number=SeqID_111278
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggtaactatcgtcttgagtccaacccgggaagacatgcaaaagcaccactggcagcagccactg

SEQ ID NO: 19594 - DNA, 258 bp, Glycine max
  Peptide Sequence Number=SeqID_111279
atgaagcatgcggttacagttgccgctacccgccgctatgctaaggcaaagatttgggaagtatgggcagctccccattatgcgctgtcgcaacgtgcccttttgtgggcgtgcgaggcgaggctcacgggtgcgctttccaaaggaggaaagatgtgtggagtcgccaccaacgtttatttgtggaaaacgtcgggaaaaccgaaggaaataagtcaaaatgaaaattctaagttcgggagttgtatttacacttga

SEQ ID NO: 19595 - DNA, 481 bp, Glycine max
  Peptide Sequence Number=SeqID_111280
atggccgacgaagccaaagccaaaggcaacacagccttctcctccggcgactaccccaccgcaattcactacttctccgacgccatcgctttggcccccaccaaccacgtcctgaagatgcgtacctgtttcgctatgggaggggatggccatcgcaatcaccacttcactgaaactgtggctatgggagggattgggccaaccatggggcttgtggacattggaaagtgtactttggtgaatgtggtgatcccacgaccaccgcctgatggtgaacttgccgctggagttggaaagcaagtagatacttgtgtgctcgggttgccaccctatgaagcaaaaaggtcaccatatattttgcatctatggggttatgtattcaagacagatgatttagtcaggcttctgaaatggagatatcctacacctaatgactttggatctgaaatcattcctgcagctgagggaaaacaatgtccat

SEQ ID NO: 19596 - DNA, 222 bp, Glycine max
  Peptide Sequence Number=SeqID_111281
atgaacaattgcttgttggcaaagtctatgaatacattagaggtgtcaagcctactgaaatctctccaagtttgggctcacattcgtgatttgactcctttccgcaagcgtttcacttctttacagcgcattactgactctttaattaggggtagatccacatcaggtgttcaaggaaaattacgttgtctggctatagcaattacagtctactgcatctga

SEQ ID NO: 19597 - DNA, 297 bp, Glycine max
  Peptide Sequence Number=SeqID_111282
atggggattacctcacctaggaacaaccaacaaacactaaaggaagaagaaaggaactccatttttgcacaacaccaaagttcaagattttctaatggtggtttcttggagaagagagaattgtgtcgcaacctactgtcgcaacctactgtcgcaacctaccctttggcaggagggcgacgcgagactcacgggagtgtcttccaagaaaggaatacgcgcggaatcaccaccaacgtttattcaaggaaaacgtcggaaaaaccgggaaagacgtggtctacgaactttaagtga

SEQ ID NO: 19598 - DNA, 561 bp, Glycine max
  Peptide Sequence Number=SeqID_111283
atggtaggcaaagatttgggaagtacggatgaccccatgatgtgcaaattcaaaacaagcacgccttcccgccatatggtttgcctcccaaactatacaccacccaatgtggtgtacattcccaatgaggatgtcaataactccactcccatactcattaagagccaacaacctcaatctgatcatgccatgtctcgtcgacctcagaggagacacatgaaattccccaccaacatacaactaattgaactcctggtatctctgaaggcaatgcatggtggtaacctaaaacacttggacgggccctcaatttcatcccaaccttacatcctcacgttccagcagcggttaaaaaaaggacacgctttacggcgcccttaccgaactcgtgctagagctagagtaatgggtgaagcagaggaggtgcaagagaagatgaaggccgaaatggaggccatgaaagagcaaatggccacaatgatggaggccatgatgagcatgaagaagataatggaagccaatgcggttatagttgccgctacttgcgctgtcgctaagtga

SEQ ID NO: 19599 - DNA, 300 bp, Glycine max
  Peptide Sequence Number=SeqID_111284
atgctgcataatatgatggggcttgcaaggttacaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcataa

SEQ ID NO: 19600 - DNA, 583 bp, Glycine max
  Peptide Sequence Number=SeqID_111285
atgggctgccgccagaccatcctgcaggccgtccagtcggatgccgatatggccatttgtagcgaacgtggctccgttctcttgccaaggttggttgaggtacgcgcggggatcgtcacgcccgcagaagggtttgaggtcgatcatggtgggtactcttttggggaggtggacggcctacagctttccgttgcggtccaggacgctgagaatgggcgcgagaatgtcgagcagggcttcgatgaacttgatcatggggaattccaggtaggggatcaggcaacagcgcctgccgataccccgcacgcggggcatgagccggggctgtcaggcggccgcagccatgagccggggcaagccgacgaactcgcggcccgcatcggtcaggatcgcgccgaaatacggttgttgcttggtgccgtcgtcgggcgccatcatggcgcggccgatggtgatgagttccggggcggcgcgctgcacttcgcggaggtctacggcggtgccgtaggcccacacgtccgcgccattggcgacggcgcgcatggcttcgatgtgcttggcttggaggtcgttcttggtcatg

SEQ ID NO: 19601 - DNA, 426 bp, Glycine max
  Peptide Sequence Number=SeqID_111286
atgtcgagaccttacatattgaatttcgagcgtcctgatatatttattatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19602 - DNA, 66 bp, Glycine max
  Peptide Sequence Number=SeqID_111287
aatgacagtgggcagggtgtagggagtaagattctggtgaggagtcgccgagctcgacgtgatgac

SEQ ID NO: 19603 - DNA, 558 bp, Glycine max
  Peptide Sequence Number=SeqID_111288
atgggtgagtgcaccatcacactcgaagatgttgcactgcatctaggcattagagtcgatggtcgtgttgtggctggacctaacttcttacattataatgagttatgcgatgagttactaggagaagtccctcccgaaaatgcacgtaaaggagctgcactgaagttggcatggttgctaagcatcttgtgcgcaccattgcctgaagaaccaacaatacaccaactacaatgcaggtgtagagcttacataatgtacatgattggcgcatcatcggaggttggtaaagttatgggtggtggtgccatactattgcagtcatgggcttggtaccgcatgccttttattgcaccaagagtcccacgacccgaaacaacttatccactggctaaaagatggagtggtgatagattaaaatatagggtcacacctcatggtgacttggtcagatatagatctcgtatagatcatatggagggccatgagttttcttgggtcccatatagaggatttgaagaacagctatcgagacatgcatatagagacatggagatttag

SEQ ID NO: 19604 - DNA, 174 bp, Glycine max
  Peptide Sequence Number=SeqID_111289
atggctccaaagtttgcttgtcccaaattcagatttcaattacaaggtggagctgatattgaggaggaactaacagatttgaggtcaaatcctcttcaaggggaaggggatgatgcaatcctccctaggaagggaccagtcactaaagccaagagcagagctccagaggattga

SEQ ID NO: 19605 - DNA, 934 bp, Glycine max
  Peptide Sequence Number=SeqID_111290
aggactacaagtcctcgccatcagagggttacacgctctcacctttagagaactacacgtcctcgcattcagaggactgcatgtcatcaccttcggaggactacacgtcctcaccttcagagggctacacgtcctcgcccttagaggacttcacgtcctcaccttcaaaggactaaacatccttatcttcagaggactacacgtcctcatcttcagaggactacacgtcctcaccttcagagggctacacgccctcacattcagaagactacacgtcctcgcctttagaggacaacacgtcctcgccttcaaagggctgcacgccctcaccttcagaagactacacatcctcgccatcagagggctgcacgtcctcgcctttagaggacaacacatcctcgccttcagagggatgcacgccctcaccttcagaggacaacacgttctcgccttcagagggctgcatgccctcaccttcagaggacaacacgttctcgccttcagagggctgcatgccctcaccttcagaggactacacgtcctcgccattagaggtcttcatgcccttgccttcagagggctacacatgctcgccatcagagggctgcacgtcctcgcctttagaggacaacacgtccttgccttcagagggatgcacgccctcaccttcagaggacaacacgttctcgccttcagagggctgcacgccctcaccttcagaggactacacgtcctcgcaatcagaggtcagcatgccctcgccttcagagggctacacgccctcgccttcagaggactgcacacgctcaccttcaggggttatacgccctcgccttcaaagggcgacacatcctcaacttcagagggctgcacgcctccgccttttgagggctacgcgtcctcactttcagtgggctccatatccacaccttaa

SEQ ID NO: 19606 - DNA, 473 bp, Glycine max
  Peptide Sequence Number=SeqID_111291
atgacaaaaacggtttgtacggataaccggttggggtatctccgtacgtcacctgacttcacggggacaatcgcttcgggtatctccatacgtcacttgacttcacgggtcaagatgacaaaaaccgtttctacggataaccgtttggggtatctctgtacgttacctgacttcacggatagcgcggaagacgacgtaaatctccgtgtgtctacgggctcgttggccgcgattgacaaagggatgacagaaagcgcggaagacgacgtgaatctccgcgtgtcaacgggctcgttggccgcgattgacaaaggtgtttatacggataaccacttgggtatctctgcccgccacctaacttcacggggtatctccgtacgtcagctgacttcacgggtcaggatgacagaaatcgcggaagatgacgtaaatctccgcgtgtcaacgagctcgttggccgcgattgacaaagg

SEQ ID NO: 19607 - DNA, 312 bp, Glycine max
  Peptide Sequence Number=SeqID_111292
atgggctacgccataaatagtttccttacacctagatgtttagaaattttgttcatcatgaacatgaaatggccccaaggaagcttgcctcaaaaagatccaggaaagacaaggcggttgaaggaaccagttccgctcccgaatatgacagccatcgttttaggagcgctgagggatgacgagtatactgacttccaggaagagatagttcgccggcggtgggcatcgctggttacccccatggccaagttcgacccagacgtagtccttgagttttatgccaatgcttggcctacagaggagggtgtgtga

SEQ ID NO: 19608 - DNA, 486 bp, Glycine max
  Peptide Sequence Number=SeqID_111293
atggcagcccaaggtaactttctgaaagaacatgagatggaactccaacgtcttaatcaaaatgaagaaaccgacaaaaagaagagaagtatagcccttaaagcctcatcatcaatgcaagaagcaaatgaagaagaagactcagatgatgaagaagacttctcactctttgtcaagaagtttcagaaatttgtcaagagaacaagaatagaaaggcgtcagaactttaacaatggaaaaagatcacaagaagactctcaagttcttagatgttacaaatgcaatcaacttggtctcatcaaagctaattttccttcaaatgaagaatggcctgagaaaagtgataaggaaaggtataatgaaagaagaaccaagaaggcctacattgcatgggacgacaatgattcatccgatgattcagaaaaggagatcaatcttctaaccaaggattatgagagtgatgaaaacatctctcaagaaggttaa

SEQ ID NO: 19609 - DNA, 120 bp, Glycine max
  Peptide Sequence Number=SeqID_111294
atggaggccgtagatggtttaaaatcttgtggaaatggctttacgaaaacaggtgccaatccaacagatattcttccaaaagtggctttgacaatccgtctatatactgttcagacctag

SEQ ID NO: 19610 - DNA, 453 bp, Glycine max
  Peptide Sequence Number=SeqID_111295
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactatggggcgattcagtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 19611 - DNA, 307 bp, Glycine max
  Peptide Sequence Number=SeqID_111296
tgggggtgcaaatagcacccaggcccacttgggccctccagaatatttcctccagaaggctgttgcttctggaggaaagcaaaccttggctcgcctgggcgagctgagctcgcctgggcgagctgggcggcaaccacctcccctatttgctataaataggggaggaaatgaagaaggaagggaaaaatctaagccgaggcgcttccgaaacgttttccgtaacgttttccgtgaggaatctcgcaaaggtttgaaccgttcttcgacgttcttcattcgttcttcatcgttcttcgatcttcaacgg

SEQ ID NO: 19612 - DNA, 824 bp, Glycine max
  Peptide Sequence Number=SeqID_111297
acgccctcaatcagttcctgggatacccgctagtattggaggagggccaggagtgcgaatatggtcagaggaggaaccgggccgatggatttgacgaggaggccattgttcagctgctatgcataccaggtcaggattttgcccggatcgctgtcgggagacgggtgcggatcatgcgcaccaacatgactaccttgacccaaacatggatgacgttgttgctcagcaacatcctgcccaacgatcataattctgacctccctctgccgaagtgtcagctggtgtatgccatcctgacacggatgagcgtccatgtggctcagttgatcgctgatgccatttatttatttgcaggtatgccacctaccaggcaccctctagacccagataagtctaacagggccctgagttttccagcattgatcgcgggtctctgccagtcgttcggggttcctatcacacctagtaaggtgattcgaccaccgatcacccgggctttcatagagaagtattgcacgcttagacaggtgcagggtggtgacccgcaggccccagacgcaccgccgccacctcatcaggctgatccagctgggtcatttgacacggagcgatatttacgacatttggttcgccagcaggcagccaaccacagggcgcacgtgcagacccatgactgtctctaccagcttagcctcagcctgcagggccagggttttgcttcttttccatgccctactccggatcagttcagggcagaggtcgcatggcccagagattggcttgaggcccaggcaggggaggcgcccgcagaggctcccggcgat

SEQ ID NO: 19613 - DNA, 825 bp, Glycine max
  Peptide Sequence Number=SeqID_111298
tggatcccgtttgatgccgacgctatcggccaactcctaggatatccgttggtgtgggaagagggccaggaatgtgagtatggccagaggaggaaccggtctgatgggttcgatgaggaggccatcgcccagctgctatgtataccggggcaggattttgcccggactgctgcagggaggcgagtgcgaatcatgcgtaccaacatgaccaccctgacccagatatggatgacgttgctcctcagcaatatcctgcccaccgatcataattccgaccttcccatgccgaagtgtcagctggtgtacgccatcctgacacggatgagcatccatgtggctcagttgatcgctgatgccatctatatttttgcaggtatggcgcctactaggcaccctttggacccagacaagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgccaccaccgcctcatcaggctgccttgactgtatatgggaaatggccccgaggaagcttgcctcaaagaggtccaggaaggacaaggcagccgaagaaactagttccgctccggagtatgacagtcaccgctttaggagcgctgtacaccagcagcgcttcgaggccatcaagggatggtcgtttctccgggagcgacgcgtccagctcagggacgacgagtatattgatttccaggaggaaatag

SEQ ID NO: 19614 - DNA, 360 bp, Glycine max
  Peptide Sequence Number=SeqID_111299
atgcaagaagaatcagaagatgaagaagacttctcactctttctgaagaagtttcacaaatttgtcaagaatagaagaatcgagaggcttcaaaatttcaaccatggaaaaagattccaagaaggctctccaactcttagatgctacaagtgcaaccaacttggtcacatcaaagcaaattgcccctcaaacaagcaatggcctgagaagaatgataagaaaaaccatgaagaaagaaggaccacgaaggcttacatcacttgggatgataatgattcatcagaaggatctaaaaaggaggaaatcaatcttttaacaaaagactatgagagtgaagaggacatcactcaaagggattaa

SEQ ID NO: 19615 - DNA, 204 bp, Glycine max
  Peptide Sequence Number=SeqID_111300
atgcatgaattgcatagtatgttagttcaggaagaagcgaggcttaagaatcaaggaagtcattcagtccattatgtaagccaccaagggaatcaaggagctggaaagaaatttatgaagaaacatgataaaggcaaagggtcattaaagatcaatactctttgcaaatccagaagaagagattctttacaatccaaaccataa

SEQ ID NO: 19616 - DNA, 716 bp, Glycine max
  Peptide Sequence Number=SeqID_111301
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcactttattgagcaataaaatgaccgccagcgtgaaagccgccaggccaatattcccggtggagccccagtccgccgccttggcattaccgcccatcgcccaacgtaccgccaccggcatcaatgacaggccaatcaccgtcaccacagtgccggtcaccaccggtgggaagaaacggataatgtgtgaaaagaatggcgcaatcaacaacccatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 19617 - DNA, 135 bp, Glycine max
  Peptide Sequence Number=SeqID_111302
atgtctttttcaagagatttactctctggtaatcgattaccaaagagctcgcctgctgaggtacatcagaggttctcactggctgactatgcccgggttgggttgggattgatcaagcttggttttgggcaatag

SEQ ID NO: 19618 - DNA, 429 bp, Glycine max
  Peptide Sequence Number=SeqID_111303
atggataacgaagagggagtgcaagaacagatgaaggccgacctatcggccttaaaagatcagatggcttctatcacggaggccatgctaaagatccaaaaaactatagaagataatgctacggtggccgcttccaatatagctagggaagcggaaccggtgctacagcccgcaataaacttgggccgagacagaaacgtgacggtttttaatcggaggtatagtcctcaagcctacccttatggtttgcctccagacttcactccttgtgcctctccagacgatttgagccaagcccctactttcgaggggcagctccctcctcatgccgactatcctctgcaagaagatgatgaaggagatgcccatttaggccctctacttcccctcaaggaaccagccccccatgagtttccccaaccacacata

SEQ ID NO: 19619 - DNA, 237 bp, Glycine max
  Peptide Sequence Number=SeqID_111304
atgcggagatacccgagtggttatccgtttaaactttcttttgctatctctaagactcaaagcatgatagcacgtgcagagactaacgcgtatcttctgcaccctttgtcaatcgtggccagcaagcctgttgacacgcggagatttacgtcatcttccgcgcagacaatttctgtcatactgaccctggagtcacatgacatgtggagatacccaagtggttatccgcacttttaa

SEQ ID NO: 19620 - DNA, 586 bp, Glycine max
  misc_feature (586)..(586): n is a, c, g, or t
  Peptide Sequence Number=SeqID_111305
atgaagcaacaactctctgactatggaatccttcttgaccatatacctattagaacacctcgtcccgaagccaccggagcatccccagcaccaattccgccctccttgtcatcctctacattgttttcatctgatgaacaacgtatctgtcacgattcaccttttgagggcaccattgttgacgactggaagtttgcttactctagtcttgatgcccgtcgtatggtctgcaatgatcaggcggatatgaccggcagactacttgctggttcattgacatttgattatcgcatcatgcactacatcattgttcgcattttattacccagttcatcaaacttagttcaagcctctaaagaggatttaatattgatgtgggcttttctcatcggtcgtccgatcgactgggcccatttgatcagataccacatgcataaggcattgcggtcaaatgcacctttgccttatccacaacttgttactttgtttcttcatcattttcaaatttccttggataatgagccctttgtgaaagtcaaacgttcttttgccattggtgcttgtgcagtaacctccttcagctacn

SEQ ID NO: 19621 - DNA, 645 bp, Glycine max
  Peptide Sequence Number=SeqID_111306
atggaagccaatgcggttatagttgccgctactagcgctgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaagctatacaccatccaatgtggcgtacattcccaatgaggatgtcaataactccactcccatactcattaagagccaacaacctcaatctgatcatgcacatgtctctcaacccatggaggagacacatgaaattccccaccacgatctagccaacttcgagccttgcctcggatataccgttgaagggcaagcagttggtggtatacccctgcaaaacactttggagggccctcagtatcatccacaaccacaaccttcacgttgcacagcggttaaaaaccctcatgactatggcaggatgcaactacagaacatttgcaaaaagggggacggatctttcaaagaacacgcccaaaaggtggagggatctggcggcccaagtggtacccccaatgatggaaagggagacgataatcgtgatggtagacacattatcgatactctactatga

SEQ ID NO: 19622 - DNA, 420 bp, Glycine max
  Peptide Sequence Number=SeqID_111307
atgaatcttgaagaacggtcgaaaatcttcgcgttattactcacggaaatgttacagaaacgttacggaagcgcctcggcttggattttcttcacggaaataattttcctcagcaattttgagagagagagaaggagaagcttgccacccagctcgcccaggcgagcaaggttgcttcctccagaagcaacaaccttctggaggaaggatctggaaggcccaactttcgaagaagttatggaaactcacggattgcgcaaaaacacctcttttcgacttccaccacattacagaatttcacggatcgcgcaagcttgcttccttttgatttctgagacgtctcgggacttcatttattgtgcaacaaaggacgccaagtatctcaaagcggctaaccaaaggttgcatgtcatcaagtaa

SEQ ID NO: 19623 - DNA, 627 bp, Glycine max
  Peptide Sequence Number=SeqID_111308
atgggatttggctatgatagaatgctattggtgttcggagtcgtcctctttccaaatgtggatgggctagtggatttagcggcaatcgatgccttccttgcttataaccacatcaaggaaagttcaatcgttgctattttggccgatgcctatgaaacatttgactggagatgcgagatgagcagcacaaggattgtttgttgcacccccgctatttatgtatggttggtctctcacatcttttgtcatgaaagtagacctgtctctcctctacaaggtcaccgcatgtgtgccgagaaagggaaagcaaattgggagcaactcctgactggtatgacaacttggctaccccatgagaagagcaccatcggaagagagtatcgcaagcctttcattgcacgaatcttcagtgaaccaaaatcaagagtgcttcaaagagttcgaaaagcatggaatgcggtgcacaaaaaggataaggagcttaagggaagcaacaatgggatcgtcggcggctatcacaagtggctgagggctagaatgcaagagataacttggctcccaaagctaaagatttcaagtgaggaagaggctgaaccccagaggagagcgaagaggtgcaagccttga

SEQ ID NO: 19624 - DNA, 621 bp, Glycine max
  Peptide Sequence Number=SeqID_111309
atggttaaggaggagtgtaaggaggtaagtgtttcctccaagaggttagctaagaaggaaagacattttgaaataaagataaatattaaagaaatttcccttcttagacaacctccacattttctcctttgtaaaaagacacttgttagcattgccacatctcttaggcttgagtttattcctcaagtaaaggagttgttggatgagggtttggttcgcaagagattacctactgtgctttgtctggtgcccaaaatagcttttaccttttgcaaacccccaacaagaaagaaccacaacttaggaaccaacacgagtcatcattcatctagtgttaattgtgagggtactagtcataaggaccctctatctaaaatattagatgggttgagttccctcaagttatggaaagaaaaactagaaagaagagaaaaaggaaaagagaaggtagaaataaatctagataagagggaacaaataagggaagaagaaagaaggaaaatactaagagagttaagaaaagaaaaacacgtctcctatagtagtcatgactcctgcaagagcctaagtgaagaacgtagtgactattatggaggaaaaggaaagaacaagtattgctag

SEQ ID NO: 19625 - DNA, 285 bp, Glycine max
  Peptide Sequence Number=SeqID_111310
atgccaagcacctcacaaggaccaaagaaaggtcgcatgtcatcaagcaaaggtccccgcccgaaattagggtatgacagggagttatctttacgtaaaaagaaggtcgacaaaagcggggctcttgctcctacgtaccctccatcgaagaggaaatcagacctacgtagttctttcaaaaggggcaaatcaagcgattctttttacttggaaggtggttatttaaggcgttggaccttaaaacgttttttcagtaatttttgcggacaaagcttgattttgtga

SEQ ID NO: 19626 - DNA, 285 bp, Glycine max
  Peptide Sequence Number=SeqID_111311
atgaggctactacttcaccttcctctagtgaaagtgaagaagcaaaaggagaagaatctagtgaagaaatctatccccaagaagaaggacacctttaatggtattattaggcaccaaatccctaaaataggtggtgtgatgaatgttttgggtggtgcaacactcttttgtaaaatcactcgtgcacccaacatcttcatgatttgtgtacatagggactcattaggggttcccatgaaccctaagagaatgaaggtcattcttgagtggcccgctccaccaagt

SEQ ID NO: 19627 - DNA, 621 bp, Glycine max
  Peptide Sequence Number=SeqID_111312
atggataagaagatccgcagtcttgtgaatagcattttgaaaaatgcttctgtccctgatgctgataaagatgtcccaacatcttccaccccaaatgctgaagtcctctcttcatccagtaaaaagaaatcaacagaggaagaggatcaagccacagaggagacccctgcaccaagggcaccagaacctgctccaggtgacctcattgacctagaagaaaaagattacaaagcagaaagggaaaaacccccattctggtctggacgtatcaaaactattgcacagaagaagagcacccaatcctcctatttccacatggttccagaggagcaaagttgctcccttccgcaagaagcagagatattgcagcaggaagcagctgttcatcaatctgattctgatgaagcagatgctgaaggagtgaaatttgtatatcacacgagacagttgcactggaaagagaacggaagtagcagataccttgattccaaggagacattggacctcaaatcaggctgcgctgctgaaaaactgaggggccaagtggaggatttgcctgctagaggaattatagcagctacttatatcctgaacgtgctcaaacgtctcactcaacattaa

SEQ ID NO: 19628 - DNA, 141 bp, Glycine max
  Peptide Sequence Number=SeqID_111313
atgaaaattcctaattcgggagttgatacgtttgcagaaggggagcatgcttgccgcccagctcgcccaggcgagcagggttgcttcctccagaagcaacagccttctggaggaatcttctggagggcccaagtgggcctg

SEQ ID NO: 19629 - DNA, 135 bp, Glycine max
  Peptide Sequence Number=SeqID_111314
atgtcggctgaaaagtatcagtcgcaggaaatgttcgatgtgggtcaccaggtgattctttttcagacctctctatctgttaactttcctggccgatgtcggctagcatttttgtcgatcagtatcggtgaataa

SEQ ID NO: 19630 - DNA, 383 bp, Glycine max
  Peptide Sequence Number=SeqID_111315
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgagcatggaggccaaattcacttataaccctgtctgctgaatatgactccacgaagatctttggttcatccaccaagttcggtcttgctctagctctcaagccttaa

SEQ ID NO: 19631 - DNA, 207 bp, Glycine max
  Peptide Sequence Number=SeqID_111316
atgcatgaacaacgctgggcaatcaattcatggggctccggacttgattgtctctggatagtgaaaaaaaaatgcggaaccaaatggttcccccgcatgtcatcgggcccgccgcctctggatgacaaaggtgcagatgaccataatttgtctctgcatgtcaacgggctcgcttgcctctggttgacaaaaggtgcaggaccataa

SEQ ID NO: 19632 - DNA, 479 bp, Glycine max
  Peptide Sequence Number=SeqID_111317
ggcgtgcagccctctgctggtgaggacgtgtagtcctctcaaggcgaggacgtgtagtcctctcaacggtgaaggacgtgtagtcctctcaaggcgaggacgtgtagtcctctcaacggtgagggtgagggcgtgcagccctctgatggtgaggacgtgtagtcctctcaaggcgaggacgtgtagtcctctcaaggcgaggacgtgtagtcctctcaacggtgaggggcgtgcagccctctgttggcgaggacgtgtagtcctcccaaggcgaggacgtgtagtcctcacaacggtgagggcgaggacgtgtagtcctctgatggtgagggcgtgcagccctctgatggtgaggacgcgtagtcctctcaaggcgaggacgtgtagtcctctcagcgaggtgagggcgtgcagccctctgatggtgaggacgtgtagtcctctcaaggcgaggacgtgtagtcctctcaacggtgagg

SEQ ID NO: 19633 - DNA, 336 bp, Glycine max
  Peptide Sequence Number=SeqID_111318
atgtcagtgaaaaaccttgttgggtgcctaggagtacatgacaagacaaaccacacactaggagaccagttaaggtcacgctgttttgtgagaatgctccaaccatgtgggatcggcacaggcttaaaggagcattcaaaccaagtgtatttacccccaaggcctacacttcgaagagtccatcagggccactccctcctgattcagaatacttatttactccctcttctaaattggtattacttgtttttatatgagagtggtcttaccggcaagcgcaccgggtcgccaaatgttcccgtgttctatgctgaggacaaaaatatcaaacactga

SEQ ID NO: 19634 - DNA, 102 bp, Glycine max
  Peptide Sequence Number=SeqID_111319
atggtaagaccctttaagaccgatgagtttttgcgcgaggagtattgtgatgggatccactatgggaacccaacgagtttaatcactttgaggtgcaatgag

SEQ ID NO: 19635 - DNA, 369 bp, Glycine max
  Peptide Sequence Number=SeqID_111320
atgttcaagaactggcaatggagtatacaaaccgtgtggcatgaccttggatttagttttcttgcaaacaagacatttatcacaaaaattatgcacatcatgcttcattgccccattaagcccccttctgtggaagtaatgacttccaagattattttgatgatgccaaagaatcaagagttaagcaagttccaaagaatcaggagtcaaaaagcttcaagaatcaagtctcaaagaatcaagattcaagaacaatcaagtttcaagattcaagattcaagaacaatcaagtttcaagaatcaagattcaggaacaatcaagatcaagattcaagaatcaagagaagactcaatcaagataagtattga

SEQ ID NO: 19636 - DNA, 210 bp, Glycine max
  Peptide Sequence Number=SeqID_111321
atggaagctttgagcacactccagacatcttctcaagatcacaacggtcagatcatggacaagtgtcttgtgaagctgcagaccacatttagagaagatccaacggttaacgaaggctgggtagcatttttaccgaggcagcttcatgtagcttcctcaagaagcttcattaagaggcttcttcaagaagcttccccgtggcttctttga

SEQ ID NO: 19637 - DNA, 594 bp, Glycine max
  Peptide Sequence Number=SeqID_111322
atgggatcgaatcaaacaccattgctcaagaaaaggttctatcaagtcaaaatcaagagtttagaggttgccagtttacgagagttggggcaattgatgggtcaacttcaacggcaagccttctgcaaagcctatggtaagatttgggacctagctatcatagaagtcttcgtggaagtgattgcatcccttacccagtattatgatcagcccctgagagttgaagaaatcctgggatgcccgctgggaggaaggaagccatatcttttctcggggttccatccctccatggctagagttgccaaggtagtgaaaatctcgacacaagagttggaccgagtaaagcaaaatcggaatggggtagtcagagtactgttaattaggcaagctttggaaaaggctgttttcaccttctcgctaagccaatatgttggcttagcgagttcactaagcgcaccgcttcatctctctaagcgcaccgcttcagttcatccgctaagcgagaaaggcgcgctaagccaaaaatcactagcgtgcgctaagcggtccatacatgcgctaagtgcacgagcacgaacaaggccacctatttaa

SEQ ID NO: 19638 - DNA, 519 bp, Glycine max
  Peptide Sequence Number=SeqID_111323
atggcctcttctggaccagttttttctttttctggaactccaacaataacatctacaaaactgaactggaaaaattatctatcttggtctgcctctgtggagctttggttccttggccaaggacatcatgaccatttggagaaaggagttgatgctgttccaaatgacagaaaatttgagtgggagaaacttgactatcaactctatgctgtattatggcaatcagttgagccagatattttggagatccttaggtcattcaaaacgtgtcattcgttttggaaaaaggcccaagagatctttgcaaatgacattcaaagcctctttgatgcaaccatgaaggttacagctctcaaacaaactggacatgacatgattgcacatgtagggaaggctagggctgcagttgaagagctgaaaaagtttttggtagctgactcattggaagaaatgaatagaaaactggataagttttacatggtcctcattctgaggagtctacactttgactttgatcat

SEQ ID NO: 19639 - DNA, 491 bp, Glycine max
  Peptide Sequence Number=SeqID_111324
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgcttttccg

SEQ ID NO: 19640 - DNA, 728 bp, Glycine max
  misc_feature (41)..(41): n is a, c, g, or t
  misc_feature (121)..(121): n is a, c, g, or t
  Peptide Sequence Number=SeqID_111325
ggtcggaacaggagagcgcacgagggagcttccaggggganacgcctggtatctttatagtcctgtcgggtttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtaccctgtcatccgctaagcgaggcatcaacatgcttagcggttaggaggaatctagaagggaatctatcacgcaggcacgcgctcagcgcgtcatcagctcgctcagcgagttgtttgtcaccttccaggcttagcacaagtttggcgctgagcgaaagttcacttactcacactaagcgcgagaatggcgttaagcgcgacgtcgaggtcagtgagcccttttttaagcctgacttgcagagaatgaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19641 - DNA, 174 bp, Glycine max
  Peptide Sequence Number=SeqID_111326
atgatggcacatcatggagtctcctctctctcttccttctccattccattgccattcatcttccaagatgcaaaggaatccatcgatgaaaaatatcctaggcctacaagctccaatggagcttacatcacatgggtccttaggagtagaaccctcaccattaacactagatga

SEQ ID NO: 19642 - DNA, 46 bp, Glycine max
  Peptide Sequence Number=SeqID_111327
atggcatctccaaaccacaaatgtcatcctcatcaggatgactcca

SEQ ID NO: 19643 - DNA, 336 bp, Glycine max
  Peptide Sequence Number=SeqID_111328
atgaccatgattacgaattcgagctcggtacccatcccttatcagtatatggacagttatctctcgagcacaggtttaggtttggcctcaatggaaaaaaacggagcacctaacaacgtatcttcacagaccaagaactacgagatcgcccctttcattctgggtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19644 - DNA, 483 bp, Glycine max
  Peptide Sequence Number=SeqID_111329
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgctgcacttggtgttcaattggcttcgaagaattttcgttttgggattgagaaaccaactgctgaagcagtgttgcttggagccacaacctccatggcagctgctatcgggaaacctgtcgtgccagctgcattaatgaatcggccaacgcgcggggagaggcggtttgcgtattgggcgctcttccgcttcctcgctcactga

SEQ ID NO: 19645 - DNA, 753 bp, Glycine max
  Peptide Sequence Number=SeqID_111330
atgagtgattatgttgagattgatattggtgaatttcctaaggattgggatgtaagaaaattaaaagatgttataataaaagcaaaatctggaggaacacccagaagaaatgttcctgaatattggaacggaaacattccatttgcaaagatacaagatataacgaaatctgttttaaatagctcagttcctatacttcccctagaagaacaaaagaagatcgtagaactacttcaaaaggccactgatatttattacaccttaaaggattatattattcaaattagaaattctacagaaactataacgaaagtaataagaaaggaattattgactaaaggtatagggcatagagattatgttgagactgatattggcgaatttcctaaggattgggaagtaagaagacttaatgaaattgctattatacgttctggtttttcagagaggaaaagagatgagaatagtaaagtaatccatttaagaccagataatattgataatgaaacggataggattgtttttcatagaattgtatatatacctgaatctccaaaaattgagaggtatttgctcaggcatttggatatcgtattggtcaatactaatggtagtattgatcatatagggaaacttggtattattgatatgcctttaaatcaaaagataacctttagtaatcatctaacggcaatacggattgtatcaaaggatgtggaaccatattatatatattatttactatcatggtag

SEQ ID NO: 19646 - DNA, 267 bp, Glycine max
  Peptide Sequence Number=SeqID_111331
atgacgggactcaatcagacatccgaacatccgagtaaaaagatattgtcgtttgaattggctcagagatcaacattcaatgttgagcgtctcgatatattacgggactcaatcagacatccgagtaaaaagatattgtcgtttgaattggctcagagattcaacatcaatttcgagcgtctcgatatattacgggactcattcagacatccgagtaaaaagatattgtcgtatgaattggctcagaggttcaacattcaattttga

SEQ ID NO: 19647 - DNA, 974 bp, Glycine max
  Peptide Sequence Number=SeqID_111332
atggcagaatcatcgaaaaagcgaaaaagaacctcgagtcggaatcaacgacattctgggtcacaagtagccccaattcctccctccattccctctggatcattattttcatcagaggaacaacgtacacagtacgcaaacctcttttcctctcgttccattgtagacccaaaattcatagatatggagttcttctctaatgagaattttgaatgcttccaagcatttgaaaactccaatcttattccatttatgtctctgaaattacctgtctattctgaattagtcaaagctttttattctaatttagaaatccatgaaggtactctaaactctgaagtttatgggatcaagatggtcattgaccaatccctattttatgatttaaccaaattgcctagtgaaggtgtgtcttttgagggtgcactgattgatgaatggaaattcgatttctctgtgcatgatgctcgccggttggtttgcaccaaccaagcggatatgaccgaaagacttcttgccggttcattggcttttgaaagccacatcctccattaccttatatttcgcattttgcttcctagatcttcaaaccttgcccaggtttctgaagaagatctcattgtcatgtgggcctttcataaaggtttacaaattgattgggcacatcttgttagatatcgcatgcataaggcattgcgattgaatgccccattgccttatcctcacctttttaccctcttccttcaacatttcaacatccctcttgattttgaaccttatgttccaatcaagagatcattccttataggcacttcaatcatagcatccttcggttatattaaggagcatgatggctcatgggtaaagaagggtgctagaaatattggtgaagaaggacctgagggagaagattcatctcttctttcgaagattttggaaaggtttgatggtcttcaaacctttgttggtgagag

SEQ ID NO: 19648 - DNA, 273 bp, Glycine max
  Peptide Sequence Number=SeqID_111333
atgaaaggctcaggtgttgtgggctctgatgatgcaagcttcattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaagaagaaggagatgaatgaagggagagggagagaagagcacgaaattttgtgctctaaatga

SEQ ID NO: 19649 - DNA, 387 bp, Glycine max
  misc_feature (327)..(327): n is a, c, g, or t
  Peptide Sequence Number=SeqID_111334
atcaactgcaggtgattcaatccccattgatttggagattaacgccacttgtagaaggcgtaactcagagagaatcagaaattttttgcaggatttagaagcagtaacaactccaaaagaagaacctcgatcttccgaggcatcttctagttttcctattgcagggcattctcatatagaacctgttgaagacccaatcatggctgaagatattagacagccagaagttcaagctcagacaaccacttatccaccttctttggtacagttgattcaaaataatctgtttcatggtctacccaatgaagacccttatgctcacttggncacctatatagagatatgccatactattaggccggtgggtgtgcctgcggatgcagtcag

SEQ ID NO: 19650 - DNA, 528 bp, Glycine max
  Peptide Sequence Number=SeqID_111335
atgctagccgacctacatgacacctttgaccgaagatgtgagaagagcaatacgaggattgtttgttgtactccagctctttatgtattgttggtttcgcaccttgttcgtcaagaggtaaggcatgcttgcccgctagaaagtcactgttcatgcacagagaaaggaggtgcaaattgggaccaactcttagcaaaccaagaaggagcgtctatcaactggttccctcgatggagagaagggagagtcggagttcttatttcatgcggaggatttccgaatgttcccttgatggggacgtggggttgcatcagttacaatcctgttcttgctgtaagacaacttggctaccctatgagagtggcaccactagaggaaaagctcacgcttgttatttcacgaggtttcaataagaccaacatggagacacttcaaaaggtccgcaaagaatgggaggtagtgcgaaagaagaacaaagaactcacgggcagtaacaatgggcccatctggtggctacaagtggtttag

SEQ ID NO: 19651 - DNA, 291 bp, Glycine max
  Peptide Sequence Number=SeqID_111336
atggtgattttcaaccatggagttgcagcggaagataaaggagaagagctagaggaagaaagcttccttgagaagctagaggggggctactcacacccctctgtcgcaacctacccttcggcgggagggcgacgcgtgactcacgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 19652 - DNA, 634 bp, Glycine max
  Peptide Sequence Number=SeqID_111337
atggctccgagaaagcttcctgcaaagaggtccaggaaggacaaagcggctaaagggaccagcgccgctcccgagtatgacagccatcgttttcggagtgctgagcaccagcagcgtttcgaggccatcaaaggatggtcattccaccgagagagacgcgtccagctcagggacgatgagtacaccgacttccaggaagagatagctcaccggcggtggacgtcgctggtcacccccatggccaagttcgacccagacatagtcctggaattctatgccaatgcttggcctacaaaggagggtgtgcgggatatgcgatcttggggccatgagtgcgagtatggccagaggaggaatcgggccgatggttttgatgaggaggccatcgcccaattactgtgcataccgggacaggattttgcccggaccgctgccgggagacgagtacggatcatgcgcaccagcatgactactctgacccagatatggatgacgttgctgctcagcaacatccagcccagcgaccataattctgacctcgccctgccgaagtgtcaactggtgtatgccatcatgacacggatgagcgttcatgtggctcagttgatcgctgatgccatttgtttgtttgcag

SEQ ID NO: 19653 - DNA, 649 bp, Glycine max
  Peptide Sequence Number=SeqID_111338
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatgttgctgacacataatgaagatgctgtggagttgagaattacatgggaagaagcacaagacttgcttcatccaccacctagtaccatgccaagtgttgaaacaattgaggacaaagaatttgaggaatttgagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19654 - DNA, 496 bp, Glycine max
  Peptide Sequence Number=SeqID_111339
gtcgactctagaggatcccctatcagctcactcaaaggcggtatacggttatccacagaatcaggggataacgcaggaaagaacatgtgagcaaaaggccagcaaaaggccaggaaccgtggcgaaacccgacaggactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 19655 - DNA, 272 bp, Glycine max
  Peptide Sequence Number=SeqID_111340
atgcatgaatatcctaggagaacccgcgcattaacgcgtaagcattcctttcaaaattcgtgtggatattcgtgttttgttggaaaaagggaaatggcttcgaagaaactctccacgaagaggtctagaagagacgccacaggagaaggatccagtgccgccccagagtttgatagtcatcgtttccagagtgccgagcaccagcaacgcttcgaggccatcaggggatggttgctccacagggagagacgtgtccggctcaaggaggatga

SEQ ID NO: 19656 - DNA, 638 bp, Glycine max
  Peptide Sequence Number=SeqID_111341
gaccacacatcctcgccttcaaagggctacacatcatcgccttaagaggactacatgtcctcgccttcagtgggctacacgctctcgcattcgtaggactacacgccctcacctttagaggactattcgtcctcaccttcataagactacacctcctcaccttcagagggctacttgtccatgccttcagagggatacacgtcctcgccttcagaggagtacacatcctccccatgaaagcgctacacgccctcgccttcgtagggatacacgcccttaccttcaaaggagtacatgtcctcaccttcagacgactatacatcatcgccatcagagggctacacatcctccacttcagaggactacacgccctaaccttcaaaggactacacgtcctcgccttcagagggctacacgtccatgcctccagaggacaacatgtcctcccctttagaggactacacgccttcgccttcgtagggcttcacgccctcaccttcagaggactacacatgctcgtcttcagaggactacacaccctcgccttcgtagggctacacgccgtcaccttcagaggactacacatcctcgctttcagagggctacacgcccttgccttcagaggactacacgtctaa

SEQ ID NO: 19657 - DNA, 294 bp, Glycine max
  Peptide Sequence Number=SeqID_111342
atgagttcaagatattcaagaaggaatcgagaacaattcaagactcaagaggaaaggttgaaggacacttcaagattcaagaggaaagttgaattcaagaatcaagattcaaggatcaagcttcaagaatcaagatcaagattcaagattcaagtttttctaaaagtcataactcttttaatggttgtcttgactagacatgaagagtctataaaagcaaggctttgttttgcatttttcaatcatcttgaacacttattcaatcaatcttttacaagccctaaatctctttga

SEQ ID NO: 19658 - DNA, 422 bp, Glycine max
  Peptide Sequence Number=SeqID_111343
gccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggcctctagtgcctgcacatgttctttcactgcgttatcccgtcgtgattctgtggataaacggcgtattacccactttgagtgagctacatccccctttcgccagctggcgtaatagcgaagagcccgcaccgatcgcccttcccaacattaatgccagccgcacgacaggtttcccgactggaacacccgcagtgagcgccctgacgggcaattgtgtctag

SEQ ID NO: 19659 - DNA, 303 bp, Glycine max
  Peptide Sequence Number=SeqID_111344
atggcatataagaaaaggaaggcttcttatacacctacccaggccagatatgacaaatctaggttcacatctcaagaagcttgggagagatatacatatattgcggtgcctaagaaactactaccggagaggaatgtggtagtttattacactgagtttgacgagttcaaggaggaactcgagagaagacactgggatgaggagctaactgattttgctgacagcaacatagacattgccatagtgaaggaattttacgcgaacctctatgaccccgaggataaatcacctaagcaagtgaag

SEQ ID NO: 19660 - DNA, 147 bp, Glycine max
  Peptide Sequence Number=SeqID_111345
atggaagaaaaaaactcagcaagagcaagcaccaacagcaagcacgcagaacactcaagaaattcaagaatggagaaaagaaaggaaaaaagcgtatacaatggtcaaaagctctctgcatccctaaacgctatgctgcatccctaa

SEQ ID NO: 19661 - DNA, 743 bp, Glycine max
  Peptide Sequence Number=SeqID_111346
cggatgccgggagcagacaagcccgtcagggcgcgtcagcgggtgttggcgggtgtcgggtctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctctgatggtattggtgttatcactcatgatcttgcaagggaagttgcagaaaagttgaaattggacaatgtaccctctgcttaccagatcagatatgctggttttaaaggggtcgtggcctcttggccggctaaaggggatggggtcagactttctttgaggcctagtatgaacaagtttcaatctactcataatatcttggagatctgtgcgtggaccaggtttcagcctggttttcttaatcggcagattataacattgctttcggcactgggtggtaccgagctcgaattcgtaatcatggtcatagctgtttcctgtgtgaaattgttatccgctcacaattccacacaacatacgagccggaagcataaagtgtaa

SEQ ID NO: 19662 - DNA, 422 bp, Glycine max
  Peptide Sequence Number=SeqID_111347
atggcttctgcagctccggctacagaaaaaagtgagacctatcactacgttccggtattttttaataatgacgaatggcgatttattttatccgcaacggacctgctgattcctgaagacgaattcggccccggtgcggtgagtgaaggcgtgcccgtttacatcgataagcaaatggaattgccttatggctatggttacctgtggtatatgagcccgccatttcaggagtcgattcctgagatgggataccagactaatctggtgccacgggaaatttaccgccggggtattatcaacctgaacaaatactgccgtgaaaatttccagaaaaatttcgcagatttaagcaaagaaaaacaggaagcgattttacacgatctggagtcgggaaaaatcgtgcttgatactatttcaggcaa

SEQ ID NO: 19663 - DNA, 51 bp, Glycine max
  Peptide Sequence Number=SeqID_111348
atgggggtggtcttcgtcattggaagtgcggtagacagactttgtggttga

SEQ ID NO: 19664 - DNA, 481 bp, Glycine max
  Peptide Sequence Number=SeqID_111349
atggcagagcaactaaaaagcctgcaagccgcacgcggacaatccacgggacagcctgtatacgccaactttaaaaatggcctcagttttgaagatggcactggcaactggaaactaggcattaatggccgtgtgcaggccgactaccgcagcttttcaccagacatcgccgctgcagatacttttaacatccgccgaggccgtttgggggcgaatgtcgccatgaaagattttgccgccaggctagaggcagagtacagtggtactgccaacaatggcagcgtcggcttaacctatgcccatgtagattacattcactttaatagctttaaattgcgtgttggtcagttcaaacctttttatgggctagaacgcgcaatgaatgccaacttcaccgattttcaagaacgtggctctaccgactacctgttaggagctacttttgaccggggcgtgatggtatttggcgaaccagtgcctg

SEQ ID NO: 19665 - DNA, 240 bp, Glycine max
  Peptide Sequence Number=SeqID_111350
aagttcttccggaagttacgaagcgcaattccggaagaaggtcttccggaagtagtttccggaagaacttcttccggaattggccttcatcacttccggaagaaggtcttccggaagttacgaagcccaattccggaagaagtgcttccggaagaacttcttccgcaattggccttcaccacttccggaagaccttcttccggaagtggtcattccggaccttcctccttctgtgcctaa

SEQ ID NO: 19666 - DNA, 406 bp, Glycine max
  Peptide Sequence Number=SeqID_111351
atgagagaggtgacgatctcgttggacgacgtcatgtctcttctgcatcttcctatggttggcagcttacatgtctttcagcccttacacgtggatgatgcggtacagatgttggtggagttattgatggtctctacagaggctgccagggctgagacagggcagtgtcgtggactgtatgtacacctccaatgggcccttcgtgacctcagtctgactgggaggtacacttggggagtagctgcgctggtgcatatgtacgaccacctaaatggtgcttctatctgcaccagccgacaacttggcggttacatcacactgttgcagtgttggatatgcgagcactttcccttgatcgtgaagtccgctgctgatcgggactatgacgagggctcactgcatgctt

SEQ ID NO: 19667 - DNA, 816 bp, Glycine max
  Peptide Sequence Number=SeqID_111352
aagctcctggctgagaaaaccaagaagaagctgcaggaagatgcacagtcaggaagcgttgatggcgtcatcgaccctccatccccggtcagacgccacgtgaagtggaagatggcccgcacgaagaagacaggggagatgacgactgaggccgtaaaggaaatcgctgagaagattgattcgtttgaggagcaagccacacagggatcgttcgtcccccatggacgtcaggatgttctggccgttgctattggacgtccagagcaccctggacgtgtccgtgctgctggagccggtgtcaccatcaagcaatactttggatcggctccacggacgtcccgcagcgcttcctccctgcctcctgacgaattacagcagctgacccagcagatcagggaccagttagaggagtccatcacagagaaagtgacaaggcaggtcatggcatccttcagccagcttcagtcacagatgcaatctcaggcacctcctgagcctctggttggtcctggtccctccgatcctcgggtgcggcttgtacatagaagcagatcctgcccgcctggttgtcgtggggagagttatgggggattgactcttgttcataacactcctttgttgcctagccaagtaaaggtgagtgtggacaaggttaaagatgcagatgctccagttcctgtacccactgctgaggtttccttagtggggcaggcacttcacaccttccttgcttggccgacacatctgatcaagtctttatcacaccaggtacttattgtccttactatatgtttcttccttatggggatcctctag

SEQ ID NO: 19668 - DNA, 294 bp, Glycine max
  Peptide Sequence Number=SeqID_111353
atgacggtgaaaacctctgacacatgcagctctcggagacggtcacagcttgtctgtaagcggatgccgggagcagacaagcccgtcagggcgcgtcagcgggcgccattcgccattcagtctgcgcaactgttgggaagggcgatcggtgcgggcctattcgatattacgccagctggagaaagggggatgtgctgcaaggcgattaagttgggtaacgccagggttttcccagtcacgacgttgtacaacgacggccagtgccaagcttgcatgcctgcaggtcgactctag

SEQ ID NO: 19669 - DNA, 564 bp, Glycine max
  Peptide Sequence Number=SeqID_111354
atggacattgaagaagatgttgagatccccttgattctgggtcgatcgttcatggtgactgcaaaatgtgttatggacatgggaaaaggcaacttggagatgagtgtggaagaccagaaagccaccttcaacttgtttgaggcaaaagaagatgaagccaagccagttgtgaatcctacaaactcttctagtatctttttggggccaaagcaggccaagacccgaaccactccagacattccaccaactcctccatcagcggtccctccgccagatgtctctcctccacctatcggccaaacttctatacctttttctcatccggagcaacttctccctcctccaccatctctcactctagcagccggtgatgacactagaggcattcctagcccaggttgcttggccaagagtccaactccttctagtaaagggggtgacacctttggtgtagctgatgatgatgagaatcctgaaactggccaaatacaggctacagactcaagtggagaaggacaaagcccccaagtggagaaggatgaaggcccaagtggagaaagatga

SEQ ID NO: 19670 - DNA, 168 bp, Glycine max
  Peptide Sequence Number=SeqID_111355
atggaaattttgatcgccaatacttcgacaacatttcatagagatgaaagactcgggaatacatatgctacgcatgtaattatgagaatgagatgcccgaagagacatcatttcctagttaaccacgcattagaggaaaatgcaaggatcatgcatgagcaaacatga

SEQ ID NO: 19671 - DNA, 330 bp, Glycine max
  Peptide Sequence Number=SeqID_111356
atggttaggaccagaggattaggtcgtgccttaggtcaggttactggcaaagcgtcgacagcctactgcatccgcatggaggcagcgattgtcgtgactgtggcgcacgatgagccaatggtccctgcgccagattttgagcctgatgtattgccggatgacccgatggaggcaccagctgattctgaggacattgtggcagacattcctgtggacacaggcgtggaggctgctgaggatgagcatgagggattttcgggtggtccgagcgacccatccgtgttgacccagtatgcggatcacgttgcttgcagcgtatggacgggagag

SEQ ID NO: 19672 - DNA, 435 bp, Glycine max
  Peptide Sequence Number=SeqID_111357
atgactggcaggctgcttgcctgttcaatgacatttgattgttgcatcatgcactacatcattgttcgcattttattacccagatcatcaaagttttctcaaccctctgaagaggatttaatattgatgtgggcttttctcaccagttgtccgatcgactgggtttatttgatcagataccgcatgcgtaagcggtcaaatgcacctctgccttatccacaacttgttactttgtttcttcatcattttcaaattcccttggataatgagccctttgtgaaagtcaaatgctcttttgccattggtaccggtgcggtaatctccttcggataccgtaaggacatggatgggaaatggttgaaaaaggacgcgcagcctccccaagacgaacgcactccctctcctccacctcaacaagatgactcctcagcatag

SEQ ID NO: 19673 - DNA, 1005 bp, Glycine max
  Peptide Sequence Number=SeqID_111358
gcgatgccgaagaaaccgacggcgatggtgccggcgaggcacaggatcatccaggtcatgctgatgcggcgcgcgctgcggatggtgcggtgagaatccgccgccatgaaacgcgccaggatgtgcggctggccgaagtagcccaggccccaacccagcagcgacaggatggcgacgaagttcagccccttcagcatgtcgaggttggccggattctgcgcctggatcaccagcatcgaggtatcgatgccgccgacggcgaagatcacgatcaccggcgtcaggatcagcgcgaaaatcatcaggctggcctgcacggtgtcggtccagctcaccgccaggaaaccgccgataaaggtatacaggatggtcgctgcggcgccggcccacagggcggtttcgtagctcatgccgaaggtgctttcgaacagacgcgcgccggccacgatgccggaggcgcagtaaatggtgaagaacaccaggatgacgatggccgagatcacccgcagcagcttgctgttgtcttcaaagcggctggtgaaatagtccggcagcgtcagggcgttgttgttggcttcggtatgcacgcgcagccttcctgccaccagcttccagttcaggtaagcgccgatggtcaggccgatggcgatccagctttcggagatgccggagaggaagatggcgcccggcaggcccatcagcagccagccgctcatgtcggaagcgccggcggacagcgcggtcaccacgctgcccaaactgcggccgccgagaatatagtcatcaaagttgttggttgcccggtaggcaagcaggccgatcagcaccatcccgaaaatgtacaccaggaaggtcaccagcataggtgtgctcattgtcatttaattctccactttcattattattcgcgtttcgctccggccacgccggcgccggtaaacccacgcgcaatgcatttcactggccgccgcgccggaacgtggcgcagcctgcgagcgagtgcag

SEQ ID NO: 19674 - DNA, 111 bp, Glycine max
  Peptide Sequence Number=SeqID_111359
atggcagcccaagatgaatggagagatgccataactttgacaatgggaagagatctcaagaaggttccccaacacttaaatgctataagtgtaatcgacccggtcacataa

SEQ ID NO: 19675 - DNA, 192 bp, Glycine max
  Peptide Sequence Number=SeqID_111360
gcggggatggggaaggtgtggatgtaggtactggggacgatctacgtgcatcaattgaggatggagatggggtggatgtaggtatcggagatggtccaagtggagatggtgtaggtgcaagatcaggaggtctaactgggatagacacagaagatggggatgaggtagatgatggaagactatctcgaggtg

SEQ ID NO: 19676 - DNA, 480 bp, Glycine max
  Peptide Sequence Number=SeqID_111361
atgattatgaggggccaagacatttatagtagtcaagataaggctactacttcaccttcctctagtgaaagtgaaaaagcaaaaggggaagaatctagtgaagaaatctacccccaagaagaaggacaaccattagtggttaaagagaagtatcaggagacacttgctagcattgccacacctcttgggcttgagtttattcctcaagtaaagaagttgttggatgatggtttggttcgcaagagcttaaatcgttgtgctttgttggtgcccaaaataggaataatcaacataaaatacagaaaaagtgatcaaggggttcccacgaatcctaagagaataaaggtcattcccgattggcccactccaccaggtgtcgagggaaggagcctagagtatgaagaacctcgggatttgaggtcaaatcctttccaagctggaggggatgatgcaatcctaccccccaagggtattggatag

SEQ ID NO: 19677 - DNA, 300 bp, Glycine max
  Peptide Sequence Number=SeqID_111362
tcatcccagcgacgactccgtcgtgcccaccctgacattgcgtttccgaccaccaagaagaaaaaccctagccattgttctgaccaccaccacgtatccgatctcgtgccctttggagtggtgtcgccaccttgctagtgtgaagataaagagggaaatatccaccttgaagctgctgaagcatccgaacgtggttagattaaacgagaggaacttagatcaattggaagagttactcaagaaggttaaattgaagaccataaggactgaaccaccttctgcatctattgctagcacaag

SEQ ID NO: 19678 - DNA, 267 bp, Glycine max
  Peptide Sequence Number=SeqID_111363
atggcggtttccaaactcagaaatgatgcaaagggtttcattctcaaccgaaaccgcgaggcaagttggaagattccgcttcggttgaagggttcctcttggtgtggggtttcaacggagaacaatggaggtttgtggtggctacgggtggctgtggttgatgaagaaaaagcttggtacattggaaatggctttggaagaaggaaggagaagaaatggcatttttccaaagctacttggactacaaggctcaaaacgcaaaagtga

SEQ ID NO: 19679 - DNA, 353 bp, Glycine max
  Peptide Sequence Number=SeqID_111364
attgtgatggcagcgcagttatccatgatcgcgtggtgatggagtgcctagagggagtttgggagaccctcgaaggcaatgagaggtgccgattccgtggcacgattcgactcactactacttcattgccagtccaagtgataaaggtgtcattctctgaagaagatcctgaggaggacccagaggagttacctcctgaacctgctgtggatgaccttgacttacctgaggatgatgaagacccactccctgaagtggattctccagaggatatcatgtcagcatctgaggcagactctacagaggagagcggccctggagagacagcgaatagtgaagactcttcatcatag

SEQ ID NO: 19680 - DNA, 231 bp, Glycine max
  Peptide Sequence Number=SeqID_111365
atggactcgggaaggttccaagttagtgtaccaggtgtagctgggggtgatactgagggccttccgaagtgttttcaaggggtataccaccaactgcttgcccttcagtggcatatccgagccaaggctcgaagtcggctagattgtggtggggaatttcatgtgtctcttccacggtttaagagacatgtgcatgatcagtttggggttgctggctctcaatgggtatag

SEQ ID NO: 19681 - DNA, 813 bp, Glycine max
  misc_feature (113)..(113): n is a, c, g, or t
  Peptide Sequence Number=SeqID_111366
atgagaaagcgccacgcttcccgaagggagaaaggcggacaggtatccggtaaccggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgtccgcaacatgcgctggcgcagggcgatgcggatgtgcgtcgcgtgcagcagaccggcatggtaacgcggcgctactggaaccagcaggagctgaacaagcgcggtttccgccatagcaccgcctcggtggagagcattgaagcgcagctgacgctgattctctccgggcgctatattggctttttgcccgagggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 19682 - DNA, 398 bp, Glycine max
  Peptide Sequence Number=SeqID_111367
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgggatattgccactcagaatcattcaactggcgatatcccaccccacatgagcaaagaggaaaagaccgaaacacctagcttcctctccagaaacactaccctcgagaaaatcctattggtccgtgatc

SEQ ID NO: 19683 - DNA, 489 bp, Glycine max
  Peptide Sequence Number=SeqID_111368
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacaaccacaaacagtaggcactgttggcttgatcttatggccaaacctcacaatttgttccatcaatgctacaatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 19684 - DNA, 687 bp, Glycine max
  Peptide Sequence Number=SeqID_111369
atggtgtctcctaaaatgctaaaccctgattcctcatactgcaggttgcctacagactacagagagattgaggctgccttatgtatcccaagtcgggggtttgttttgaatgctgaaggccaccctgagaagattctcaggaaagatttaacaactcttgctcgggtgtggagtgttctctcatactccaacctggctcctacttcccacacctcagacctgacagtagatcgagataggctgatctttggcctagtctctcagatggacatgaatgtgggagctctcatctctagtcagattacatctatggcccagtctaactcttctagacttaggttccctgctcttatcaccgctttatgtaagtccagaagggttgcttctgacagcctagtcttcaaacacctgagcctggtcattaacttggcctatatcaagaaaaactattggaaccctgatgaaggtcccacagcccaggtaccacagcagatgaagaatgagtcatccaagactaccactccaaagcccttggtcagaaggaagaaggcagatgaaacacaagaagctgtagccacttctaagaaatctcttgaggccacatctaagccttcagaaccagtggcagatacaacttcacctcagcaggcagcagacccttccactgctgaggatcatactacacca

SEQ ID NO: 19685 - DNA, 879 bp, Glycine max
  Peptide Sequence Number=SeqID_111370
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcagatgaacgctggcggcatgccttacacatgcaagtcggacgggaagtggtgtttccagtggcggacggccacactgggactgagacacggcccagactcctacgggaggcagcagtggggaattttccgcaatgggcgaaagcctgacggagcaatgccgcgtgaaggtagaaggcctacggccgcggtaagacagaggatgcaagcgttatccggaatgattgggcgtaaagcgtctgtaggtggctttttaagttcgccgtcaaatcccagggctcaaccctggacaggcggtggaaactaccaagctggagtacgatcggaaagaacaccaacggcgaaagcactctgctgggccgacactgacactgagagacgaaagctaggggagcgaatgggattagatacccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaag

SEQ ID NO: 19686 - DNA, 671 bp, Glycine max
  Peptide Sequence Number=SeqID_111371
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgatggatggatccacgttagcaatctgagatggaggtggtggagcatagcagagcaggggggtccactctggaaaaatataaagcaggagaagcgaacagcgggccccgctcccgtgttacagtttggggtaccgagctcgaattctcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 19687 - DNA, 86 bp, Glycine max
  Peptide Sequence Number=SeqID_111372
atggcgcgggaagagacgatcttcggtcagtcgaaagtgggatccgtgaagagtggattcataccgcaacactgtccacagaacag

SEQ ID NO: 19688 - DNA, 812 bp, Glycine max
  Peptide Sequence Number=SeqID_111373
gctaccctatgagaagggcaccttcggaggagatcatcgcgcctttcgtcgcacggggtttcaatgaaggcaatgcaaaaatacttcaaagaatccgtaaagcgtggaatacagtgggaagaaaagataaagagcttagggggagcaacaacagtgtcattggcggctatcataagtggttgaagactaggacacaaggggtaacttggctcccaaagctaaaaggtcaaagtggggaaaaagctgaagtccctgaggaaagcgaagaagtgcaagccttgaaagcagagcttgaaagaatgagagtggtcaaggaaaagctaaagaaggcagtcactagggtcaagaaagagtgtgacgagccaagggatgtcaacattactacggccgaagtcaacaacgagcgcaagcttagaagggccgaaagggatgagtcaagggtggaaagaagtttcaccgaacaactgagtagaacgaaagagaatatgttgacaatcattgaccagtataaagagaagctaaacctagctgctagccatgggcagagactagagaataagcatgcgaaggtattggctctgcaagtggaaagggaagtaagagagagggtgatagaatcattgcatggggaatctgtgaaatggatggatagattcgctctcactctgaatgggagtcaagagcttccaaggcttttagccagagccaaggtaatggcagatgtatactcagctcccgaggaagttcatgggctttttgattattgccaacacatggtcgagttgatctcccacataattaggaaccactga

SEQ ID NO: 19689 - DNA, 875 bp, Glycine max
  Peptide Sequence Number=SeqID_111374
atgaagctatcagactcagtcttttctcattttcactggcaggagaggccaagaggtggctccactcattcaaaggtaacagtcttaaaacctgggaagaggttgtggaaaagttcctaaagaagtatttcccaaaatctaagactgctgaagggaaggcaacaatatcttcatttcatcaattccctgatgaatccttaagggaaaaaataaagctgaaaaccccagaagaagcaactaagctcatagagaacatgtcagccagtgatcatgccattctgagggacagaacccatcaacccacaaagaagagcctgttggagctaacatcacacgatgctttgttggcacagaataagttgctatctaagcaacttgagatcctaacggaaacacttgctcatgagataggccaatgcatctcaattgaagaaaacactcaagaaattcatttcatggggaatcagcagaggcaagggtatactcaaggaggattttcaggcttccagcaaggtccttataatcagcaagggcagtggaggacacaccctagcaaccagctcaataaagaccagggtggatcctcaaacaggccaattcaacaagggcctaacatctttcagaggatgactaagttggaagagaccttgactcggtttatgcaagtaacgatgtcaaatcataagagtattgagtccgtactaaagaaccttgaggtccaggtgggacaactgaccaagctgatgcaagctccattggagcttgtaggcctagaatcttcttcatcaatggattcctttgcttcttggaagatgaatggaagcggaatggagaaagggagagagagaggagacgccacttcaaggagaagatga

SEQ ID NO: 19690 - DNA, 309 bp, Glycine max
  Peptide Sequence Number=SeqID_111375
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggtgaaaatgagccaagccaagctaagctttactag

SEQ ID NO: 19691 - DNA, 603 bp, Glycine max
  Peptide Sequence Number=SeqID_111376
ggtagcacattaatttctaaggtgcatggcatatcaattgttattgatgaatctgttttcttttcattgacacatctgcccagtcacgattcaccttttgagggcaccattgttgacgactggaagtttgcttactctagtcttgatgcccgtcgtatggtctgcaatgatcaggcggatatgaccggcagactacttgctggttcattgacatttgattatcgcatcatgcactacatcattgttcgcattttattacccagttcatcaaacttagttcaagcctctaaagaggatttaatattgatgtgggcttttctcatcggtcgtccgatcgactgggcccatttgatcagataccacatgcataaggcattgcggtcaaatgcacctttgccttatccacaacttgttactttgtttcttcatcattttcaaatttccttggataatgagccctttgtgaaagtcaaacgttcttttgccattggtgcttgtgcagtaacctccttcagctaccgtaaggacatggatgggcaatggttgaagaaggatgtgcaacctctgcaagatgaacatactccctctcctccgcctcaatga

SEQ ID NO: 19692 - DNA, 321 bp, Glycine max
  Peptide Sequence Number=SeqID_111377
atggtatggggggacattttggctaaatttgatatcccagaagctgaaaaggccaagaaaaaagacgaatttgttgcaagtcgcaagaccccggattggcaggaaattcggaaaaaggcaaaggagagtaaaaaatacaatgactgcccccacgtactgtctcgtgggggttatgacttgcttgagaaaaaattgttagatgagaaaacaaagcaaagacaacagcaagcacttttgactgagaatccattgtttgatctggaggagccgccatctcccattaaaaggcaagtgaagtggaaaatggctagaacaaaatga

SEQ ID NO: 19693 - DNA, 747 bp, Glycine max
  Peptide Sequence Number=SeqID_111378
atggaaggaaggaaaggagggagtccttttctcatgtggaggttaaaagtcgtcagtgaagagagttttgaagcaccggaagaggacgaagaagtccaagctctcaaaagcgagttaggaaaggcgaaacttgccaagaagaagttcaagttggccactacacacatccggaaggagtgtgccggattacgggaagagaatgcaactaccgcaagagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctattcaaggtccaaaaggagcttgtctcagcatttatgcgagacggaggccaacatgctagctaacatcgccaagtaccaagaagagttaggtctagccacggcccacgagcatagggtcgcggacgagtatgcccaagtatacgtggaaaaagaggctagaggaagggtgattgactctttacaccaagaggcaaccatgtggatggatcggtttgctcttaccttgaacgggagtcaagaacttccccgattgttagccaaggccaaggcgatggcggacacctactccgcccccgaagaaattcatgggcttctccactattgtcaacatatgatagacttaatggcccacataattagaaatcactag

SEQ ID NO: 19694 - DNA, 442 bp, Glycine max
  Peptide Sequence Number=SeqID_111379
atgatgtggatcgataccgtcaacggcctgatcatggtggactgcgctagcgcgaagaaagcggaagatacgctggcgctgctgcgtaaaacgctgggctcgctgcctgtagtaccgctgacgctggaaaatccgatcgagctgacgctgaccgaatgggtgcgctccggtagcgtggctcagggcttccagctgcttgacgaagccgaattgaaagcgatgctggaagatggcggcgtgatccgcgcgaagaaacaggatctggtgagcgatgagatcgccgtacatatcgaagcgggtaaagtggtcaccaaactggcgctcgactggcagcagcgtatccagtttgtgatctgcgacgacgcatcgattaaacgtctgaagttctgcgacgaattacgtgaccagaatgaagatattgaccgcgaagattttgcgcagc

SEQ ID NO: 19695 - DNA, 381 bp, Glycine max
  Peptide Sequence Number=SeqID_111380
atgcgagttcctgatgactgttcttgtaatacactcaagcatagaatgcaaaacacctttcaactaaccaacgatcaattagtggatgaaatctactaccgacaaccattcatagatgcagcaatagaacaccagatgctatactcaacctgcttcaatcaactatcactcctactcatgatgcaattatgtattacaacgggaagtggaacataccacgtcaaagtgggtttttgggttactccaggtggatctttgggttactcctttactggaacaaatccaataagatttggcatcccttcgggatgtaacatggacaaacttaagcatttaatcaagcaagttgcacctatagggattcctcctaatggaatttga

SEQ ID NO: 19696 - DNA, 300 bp, Glycine max
  Peptide Sequence Number=SeqID_111381
atgtccaaatcttgtggatttgggatgaccagccctctcgatgagtcgatctcttgctttctcataagggtggacccttggatacttgtacctatcaccatgagaggactacacgtcctcgccttgagagggctacacgccctcatcttgggtactagttaccctcaccgtcagaggactacacgtcctcgccttgagaggactacacgtcctcaccatcagagggctgcacgcccttacctccagaggactacatgtcctcgccttgagagggctgcacgccctcaccttgggtactag

SEQ ID NO: 19697 - DNA, 878 bp, Glycine max
  Peptide Sequence Number=SeqID_111382
gttcaatggacaatggagatggaatagccgtcgatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacagggttgcccaaaggcaatatataaggcatacccagtaaaacttacaagtaaaccagatatagagatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 19698 - DNA, 1054 bp, Glycine max
  Peptide Sequence Number=SeqID_111383
ggagagaagattgctggaaaccctagccttgcaacaagtcctagggaagttgacacggagatggacaagaaaatccgcagtattgtgagtagcattttgaaagaagcctctgttcctgaagctgatgaagatgttccaacatctttcaccccgaatgtttctgtgcctgatgttgagaaagatgttccaacatcttccggcccaaatgctgaagtactctcttcccccagcaaagagagatcaacagaggaagatgatcaagcgacaaaggagacccctgcaccaagggcaccagaaactgctccaggtgacctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaagagggccaagaaatctggaagaaaggtgcctggaaatgttcgtgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaaattgggagactgttatgaaggcctagtcagggaattcattgtcaacattccctctgacatatcaaacagaaaaagtgatgattatcaaagagtgtttgtcagaggaaagtgtgttagattctcccctgctgtgatcaacaaacatctgggcagacctactgatggaatggtggatattgatgtttctgagcatcagattgccaaggaaatcactgccaaacaagtccagcattggccgaagaaagggaagctttcagcagggaagctaagtgtgaagtatgcaattctgcacaggattggagctgcaaactgggttcccaccaatcatacttccactgttgccacag

SEQ ID NO: 19699 - DNA, 556 bp, Glycine max
  Peptide Sequence Number=SeqID_111384
aagcagatcctgcccgcctggttgccgtggggagagtttatgagggatccactcttgttcataacactcctttgtttcctggccaagtaaaggtgagtgtggacgaggttaaagatgcagatgcttcagttcctgtacccactgatgaggtttccttagtggggcaggcacttcacaccttccttgcttggctgacacatctggtcaagtctttatcacaccaggtacttattgtccttactatatctgtgtctccaccaaaaccacctctgaagcccgatccagaggtcgatgatccgctttatctgatgacattgaccatcccagagcttttcttgaggccttatcaggttagatgggatgccaccgtgttcggggttgttaatccagatttccccctgtacataaagcacaaagacctttccgaaatcgcacacggtggtcaatgtctcagcatatcagtgttacagttgtggattctgcatctcactgaaacatgtatgcgagcggggaattatgatatctatggattcctcgagcctcagtccattcggag

SEQ ID NO: 19700 - DNA, 375 bp, Glycine max
  Peptide Sequence Number=SeqID_111385
atggttgcaccaggtgaggtgtgcactgtgccaggtcagtgtgccagcgactacatagactggttcttccgtatttcacatcctttcatgacaccagtcgtccctcaggtcccacagacagatatccctcacgtgtcggagccaggagcaccatcgacgtctgcaatgcccgttgtggacgagcctagacatgcagtggaagtttgctatgagattgctgagaggttggagcgccatctgagcctaggggtggtcacgccaggctcatcgacacatgaagtgatcgaagattgcctcaggatagccaggagtgtcacacaggaccagctagtatatgttaggtctcgacgtaggcgatgcacggatcaggcgtag

SEQ ID NO: 19701 - DNA, 882 bp, Glycine max
  Peptide Sequence Number=SeqID_111386
atgtcatttgagttaataaagtatatcatgaattcaattattacagtgttgtatttcaatggaagagtatatgaagataatgatggtgtaatatttgaaggcagtaaaaaggccattcagattaaacgcggaattagtttcaatgctttgaaaaaaaaattggagataagatttttagtttcagcaaaatatgttgcgttgcaaatttgtgatgacgaagatgttgaaactatgatcgaaagttttcaacaacaacaacaaatgtcagttctagaattgtacgtagaaaaggatgttgctggtggttctatgtttcatgctgcaaattctgttacgtcatgtggacgtaatgtatctcatcatgagtcggaactgccaagaaatataagcaatttacatgatgatgaagatgatgatgatgatgatgattatcttgcatctaactcatacgttgaagagtctttcgatgaagatgatagtgatgatgaaatatctgatacagacgatgaagtcactgacatcgttgaaccagtttcaattgttcacccaagcgaaggtgtaccagaaattcaaaatccattttggaatgatgctatgcattataataatatcaattggagtcatccggacgagggggacatttgtggtctggacatgccaacgacttttaatgttggacaagaattatatattggcatggattttgacagtaaagatgcggtaaaaaatgcactgaaacaatatgtgatgaatgtgcatcaaagttttaaggttgttgaaacgaaatcacacaaatatatcgtttgttgccccaacaacaccgaagagtctccttgccctttttatatgagggcaattttatccaaaaaaactgatgcatga

SEQ ID NO: 19702 - DNA, 102 bp, Glycine max
  Peptide Sequence Number=SeqID_111387
atggcgccaaaaacttgttcgctggttccaacaagtgcaccggatcgcacaagtagtataaaatggtgtataaactatctgtgcaaaaagaaagaaaatcac

SEQ ID NO: 19703 - DNA, 264 bp, Glycine max
  Peptide Sequence Number=SeqID_111388
atgcgtttgacagtatatgaatcttcaaaactctacaaagaaagagtcaaagcctatcacgataaaaagccgatgaagagagattttaaactaggaaaaaagccttacggtgcaatagagttgtatgatccacaatctcaggaccctgacagaacatgggtggtgaatggtcaaagattgaaactgtaccatggtggagagtttgaaaaggaaaacactatcttgcatttgatatcactcattgaggtatatgcatcaagctaa

SEQ ID NO: 19704 - DNA, 241 bp, Glycine max
  Peptide Sequence Number=SeqID_111389
atgtacatcaagtatgacccagaatacatcatgaagcatagccaacaaaacaagttgtccaatgacacaaaaaccccccacacttattcccaaaacaattccaaagctccaaaattccttaaggatatggtgatatcatggacgcatcaacaagaatcaagccaaggatattgtgcaagcaatcaatggggcaaaacacaccaaatgattatgatgatggatggctcaaattctcacaaag

SEQ ID NO: 19705 - DNA, 461 bp, Glycine max
  misc_feature (127)..(127): n is a, c, g, or t
  Peptide Sequence Number=SeqID_111390
cggcagggtcggaacaggagagcgcacgagggagcttccagggggaaacgcctggtatctttatagtcctgtcgggtttcgccacctctgacttgagcgtcgatttttgtgatgctcgtcagggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagcatgcaagcttggcactggccgtcgttttacaacgtcgtgactgggaaaaccctggcgttacccaacttaatcgccttgcagcagatccccctttcgccagctggcgtaatatcgaagaggcccgcaccgatcgcccttcccaatagttgcgcagcctga

SEQ ID NO: 19706 - DNA, 261 bp, Glycine max
  Peptide Sequence Number=SeqID_111391
atgacattttttcctcttagaagtcaaccactacccgattcttctgtgcactgcatgatatgtgtcggtcacgtgtttggaaatcattttgttcaggtttatttgaaagactgttgtcctttaccacctctagcgttgttgtggtcaaccaattgttattctcaggcaaagcagtggccaactccatatattagtagaatgcagcagtacacaagcttgatgtcattcaaaagagactatgtcgacctaaatgaagactga

SEQ ID NO: 19707 - DNA, 394 bp, Glycine max
  Peptide Sequence Number=SeqID_111392
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgcattagaagaagctaagaagccagaaggggttgcaagcaaagaaattattaaccttttcggattcggcgaccggtgctgtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19708 - DNA, 558 bp, Glycine max
  Peptide Sequence Number=SeqID_111393
atgaagaacggtgaaaaaccttcacgaaatcacccacggaaacgtctcggaagcgttacggaagggaaaagtgggaggtggttgccgcccagctcacccaggcgagttgggttgcttccaccagaaggcaccgccttctgttggaacatcctagaagtacctcgaagtggtcaagcgaaggtcgcggaacttcacggattgcctaacgatgcgtgtcaagtacctcgaagcggtcaagcgaaggtcacatcccaccaaacagatggtccccagacaaaattagcgtatgacaccatgaaagagaaaatgaccacaatgatggagaccatgatgagcatgaagaagataatggaagccaatgcggttgcaatagcccctaccagcaccattgctgaggtggacctgacccccccatctgacctcaaccaaatgaatcatccaacctcagatatggtaggcaaagatttgggaagtacgggggcccccccttttagtgcaaaaacaagcatgccttcccaccataggacttgcctcccaactatacgccacccaatgtag

SEQ ID NO: 19709 - DNA, 315 bp, Glycine max
  Peptide Sequence Number=SeqID_111394
atggccatcatgttaggagttgtggatttaaggctgtggtggccaagactaggtagttttggtgtagtggtgcttgagagtgtaagtggacttaaggctgtggattttaggcaacctgaggtactattggtaaagaaggttcatcaatttgaggtgacaaaaagcccacttgaggcattagcagatatgggactaaatggagagtacaatttgaaggagttaatgacattggtaagcttaggagctgaacatgggagagaacatggagagcagggaagattggagagaaacaaatacttggtctttcaacaataa

SEQ ID NO: 19710 - DNA, 198 bp, Glycine max
  Peptide Sequence Number=SeqID_111395
atggtgacaatgatagatgtggttttcatgacgttgacgataatgatgttggtgacaatgacaatcaatgatagtggtgttgtcaatagtgggagtagtcagatgttgttgaacatatataacctcttggtgacaaggtatcggagtttaattttgatgaaggcatatccaagaaagctaagaaaagaaagagcttga

SEQ ID NO: 19711 - DNA, 249 bp, Glycine max
  Peptide Sequence Number=SeqID_111396
atggtggagcaagtgaagaagcagacagagaagaaggttaaacgactttggacagataatgatgaggacatggcattgactaagaacaaggaacctttagaaggacttggaggacctatggcaagggctagaacaaagaaggccaaggaagctcttcaacaagtgttaaccataatatttgaatttagacctaagttacaagtggagaagcttcagattgtcaattgcaccatgttccaagaagagtag

SEQ ID NO: 19712 - DNA, 417 bp, Glycine max
  Peptide Sequence Number=SeqID_111397
atgtcaggctctgctccgtcgtcatcacggttaatcaccctcaatgaggaactggagatgcttcttgcaactctgcctaagttaacaaataaagagcacaagcaatggtgcgaaatggtgaagatcatgttgaaggtcgcggttccaccagatactattttaaacaccgttggcgccaaggaccaggacattccaagcaccatgtattattttcttaaagacaaaggctggactcatttgcatttggaggacgttgcagaatgtcggcttgtgttcaatcactggagaaagacacttaaaattggagctggatggaaatatttcagtgaaaccttgtccttgacagctaacatagaaatagtctttgaattcattgatccgattgttaaccatgtgttattttggccatgtttatga

SEQ ID NO: 19713 - DNA, 351 bp, Glycine max
  Peptide Sequence Number=SeqID_111398
atgaggaaaatgcaaggatcatgcacgagtgaacgtcatgtgaatgatgaaaatagaatgtatgcaattggcatgctaaatgaaagagtgatgcacccattaggatgctatgaagagatgcatgatgcgatcaaggaacaagccagagtaagtttgctatgtgcccccgaattgaggaacctaatggaaatgatccaaaagtctacttctagaactatcaacgacaatgaatcactaaaagaggaaaactcagatgaggctacattgttatcaagtgtgttggagacccagcatgaccatagaccgacctccactccttatggctcacgtagacccgggtatagggcctaa

SEQ ID NO: 19714 - DNA, 255 bp, Glycine max
  Peptide Sequence Number=SeqID_111399
atggctagggttgtctccaacctttttgaagatggagcccagtcaacttggccaaatccacccacaccagtggtggacctatcctcacctcagcatgcagcagacccctccactcctatacttgagataccagtggacccgaccacaccagtcctaactatgagcacttctcctccagctactccagtacttcatctgacggatgagaagggtgttcagactcaggatactcaggaccagtcacatgaattctaa

SEQ ID NO: 19715 - DNA, 231 bp, Glycine max
  Peptide Sequence Number=SeqID_111400
atggaaggtaaaggaaatttaaagcaagctagagacagtttcctatgtgaggcttggatgaccctttggagttcccaagtagctcttcacttagtctacatgatttacactaagttattacacacaaataaagtgtttcactcaaaatttggtgaggctttggttggtccaaatccaatggtacttctaggatggttaaccttcaagactaaaaaatcttccttcaagtaa

SEQ ID NO: 19716 - DNA, 444 bp, Glycine max
  Peptide Sequence Number=SeqID_111401
atgagtttcttgggtttaggttttagtcttggtactgttccagtgtgccatggagcaaaacataaagtgttggataggagggtgaggataacaaagctggtgctaaggtgtgtgagccttggtcttggagttgttgcaattgttcttgtggtgactgattcccaagttaaagagtttttctccttccagaagaaagctaaatttacagacatgaaagctttaatgtccttcaatggtgatttttcaccatggagatgcagcggaagacaaaggagaagaggtgagaggaggcgccatccactagggaataagccatggaagaaggagcttcaccaccaagaatgtgccttggataagaagcttggagaggatgcttcaatggaggaaaagaaagagagaggggggagcacgaaattgaaggaagaaaagaggaagagaagttga

SEQ ID NO: 19717 - DNA, 489 bp, Glycine max
  Peptide Sequence Number=SeqID_111402
atgaaaatattcatgcaactagaggagggtgatcaaagatctccgggaatcatacctcttgctgtgaaggatgcttttagcattattcaagagatgtttccttacaccagactccgaacagagagtttcttcttcgagtttcgtacctggagatctacaatgagactttcaataaacttccatgatggtattggacttgaaactgtaatgacaataagttgcccaataggtgtacactgcaccctagaaattgagacatgctatgtgggattttctgacaccctctccccctccacaaagggaacctttgttgagggaataaaggaagaggttgtactctcccctgcgcatgctctgtcccttatagctgccggagaagtgtcactgttaagatcatgtgagagaacacatcccagtcatttcttcaatgctttgtgctatgcacttctatacggatacgtgcaaaagagggacttacataggttgtaa

SEQ ID NO: 19718 - DNA, 756 bp, Glycine max
  Peptide Sequence Number=SeqID_111403
atgtggataccgataggggcggacattgactggggtgtgtttatcggaggtggaatgggtgtgattgatgaaggggatgaagggggttgtggatggggtggagggggcgtttgcgctaagggtaatgtgttggcccatatgaacgaaagtcatggtcaacgtttggaacttggccacgcgcgactaaatgatgttatgcatgctgccgccgtccatgagaatgaccacttggtggtggctcagagacctaaggaggcggaaggggtgttaatcgtggaaccagtgtgtgaatcgagggccgagggacctgacgaagtggccatgcaaccacttctcatcgcaatgatagcaaagcccttgatcacggcggatcgccatttcctctatcaggaacggtttccgcagcggcgatccaacattttgtcttcctgtaatcgtgcgagcttagtcgcctgggagctccctgtggatcgtcataatatgacggagcgaatcgctattctagcgcctgcaacatcgccgctcaggaagggaaaaatccatttcgagccatccactggtggcggaccgggggatgaggacggagactgtgtaggtgctgctatggtggcgaatcgctcgacgagggaatcaaattttgtagtaagcgagcctctttcgagtttatcggtagtaacttggcgagtgtggtgttcaggcatggtggatgtggtggttgtaaccattgcagttgaaggtggtggtggtggtaggtag

SEQ ID NO: 19719 - DNA, 273 bp, Glycine max
  Peptide Sequence Number=SeqID_111404
atgacaaaacttcaaacaattgatgttttcattgatctcttcaaagaactagctttcttaacaaaagagagggatgcacacagtttgtgtgggttgctgcctcccacattcagcagtcaacaacttcaggagaataaactgatgaacaacatcagcctatatcaggttcccttgcaaaagtatgtggccatgatggaccttcatgtcattgtttggcaacccaacatgagagggaaaccagagaaaaaaatatttggaggaatatatgcatga

SEQ ID NO: 19720 - DNA, 387 bp, Glycine max
  Peptide Sequence Number=SeqID_111405
atgtcctcaccaagttctaatttaagtgacttgagttttgatactagattggacatttccatgatgtactccctcatatttcctttgcccctatacttcatggagatgagtttagccaaaagagtacggttcaattttttcaattacaaagggagtaacaaaaaacagtgtcacaacctactcttcagcgggagggcgacacgaggctcacgagtgcgtctttcatgggaggaaaatgtgtggagtcatcaccaacgtttattcaaggaaaacgtcggaaaaaccagaacgtgtggtgtacgaactttaagtgtgaaaggttcgagagttgtttttacgcacggggaaggtattagcaccccacgcgtccgtcacaagcgacgatag

SEQ ID NO: 19721 - DNA, 354 bp, Glycine max
  Peptide Sequence Number=SeqID_111406
atgattcatgtggttgcacagactccaaacacactccctacagctcaagaccaaccaaatcctacctttgtaagggagtcaattcccactacccctgttagagatgctccaccttcagcaccagatgattctgttacacctgagtacccaacagatccaaattgtgaacatattgttgatgaaaggcctttcattagtgcatataaaggagagtttcagccaacatatgggtgttctaatatcatatcaaatatcattagggcaaaatttgatgaaccagctccaagttggttgaaggtgtcagttgacctttgtgataggtggtttggagagtttaagaaagagtatagatga

SEQ ID NO: 19722 - DNA, 369 bp, Glycine max
  Peptide Sequence Number=SeqID_111407
atgactagaggaaattcatctgacttacaaccctttgatcctgagatagataggacatttcatagattagttagacatcatttggtaccttttgagcatcctaagcattctgttattggtgattttgagcattctgagaacatggcacaccctccaccctgtgagaggactctaagggaattggttgcacttgatttcacctacgaaagcttgtgcatccaataccctgatgaggatgtcccatatgttcttaaaactggactgatccatttgcttccaaagtttcatggtcttgcaggtgaagacccacacaaacatctgaaagaattccatattgtctgctccaccatgaaaccaccagatgtctag

SEQ ID NO: 19723 - DNA, 220 bp, Glycine max
  Peptide Sequence Number=SeqID_111408
gcttgcatctggtgtctcgctaagcgaggcttgtgtgcttagcaagaatcatgcgcttagtgaggcactcaacccgcttagcgagttgggagaatctggaggagaatctgagaagcatctgcgtgctcagcgtgtcattagctcgctcagcgaagcgtttgtctcttcctacgctaagcaccctcagctcgctcagcggatattcactaactcgcgctaa

SEQ ID NO: 19724 - DNA, 237 bp, Glycine max
  Peptide Sequence Number=SeqID_111409
atggtgcaaaacactattgggcttgaaaagagagatgcaactaatagagggaagacattcacttgcttcctgactaatggaaaagcaaagagtcgaattgataaggaggcttggttgaagaaaaatgttgttggatggggagcttatttacttaaagaaaaactaaatagggttaaggaggttttgaaaaaatggtacaaggaggaatttggtgtctacaaaggagatgacaactaa

SEQ ID NO: 19725 - DNA, 432 bp, Glycine max
  Peptide Sequence Number=SeqID_111410
atgatgaagccatttaactccccttggatgaggatttcacctagttttactgagcaacaaatgaacaagactatgaagactgaatctggtgtattaccacataagagttccaaggatggccttggaaaatcaacatatttccatatgcaccaacaagtaatcgagaagatagctccatcaggtcatgttgaaaaatgtgacaaacaagttttaaaagatgtgacatttgtattagatgcttttagactagtgtcataccctaattttgtccggggaccattatttgtcggcatgcgactttcgtttgaccacttcaaaatgtttaacacccatcgtcgtggaatccgtaaagttccgggatgtttcggagagaaaccggccaagaacacaaaaatgggagtgtatttagcaaaatggggggtgtgtaaatag

SEQ ID NO: 19726 - DNA, 1119 bp, Glycine max
  Peptide Sequence Number=SeqID_111411
atggcgaagttcggcgagggtgacaagcggtggatcgtggctgagcgccccgacggcaccaacgtgcacaactggcactgggccgagaccaactgcctcgagtggtccagaacctttttcaacaacagtttcaccaacgtcgccgtcggtgacggcgatgccactgtcacgatcaagaaggtggagaagctcgacggcgaggcctatgtcaacgtccgcaaggggaaggtgatccccgggtacgagatcagcgtgaggctcgcttgggagggcgaggcgcgtgacgccgacggaaaggttctgaagagagtcgacggcgccgtcgagatcccgtacatctctgacgagaacgccggcgaggatccggaaattagggtttcggtgaaggaaaatggcgaacttgggattaaattgatggaggtgatgttgaagaaggggaaggtggtggttttggagaaggttagggtttgggtggagagcatggcgaagggtgggcccgtgaaggacgagctcgaagcgaagaaggtggctgttcctcacaagaacaacaacaacaataacaacaatagtagtaatggtgataacaatgttaagaaggaagaggttaagaagaatgaggggaagaaggggtttaaggtgattagtttgattgagaagtttaattgtagggccagggatttgtttgagattctgatggatgagaatagatggagggggtttacgcagagcaatgcaaggataagcaaggaggttggaggagagtttagtatttttgatgggtcggtgaccgggaagaatttggagttggatgaagggaagctgattgtgcagggatggaggtttgggagctggccggatgggattgaatccatggtgaggattgtgtttgaggagcctgaagatggagtcactgttgttaagctcacacatagtgatgtccctgaagaagacagatatggaaatgcaactgtggtggagaacacagagaggggatggcgggatctcattttccaaaggatacggactgccaaggaaagattattggattggcaatttcttgtgaaagacgaagtgtctcatgctcaatttaatgatcttgctggctgtatctctagttag

SEQ ID NO: 19727 - DNA, 225 bp, Glycine max
  Peptide Sequence Number=SeqID_111412
atggcaacacctaacgccccattagctccacaatggaatgtacccagagcaatacctgatatgggtgacttattaggttttgatttgcgtcacaagttttctgctaaggttgagcaagtagaagcggggagacatcgtggaataagaaatcctgatcgtcaagggcgaagatgggatcgaccatgtggcacatcctcacgtcatcacggacatcataatgaatga

SEQ ID NO: 19728 - DNA, 219 bp, Glycine max
  Peptide Sequence Number=SeqID_111413
atggtgattttcaaccatggatatgcagcggaagataaaggagaagaggtgagagaatacggcatccacaagggaataagccatggaaggaggagcttcaccaccaagagagtgtcttggataagaagcttagagtggaagcttcaatggaggaagagaatgagggagagaaggagaaagtggcatgaaaaattgaaggaacaaagggatacaagttga

SEQ ID NO: 19729 - DNA, 510 bp, Glycine max
  Peptide Sequence Number=SeqID_111414
atggatgatggcataaaagaagaagtgttggagacttcgattgtcaccgagaggagtgattccaacaaggacaaagaagagggccatgacttggacagtacactagccaacacaatgaatggtgcttcttcttcggtagagagtccgtccaagaagcgaaggacaagcgaggctggaggagtggttttgtcggttggattcgtcacccttctcccttcggcgttggcacttcctcccactttgtttattaggtatagtgcaaaagcaaagaaggtgaaagtggtgaagggagattttgttcctatggccagtgtgggagcttcccagaacaaaattcttgctgacataagcaacttaccccaacaaccaaagcaacacatctctgttgaccaccttctcaaggaaaaggaaacgttgataaagcttattgctaatagagagcagactcttctagtagaggatgtccagaatgttaactgtggaaaaggttgctcaagctcaagcacatga

SEQ ID NO: 19730 - DNA, 351 bp, Glycine max
  Peptide Sequence Number=SeqID_111415
atgatgagaatcatgaaactggccaaatacaggctaaaggcccaagtggagaaggacgaaggcccaagtggagaaggacaaagcccccaagtggagaaggatgaaggctcaagtaatccttgtggcgtctatcctgacttatcttccttcaccggaagtggcgtctacccagacttatcttccttcattggaagtggcgtctaccctgacttatcttccttcactggaagtggcgtcatccaaatctctgtaacctgtatcaaacgatccactcctactcaggttcacatcattaccttgacttatcttccttcactggaagtggcgtctacccagacttatcttccttaa

SEQ ID NO: 19731 - DNA, 285 bp, Glycine max
  Peptide Sequence Number=SeqID_111416
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatcatgatgatgatgctagaggaggggcttag

SEQ ID NO: 19732 - DNA, 636 bp, Glycine max
  Peptide Sequence Number=SeqID_111417
atgtcctttactgcatacttgatcactttggctcttggtagagccaagtcagcaccatcagtggctatattggctatttccactgttagttcttggtctcctagtcaaagaataatcaatctttctactcctactcctcacttgagagctcgtgctggcaatgaacatgaagaacatactcaaattcgaatatgtgtgcaaggccttcttaacaggctttctgaatctaatgttaagtcaattactggggaattgtccttgatctttcagggattcaaaaagtattatttgatctttggatatgtcaaattcttcctccttgatcttgtgttaaaaataattaaaaataatattcaatttaaagacgatgcttatatcagcaccgtctttgaaagtagacattctaaaacggtgcttacctcaacaacgtctttgaaagtaggcattctaagacgttgcttaaataagcaacatcttagaatgcctatttttaaagacgttgctgaggtaagcactgtctttgaaaattgctcacttttaaagacggtgttttggaacccgtcattgaaatttttaagcttcgacgacgtcacattcaacgacgttcgaaaaacgttaatcacttttttccaatag

SEQ ID NO: 19733 - DNA, 267 bp, Glycine max
  Peptide Sequence Number=SeqID_111418
atgcagcatgtggccgaccaacaggtagctaatcataggggtcaggtgcagctacatgagagcttctaccggtacaccctgcaccagcagagccaggaccccaatcctttcccgtggcctacccccgagcagttcggggccacgattgcttggcctagagataggcccgattttcagacaggggcaggacccgtagggaccctcggagatgaaggaggagcacaggatgatgatgatatggctgatgtgatggactacttcctttga

SEQ ID NO: 19734 - DNA, 138 bp, Glycine max
  Peptide Sequence Number=SeqID_111419
atggagagggagtttcttgtgcacgactgggtgacctcgacacttcctgatatgaatggcagaggaatggagaaggaagagagagaggagatgccacttcaaggagaagatgagtctagaagaagctcaccaccatag

SEQ ID NO: 19735 - DNA, 213 bp, Glycine max
  Peptide Sequence Number=SeqID_111420
atgaaggcagtaaagaacactatggatggtaaaaatgatcaaggaactcctaagtggattgaagtgaaggatcgtcaagttgtttatgaaggtgaggtggtacttgcagaacagcctgacaaaagcaccttagatgctcccaatctaagaactaaggatgaacttactccacaacaaggtaagaacatcacattttacacaattcagttttga

SEQ ID NO: 19736 - DNA, 228 bp, Glycine max
  Peptide Sequence Number=SeqID_111421
atgaaaacggagaagagcaaagtggatacattgataacaatttctccaaacacgtggcatgcatcaaatggaagttactggaagttgaacttggaagttgaacttggaagtggaagttggaagttggaagttggaagtggaaattattggaagttgaaagttgaaaatggaagttggaagttggaagtgaaagttactggaagttggaatttgaaatttgaaatttga

SEQ ID NO: 19737 - DNA, 453 bp, Glycine max
  Peptide Sequence Number=SeqID_111422
gaatttagaattcttgtgactggagtagctggaggagaagtgttcagagtcaggcctggtgtagtcgggtcctctggtatctctaggataggagtggaggggtctgattgcaagtcgcaaggtgtgccatctgtggtggagctcatgattctggctgttgtatccccaatgaagaaccaactcatgaagtcaattatatggggaaccagccaagacacaatttcaatgcaggtggattctctggattctagcatggccagtagtataatcaacagtatggacagtggagaaatcaccctggaaatcctttcaacaaagaccagggtggaccgtccacaaggatgcaacaacaagggcctagtctctatgatcgaacaacgaagctggaagagactcttgctcaattcatgcaagtatctatgtcaaaccataagagcacagagtctgccataa

SEQ ID NO: 19738 - DNA, 804 bp, Glycine max
  Peptide Sequence Number=SeqID_111423
atgcctagtttattcgcaatcccaggaactaagggagttgtaggcaatggccataggcctatggggaaggccagcagtgcgagtatagccggaggaggagtcaggcctccggcttcggtgaagaggctatcgcccagttgttatgcgtgccgggataggactttgctcggacagcggcggggagacggcaatgtcctacccaatgaccataactcggaccttcccctaccgaagtgtcagttggtttatgccatcctgacacagatgagtgtacatgtggctcagctaatctctgacattatttaccagtttgcaaagattgcgcccacgagacacccagtggacccagagaagttcaacagggccctgggatttcctactctgattataggcctctgtcagttctatggagtgcccgtcacccccaacaagatcatccggcctcctattaacagggcatacatcgagaaatattgcatgcccaagttggagtgttgtatacgacatgtggctaaccagcaggcgaccaaccacaggggtcaggtacggctgaatgagagtttttatccgtgcaccctacatcagcagagccaggatcctagcccttatgcatggcctactcctgaggagttagaggtcatagtggcatggccaagagattggcccaattttcaaacaggggcagggcccaaagggacctccagagatggagacgaagctcaggaagacgatgacatggccaatgtgatggacttcttcctgggaggaggtgaagtcgtacggccggggtcgccaaacttgtga

SEQ ID NO: 19739 - DNA, 1221 bp, Glycine max
  Peptide Sequence Number=SeqID_111424
gagaaggtattagcagaccaaggtgaatggacttcattcattgacatcttagcactattgatattcaaagtcatcctctttccaaatgtggatgggctagtggacctagcagcgattgatgccttccttgctgatcaccatagcaaggaaagtccggtcacagctattttagtcgatctctatgacacgttcgaccgaagatgcgaaaagagcgacacacgaatcgtctattgtacaccaactctctatgtgtggttagtctcgcacctctttcgccacgagagtagacctgtttgtcccatgcaaggtcactacatatgcgccgagaaaggagaggtaaactgggagcaactcttggctagtgtggtaggggcatccattaattggttcccctggtggaagaaagggggagttggggttttgtcctcatgtaaaggattcccaaacattcccttaatgggaatgaggggttgtatcaattataatcccgtcctcgccataagacaacttggctaccccatgagaggagcaccatcagaggaaagcatcatgcctttgatcgcacggggtttcagtgaccacaatgcgaggatacttcaaggagtccacaaggcatggggtgcagtgcaaaggaaagataaagagcttaggggaagcgccaatggtatcatcgacgactatcataagtggctgaagactcagacgcaagagttggattggattcaaaagctaaaagtttcaagcgaggaaagggatgaaattcttgaggagagtgaggaggtgcaagccctaaaagcagaacttgaaagggcgcaagcagtcaaggaaaagttcaagacaacagccatcgagctgaagctttggaacgggaaacaaagagggcccaaaaggaagaacacggctgaaacaagtttcgaggggctttatgggggtagcaacaacgagcttaagctcccaagagctgagagggactacttgccaaaggtcgaaaaggagcttgtccgaacaattgagcaagaccaaagaaaacatgtgggccatcatcgaccaatacaaggaaaagttaagcctagcggtaactcacaaacaaaggctagaggacgagtacgtgaaggtataagtcctgcaagtggaaagggaagcaagggaaagggatgtcacgacatcgcgcttcagaacatgcagcttgtatatgaccgtatgaacagattaaacaagtaa

SEQ ID NO: 19740 - DNA, 190 bp, Glycine max
  Peptide Sequence Number=SeqID_111425
aagatctgaagaggacctagaagagttacctcccaaacctactgtggatgaccttgacttacctgaggatgatgaagacccactccctgatgttgattttccagaggatgttttgtcagcatctgaggcagactctacagaggagagtggccctggagggacagcaaatagtgacgactcttcatcatag

SEQ ID NO: 19741 - DNA, 540 bp, Glycine max
  Peptide Sequence Number=SeqID_111426
atggtagaatctctccttaggtggtttggtcatgtgtggcaaagtctggtagaagccctaaaaagaagagtagagcagatggaggataatgtagccactagaggcagagggataccaagaaaaactataagcaaaacaattaatatctcaaacatcttgcatatcatacaacgaagtgtggatggaaagttgttgtcagtaatcaccgaggacttggaggtgtttcaatcacgattcttgaccttgaactttgagacatcacttgatattctcaatgttggtaaaagccttgataaggctgctatgccgaacactgtgggaaatgttggtttttccctcaaagggtgttgttttattggtgtgttgagatggggatggagcagtgttgttggaaaagtgggtggtggtgggaagaggaaaaaggaatcgcatgaagatagtataagtggaggcttcaatctcttctccgtctctctgacgtttgagaattttattgggacactcggaggaataactggaggaatatcagggaaccgctag

SEQ ID NO: 19742 - DNA, 519 bp, Glycine max
  Peptide Sequence Number=SeqID_111427
atggaaggaaaacaaactcttgacggacagggctacttacctttgaccgagacttcacagatgaacttctctggtgttgctttgcagagattgaagagacacagggcccaatcaaagcttgagtttgagggtcactgtaaaaacaaaaattactttgatatcaacactactaaaatcaagctatatgaaaagaagataccaaaaattcaaaatgaacgcaacactaaacttaggaatatcttaattcaggtaggaggttgtgctttgtgcggcggagctcaagagtcaagcacctgcatgactcaagaggaaacatcaaagaaggtcaattatatggccaacatgaaccaccatgggtataatcaaagaagcaatgcaagttatcatccaagaagtaatgcgggttttcatcaaggaggaaatttctctcaaaaccaaggtcaagattggaggttccatccaagtaataacttcaagaaagaccaagtgggttcgtccaattgccccctccccccctaa

SEQ ID NO: 19743 - DNA, 318 bp, Glycine max
  Peptide Sequence Number=SeqID_111428
atggccagtgttgtcaaatgcctaatggaaggccaggaagggaagaagcttcattaccgaatcaaggatctcaaggaggttgcggctaaggttctctctccacatggttcctctaccgaccatatctccaatttgcttctcaagtggaccaacaaaccaccatctctactagtttggtttggttccatctttgtgtttgtttaccctgaaccaaaagagtggtgtaaaattgaaatccacgtggtgtttgttacacactttagtgtcatgttggatagtctacgtgacactaaaattgccaacaatgcacttcactaa

SEQ ID NO: 19744 - DNA, 315 bp, Glycine max
  Peptide Sequence Number=SeqID_111429
atgtatggggatgtccagctgaggcaaggccttatatgccaaatgaaaggaaattggactcctgaacagtgctataagttttatgatcccaaattaaagacaatttttgagacaggaactgccacattttttgaggatattgagtctggggggaagaataaggttagagactttgtcttagaggaagaatcagtaacaattccagaactgattcatacagttgttattgataaagcaaattcggaacctctaaaagatattgttattgaatctctcactcaagataatttggtcgttcatgaagaacaaacttaa

SEQ ID NO: 19745 - DNA, 816 bp, Glycine max
  Peptide Sequence Number=SeqID_111430
atggataatgagaacgcaaaggataaaatatttgagaagtttacatggaggattagaaacttctctacattagactccaagccactgtactccgaggaatttttcctcgataaccatacatggagcattcttatctatccaaaagggaacaaggtggcctatttgtcaatttatttagatgctggggatcctgatgatttgcctcatgggaggagaaaatatgcaaatttcaagttggctttggttaatcaggtccatgacaaatataatgacatagaagaaactagccacgtgttcagtgcaagtgagactaattggggtttcacaacattcacacctttaaataaactttgtgaccctagccttgggtttattgtgaacgatacttgtataattcaagttcagattttggctaacaaatcaaaacatgagaaccaagttgatcaatcagtcaataagattgattataagattgttgaacgcatggataatcctttacccaaggaaatgatctcaacttcatttggcgggctagtagatttcaggggtctagggaaactagaagaagatttcgtaccactacttgaagaaaaagttgttcaagtgaaaacgttggaggagaatgtaacaactttagagatgaaaacaaaggggttgaagacaaagctgattgaagcagaggagaagaattttaaagagcaagcaacatggtcaattgctcctgagtctaagatccaatctctaggctcagctttgcttatgctacaaattgttgttgaagcagtgacatcaaagcttgatactgttgtggcatga

SEQ ID NO: 19746 - DNA, 306 bp, Glycine max
  Peptide Sequence Number=SeqID_111431
atgccacttacgatggtgactaggcctgtcatacaaaaaggagaaaaattggaaggcgtagcagctggagtcttgctaagcccggggcatgcgcttagcgagtatcatccgctaagcgagacatcagcccgcttagtgactcgcccagcgagttatctatctcttctggcgcttagcgcgcttggctctctaagccaaagttcacttactcgcgctaagtgcaaaaatggagctaagcacgccttcaagaacagaaagccctttttaaagcttgaagtgaagaaaaagagagatcttggcagatag

SEQ ID NO: 19747 - DNA, 651 bp, Glycine max
  Peptide Sequence Number=SeqID_111432
atgactagaggcaatccaggtgacttacaaccctttgatcctgaaatagataggacatttcatagattagttaggcatagtgtgcatcattaccctgaacattttgtaccttttgagcatcctgagcattctgttattggtgagtctgagcattctgtggttggtaattttgagcattctgattttgaacattatgaaaatatggctcaacctccacctcatgagaggactctaagggaaatggctgcacctgatttcacttacgaaagcatgtgcattcaataccttgatgaggatgtcctttatgttcttaaaactgaactgatacacttgttgcccaagtttcatggtcttgcaggtgaagaacctcataaacatctaaaagaattcaatattgtctgctccaccatgaaacctccagatgtccaagaagatcacatctttttgaaggtctttcctcattctttggagggagtggcaaaagattggttgtactaccttgctccaagtaacatggagagaagtatgattgatgctgccaatggtggagcccttggagacatgacccctgctgaagccaggaatttaattgagaagatgacttccaactcccaacaatttagtgccagaaatgatgctattgtcatttga

SEQ ID NO: 19748 - DNA, 1158 bp, Glycine max
  Peptide Sequence Number=SeqID_111433
atgacggtaaaaagaggcaacatgacagaggaggatgtccgacgccctgagctagcgccagatgtacataccggaatggtgaatgaattgacaacaggtgttgattttgagaaattctcatggaaaattgaggatttctcaaaaaaaaatctcatgaaattgcgctccaagcctttcaaaatccggggttgtacatggaggctccttgtgtatccactgaggagggatgtgaatcacttttcagtgtatttgatggttgctgattctttaccgccgtacggatggagcagaaacacttttttcaagttagctctaataaatcaggtggataggaataagtctatagctaaagagacacaacaaaagttcaatggaggatatcgttgctggggttcatttttcttgaatcttactgatttcaataacccaaaacaagggtatcttgtgaggaacacatgcataatcgaagcacacatatgtgtctccgatttagcacctaagattcaagtccacccaaatagttctcccatccatgactcttgtgatcaagcaacagaagaatcatcctcagatgatagggacaccattagtccaagaacctcaggatctagtactgcagcagaaggtgaaattcaaggctcaaacaatttgacactaagagaactcatagattttgagagtttaggagcagaagaacaagcattcattccactcttggaagaggtttgcatatggcaccctaatctgataaagtgccaaagggaaaggactagaaggtttagacaatgggcctttacttctttgggccatgttttgcattttctcaagaccaaaagggttaaagacatcaatgaagaggacataaagtaccttcatggcttgtggaaggaacttgtgaagtcctcagggtttgacctggcttggctggagccatatgttcaattagcattgggttcgagggcatatatggaaagagcaaaccaattgaagaagctgaaggacaaggtggttgctttggagattaagatgaagcggctcaggggggaacttgctgctgctgaaggagagtttgaagtggcaaggagaggcttgtctgaagtaagaagaggcttcaatgagatggatttaaatgctgcaattggttatgctatgttttga

SEQ ID NO: 19749 - DNA, 162 bp, Glycine max
  Peptide Sequence Number=SeqID_111434
atggaggagttgattaacaaaacacaactctctcccaaaataatctcaacatcatcacatcagctcggtggctccacaaaagaatctcacttctcgtactctactgctgtcattctactcctacgaacaagagttcgcgatcatcacaggtatgtaaactaa

SEQ ID NO: 19750 - DNA, 654 bp, Glycine max
  Peptide Sequence Number=SeqID_111435
atggctacaccacctagctcacctcctcctcctcctgagtcagcaacaccttcttcaccgtcttcatcaaagaatactagaaaagcaacacgaatcaggtcgttgactactagaccagctggggtgaagagactagtggttcatgttgaccctgtcattgggaaattcgatggtccccaccgaaagaaattaagaacatatttggggattgtctttcgtgataaggagggcgaggatgacaaagtctgcgagaagtatagaataagcaaagagaagtggacccaattttgtcagagccttggagatcctttatgggaggattccttggaggagcaggcctcacaaggaagttttgccacccatggacgtcaggatgtactaactgttgccattaggcgaccagagcacccaggactcgcacaacctcctgaggctgaggttggtccttctactactcgtgtcaatataaaggaaagttgtgttgatccctcaaggcaggacccagaaacgggtgactcagacaaatttgggatatatgtcaatgacaatcatccccgaatcgttgctcttggaagagtttataaggggtcgacagtcatccatagcattcctttgggcaatgatcaagtgaaggtcggggttgaggaagtctga

SEQ ID NO: 19751 - DNA, 567 bp, Glycine max
  Peptide Sequence Number=SeqID_111436
atggctgagaggttgacagctgtccaaaattttggaaagagattcgtgaagccatcgaaggttacaaaggatatacatactgatcgttggtcgaaagaggcatggattctgcgtcaagatgtttgtgctgggtgttgcagttttggtatcgcagggaatgatcccaaagttgcacagttcaaccagtttaaggcacgcatcggaaagttcttcaagcaagaagggagaaactccttcagagaacactttcctaggctagaggactttgccaaggctatctacatatttgatattggaaaaaatgatattgttgctgctattaacagagtgggccacgaagattctcacgcagtcatctcagacattgtggattattttgaaaaccaaatccaagtaaaaacaccacaccagtttttgggtctgccacagggagcatggtttcaagatggtgggttcgagatttctgtgttagatttgggtctacaaattagcaaaaactccacacctgtagatttaaatactaagtttagatttggtgttctacctacgatacttaatgaattataa

SEQ ID NO: 19752 - DNA, 198 bp, Glycine max
  Peptide Sequence Number=SeqID_111437
atgtttggttacagtcctttcactaagtgcaagcctcgcgctaagcgcatctttggtcatgcgctaagccgagagtctcaagcacttagcgctcaacccttgcatcttaggctgatttggtccgctaagctggccaaggctgagcaaagccaatttcaattcgatctgaattcggctaagcgacggcctgaccgctaa

SEQ ID NO: 19753 - DNA, 275 bp, Glycine max
  Peptide Sequence Number=SeqID_111438
ataacaactacaaaacaaaccggtacagactcccactactcgattttgttggggtgacaccgactgggatgacattctctgccggttttgcatatgtggagggtgaacacgtttatttaaaagaacgttgtcccttaccgcctgtagcattgttatggtctaacaattgtcatctgcagacgaagtcgtggccaaatccatatattagcagaatgcaacattacaagagcttcgtgatgttcaagagagactatgttgacataaatgatgattga

SEQ ID NO: 19754 - DNA, 111 bp, Glycine max
  Peptide Sequence Number=SeqID_111439
atggtgtacaaaggttggagctttgatggagcttcaatggtgaggaagaagaaaggaatagcaacttcctcgcgtttctctgcacccgtcggggccagttttcgaaagtag

SEQ ID NO: 19755 - DNA, 486 bp, Glycine max
  Peptide Sequence Number=SeqID_111440
atggcccaagctagtgccaacatagcgacatttcacattactcgaaaaagccgtgttcctccttcggtcgacaatgttattccaatgccttctattaaccgaacccctggattcttcatcaaggagtttgctctgaaccatcttgtcgatatgagccttatttcatatcatggtcatcgtgtgatgaacaagaatggtcgagataagggattggagaaatgtgctatcgatgttgaggattcagacaagtctaatatggaggaggtggtgagattggagtctgctttggccactattgagacagaaaaggatgccgaaagggaagagacaggggcaccaaatggtggacaactgaatgcccctcctagcgaaagccaaatgactaatcctggcgaggaggatgttggcgaggaagatgaggcccaaaaggagaagccttttagtgtcgttttgcttgtaatgcttgactttagccatttcatataa

SEQ ID NO: 19756 - DNA, 324 bp, Glycine max
  Peptide Sequence Number=SeqID_111441
atgagcgagagaaaaggagatgggatggaaccactccattgtagcgattttaatggccacctaggccttgaggtgagagggaaagaacgaaaaagagaccccaataaaaaagtgaggtattcgatttttggacctccgattcctggtgatagttgtgctttcctaagaggtcatggtgcaactgttagatcgtggtctgacaccacgtctctcttcaactgcgttggtaatcaaaacgctctgtcattccaactgttgatctttgtttatctcacagtggagattcatgataggtttggacctattggaggcccatcttcataa

SEQ ID NO: 19757 - DNA, 681 bp, Glycine max
  Peptide Sequence Number=SeqID_111442
atgccccgtaggcctctctcgggtgacctaagcatttggtacttcgatcttttattaggttggcgccaggttcgtattcaaaccttctttccaaatcagtccttgttcatttcattcgtggtgctcttggcacaatggtctaatctggaggagggaagttggatgtttttctctatttatcatcactacgggccatatggccagatcgacgttgtcagaataatagtgtgcccctttgaaaaggatgaatgccccacccatgtgatatctgctaaaggcttcgtcagtgaggtaaattctctacttgtcttcaccttcggacatcaagaaagccaaactgactcgctggctttgctttgtaagggcttgacctctgatgtatggaagtacgtggttgaagtgaattcctcggaaatgcagccgaagggcaatctctcttttgacccggtctgcatatggctatggttcagatacagactaaagactttctttcgtgctttgatctcaggggaaatccaacagaactcaatgaaacaaacgaattcgatacatcggaatttaaccctgtctaatactagttccctgagttcgatactcggattcatccattttaattttaaatacttgacgatccggtacgctttccagcgaatcgaattttccttgaacatatttgtataa

SEQ ID NO: 19758 - DNA, 369 bp, Glycine max
  Peptide Sequence Number=SeqID_111443
atggactcatctgaagattcagaaaacgaagttgtaaacctgagtctgatggccaaaattatgaaagcgatgaagagatattatattaggaaagcaaaggtttccttgaagaagagttggtacatagatagcagatgctttaaacacatgacgggagatgcatcgaaattcactcatatttctcccaagaaaaacggacatgtgacttatggcgacaacaataaaggtagaattcttggagttggaaaaatagaatcattagaagaaatgcatatttatggagaagatcacaaaggcaaaggagatggaaataatgaagattttcacattgatgaaattaaagcaaatgctgatcttccaagagaatag

SEQ ID NO: 19759 - DNA, 231 bp, Glycine max
  Peptide Sequence Number=SeqID_111444
atgacccctactcatgatgccctgctatattacaatgggaggtggaacatgtcacgccaaaatgagtttgttggttactcgttcacaggaaaaaatcccaaaaagtttgacattcattccaaatgtacaatggatgaactgaaagatttaatcaagcaagttgtgcctcatgggattcccccttatggtattcatgaaacacaaacggtgttaattgagtctaactactaa

SEQ ID NO: 19760 - DNA, 297 bp, Glycine max
  Peptide Sequence Number=SeqID_111445
atggagggggtgttctcaagtgtgaggatttctgaccctttagagagagttttcattgatggggaccttgactgggaatatcttagctcgcaacaatctttgcataagcaatcctcttggtggaaagacataggcaaagtttttggatggagagatcaaggtgggtggtttgactcacacataccatggagggtgggggatggaaaacagttttatgaggatattgtgactgtatctctaaagaaacttgttgcggatgtgagggtgtgggatcttgaagggtttgggctttattag

SEQ ID NO: 19761 - DNA, 1935 bp, Glycine max
  Peptide Sequence Number=SeqID_111446
atgttgagtggagtcacactgaagttgttcgtcggagtcgcactgaagttgtttgctgaagttggaatcgcaccagtgtcgttcgccggagtcggaatctcacgagtgtcaccagtgttaactggagttgcatcggtatttgcggaagccatgaaaatgggtcagagaactctagataccatattcaactttttcaagaacctaaatactttgcgtgaattgtttacaagatacagttactcagagggttatattaagaatgtcacaccaaaaggttgcttcattatgctgtcacgaaagattgatgccaaaattcttctgtccaatctttccgaacaatatgttcaagaacttgagaaagaatttcctattggaaaacttgtcattggcagatacttgaagaaatgtactaagacagcaaataacagggttatatctgtggagcctctctcaaatcgtgttgaagttacactgaagacgtcaacggatcccaatatacccaaatctgagattattgatttaagtaaatttcacgttggagatgttatatctggccggattaagcgggttgagtcatttggtttattcattgcaattgacaacacaaacatggttgggttatgccatgtatcagaaatttctgataaccgtattgagaacattgaagcaaactatagagctggagagagagtaaatgcaagaatattaaaggtggatgaagaaagacacagaatttctttgggaatgaagaattcatatatgagggatgaaaccatgcttcaaataccatctgaggaagaatcagatgaacctatcacagatggaatgaagtctataacttctatgaatagtagtttgcttggaacctcaaatatagatgttgaggatgaaattaatcaattcccaattctttcacaagtacaacaaagggcagacattccaccacttgatgttccccttgatgactttgatcaatttgatgtaaataacactaacagtcaaagtgaagaacatgcaaatgaagaagacattgtaaatgaaaaacataagagacgtgaaaagaagaaagcaaaggaggagagggagaagcaaataagggctgctgaggaaagattactggaggatgatgtccctagaactgctgatgagtttgaaaagctgattagaagctctcctaatagcagtttcacctggataaaatatatggatttcatggtttctatggttgatgttgagaaagcccgctcaattgccgaaagggctttgaggacaataaatatccgagaagagaatgagaagcttaacatctggaaggcctactttaatttggaaaataagtatggaaaccctagagaggaggctgttatgaaagtattccaaagagctctacagtacaatgatcccaaaaaggtctacctagcactcttgggaatgtatgagaggactgaacagcataatttagccgatgaacttctcaataaaatgacaaagaagttcaagcattcatgcaaagtttggttgaggcgtatacaaagtcttttgaagcaaaaccaggatggaatccaacctgtcattgatcgagcttcgttaagccttcccaaacacaagcatattaaatttttctctcagacagctattcttgaattcaaagttggggttctagatcgagggcgatccatgtttgaaaaaatcctacgggagtacccaaagagaacagacttatggagtgtttatcttgatcaagaaattcaacataaagacaaagatataattcgtgcactgtttgaaagggctgttagtctgagcctcccaccgaaaaagatgaagttcttattcaaaaagtatctttattatgagaagtcccaaggtgatgaagaacggattgaatctgtgaagaggaaagcaatggaatatgtcgagagtactagggcttga

SEQ ID NO: 19762 - DNA, 390 bp, Glycine max
  Peptide Sequence Number=SeqID_111447
atgacttgtgatagtttaggagtcaggatcatatttgtggatatctgcaatcaacccaccttccgtatgaagggggtctgttattttactacaaagcgcctacctgaggagcgcgttccaccagaacgcgacacgtggcttgtctggacaggtcgatgtgacaggggtggtcgtgcctgcctgccaggcgctaccagtcgtgcctacctgccaggcgctaccagtcgtgcctacctgccaggcgcgaccactagtggtagcctggcaggcacttccactagtggtggggcccctggcacgtccctgttccctataaaaccatctgccctccgtttcattttcacacaaacacaaaatcaagctcatttggaaaccttgaagctgagttga

SEQ ID NO: 19763 - DNA, 1794 bp, Glycine max
  Peptide Sequence Number=SeqID_111448
atgggggtcttgtccataggttattctttttcctcaagtttactcaccaaactcatatttggagtgccacaaaacaatgagcggtgcccttcaaggaggaaggcatgtgttgtgtattgccaagggggtgggaatgtaattaagtcctcctcaggcttgtcttctgtgttgacagaaagatcagcattggttggcacagatcatgcagctgcagttctaatggatgcaggaagcttggtcttgtcacaaaatgggaaaagccaggcagagattttggtgaaggatttggtgccttatgatggaccaacaacattgataggggtggaagatggaataggcattgtcaagtttcttggagggaaaaagtttttcattactggggcaactgggtttctagccaaagtttttattgagaagattctaaggacagagccagatgtggggaaaatgtaccttttgatcaaggcaaagaataagcaagctgcaatggagagattgcaaaacgaaatcataaacacagaacttttcagatgccttcaagaaatccatggaaaatcataccaagcctttatgttgagcaagctagttcctgttgtaggcaatatttgtgaacataatcttggactagatgagggtatatctgatgttatagcagaggaggtagatgtcattgtaaattctgcagctaataccacatttgatgaaagatatgacactgctatcaacataaacaccatagggccatgccgccttatgaacattgccaaaaagtgcaagaagctcaagctctttctgcatgtttcaacagcatatgtcaatggacaaaggcaaggtaggatcatggagagaccatttagcattggagagtgcatagcaagagaaaaatatatatctgaagtttccccaaaataccttcccacattggacattgaaggagaaataaatctggtttcaaattacaaaggggacattgaagacaacttactagctcagaaaatgaaggagattggtctagagagggccagaagatatgggtggcaggatacatatgtgttcacaaaggctatgggagaaatgatgattgacaaattgagaggggatattccagttgttgtaatgcgaccaagtgttattgagagcactttcagtgaaccatttcctggatggatggaaggaaataggatgatggatccaatagttctctgctatgggaaagggcagctaacaggttttctggtagatccaaatggagtactagatgtggtcccagctgacatggttgttaatgcaaccttagctgcaatggcaaggcatggagtgagccaaaagccagatatcaatgtgtaccaaattgcttcatctgtggtgaaccctctagttttccaagacctggcaaggcttctctatgaacattacagctcctcaccatgcattgactcaaagggtaggccaattcaagttccactgatgaagttgtttagctccacagaagaattctctggccacctgtggagagatgctattcagaaaagaggcctcacagctgtggcctcctcaaaggggaagatgtctcaaaaacttgaaaacatgtgcagaaaatcagtggagcaagcaaagtacttggccaacatttatgaaccatacacattttacggtggaagtcaatcagaaatcatgagacatgactttgaagatagttattataaaaggtggggtacttatcgacatgaattgagtaatcatcaacgcatttttaaccttcaggatcaaagcaacaatgattttatttattga

SEQ ID NO: 19764 - DNA, 570 bp, Glycine max
  Peptide Sequence Number=SeqID_111449
atggctacaatcattcagaacctttttgttttgaagatatctgctttatatggtaatgctagtgtttggaagatctttactgacctttttgatttctttccgttgactgcattggttgagtccgaaatattttgtttgcatggtgggctttcaccttcaattgagactcttgataacataaggaacttcgatcgtgttcaagaggttcctcatgaagggcccatgtgcgatctgttgtggtctgatccagatgataggtgtggctggggaatttctcctcgtggtgctggatatacatttggccaggatatatccgaacaatttaatcacacaaacaagcttaagttaattgctagagctcatcagctggttatggatggatttaactgggctcatgaacaaaaggtggttaccatttttagtgcacctaactactgttatcgatgtgggaacatggcctccattttagaggttgatgattccatgggccacacatttatccagtttgatcctgctcccaggagaggagaacctgatgtcacccgtagaacgcctgattacttcttatga

SEQ ID NO: 19765 - DNA, 561 bp, Glycine max
  Peptide Sequence Number=SeqID_111450
atgaccattggagatttggaggttcggagaggtccaaggtatggtatcaatctggctaaaggtattctggaacatcacttgaaagggatcctagattctgacaaaccaaggaaattgctcgaagattttcgaattggcaagctcatcacaggtaatatacataggttgcaggttggcaagatagaagcagagaaaatgcttattcaaatggttgaaactgagttggagaagagaaagcaacagggcacatataaaggaggatttggggggcagtcccacttttttgggtactccgtctattttagatatatcattcttagaattgtaagctatgaagggagatgtggcttgccaactaattttgattctacttactgctatgcattgggttatggtgttgcagccctccttcaaagtgggaagactggattaatatcatcagttggtaatttatgtgctcctgtagaagaatggattgttggtggaactgcactcacttcattgatggacgtggagaggagacatggtaaattcaagcctgttatcaaaaagaccaattga

SEQ ID NO: 19766 - DNA, 369 bp, Glycine max
  Peptide Sequence Number=SeqID_111451
atgcagaaggagttctattgttctaaatatgttgtgttggttagagttttatgtgagaaggctaaggagattttgatggatgaaagtaatgtccagcctgtgaaaagccccgtgacaatttgtggtgatatccatgggcagtttcatgatcttgctgaactatttcgaattggagggaagtgtccagatactaattacttgtttatgggtgattatgtggaccggggttattattcagttgaaactgtaacacttcttgtgtcactgaaagtgcgatatcctcagcgaattactattcttagaggaaaccatgaaagccgtcagatcactcaagtatatggattttacgatgaatgcctcagaaagtaa

SEQ ID NO: 19767 - DNA, 564 bp, Glycine max
  Peptide Sequence Number=SeqID_111452
atgtcggttctcaggggtggtgccatgatgggacttggtattatggggtgcctaagtccaacatcaagtagtatggaatgcgaggaaagagaactagcattgaggtcattcaagactggaaacacaccaattctagtggcaacagatgttgctgcacgtggtcttgacatcccacgggtagcacatgtggtaaattttgatcttcccaatgacattgatgattatgtgcaccggataggaagaacggggcgagctggtaaaatgggattagcaacggccttcttcaacgaaggtaatttcaacatggctaaaccattagctgatctgatgcaagaagcaaatcaagaagtacctgcctggctcagccgttatgcggcaagggctacttacagtggtggcaacagaaataggaagtcggggggatcccgttttggtggccgagattttaggaaagagggctcgtttaataaagcaacagattactatggtggcggaactggtggtggatattgtggcaattatggtggagggtatggtcaaggtgtgcctagtgcttgggattag

SEQ ID NO: 19768 - DNA, 126 bp, Glycine max
  Peptide Sequence Number=SeqID_111453
atggccaaagaagagaaatttagtgtaactgatgactcactcaatgagactgatccgctcagcgagtggcatccgcttagcgaggcatacaactcgcttaacggattgggaaaccctagaagatga

SEQ ID NO: 19769 - DNA, 312 bp, Glycine max
  Peptide Sequence Number=SeqID_111454
atgaaaaaggttttacatcaactgttcaatagaaatccccaactgagggttttagccttccatggcaaggaagctccttttacaataaagaaagggaatcaagagaaattgcttgcttacacaggaggggggatgtctcctccacctcttggcaccgcacaatcactcaaaagctccttaatctctctaaaagttgagaacttggctccttgctttgcttcttcgttctatgcagtccacactcagaggctctctgtggtctcactccaaaatctcttcccccctctcttttcagtgcaaatcaggctttaa

SEQ ID NO: 19770 - DNA, 378 bp, Glycine max
  Peptide Sequence Number=SeqID_111455
gattcggatgatgttctccagcggcgaaggcccacagcatccgcacgtaggcaacgggaagttgtcgttgttgctgaggatgctcctcacgtggatgacgcagttgaagaggtattccaacatgctgatgaagttgttgatgattttgagggttttcctaggccgcgtgacccatcagtgctaattgtctatgctgatcatgttgcagtcattgtttggaacgaagaggaacgtcctgaattaaagctatcttcccatggaaggaaggttcagaaatttgggagatttgctgttgaaattgaaaggttagtcgttggcataagattaagtcctttgatcgcatattcattggacactggccatcagagacttatataa

SEQ ID NO: 19771 - DNA, 93 bp, Glycine max
  Peptide Sequence Number=SeqID_111456
atggctagggttttactgcagaggaggaagaagaacaagtgcagggatgatgagagagaaagagagtctttgttaatggtggaaggaccttag

SEQ ID NO: 19772 - DNA, 285 bp, Glycine max
  Peptide Sequence Number=SeqID_111457
atgcaagaaaaaattgattgcaataacataaatgagataagggaagagagaaatacaaactcgatttatactggtttggccacttctcgtgcctacatccagtcctcaagcaacctacgtgagattttccactatctttgtaaatcctttacagactttgaacacaccttgggatcccttaccattgtgttcaaagattctccaagagacaacccgtctcttgattacaattctcacaatccaaggacaaccagtctcttgattgcaactgactttctgagatga

SEQ ID NO: 19773 - DNA, 456 bp, Glycine max
  Peptide Sequence Number=SeqID_111458
atgacagtagatacaaatcccttcctgaaactgaatattaatatggtgtcatatgagtatcctaccaccaagaaaaaaggtgaaacagaaggcacctctaatggttcaacatatcaaattattgatcctaagctagccaatatgtggcaagccatgaagaggaaggaagaatccatgaagattgagaaattgaggcagcaaatccatggcaacatggaggtggctcacatgccaaaaattgatgatagaccaatcccacgaagcaaaataatggtggttgaattcaatgttgagaatgagatgaaaaccctatggatcactgttgacagcgagggaaatagtaaatttaggatgattaaaccatctacaaatgcagagataggacaatggtgcttgaatcaaaaggcggttcaagacaaagaaaatccgcaacttggaggattaacccatacttag

SEQ ID NO: 19774 - DNA, 528 bp, Glycine max
  Peptide Sequence Number=SeqID_111459
atgcagaagccatggaacctgcgcctttgcaagcccacgctaatccccaaggccacactcaagatcggcattggaccttcccaaaaaccaccaccacgccaccaacaatggagcattccacgacggcggcagcagcgacaacaacaaccccgcatcgaagtcgctgcggcctcgcgggttctaagacatgctgtgcaagtgtgttccttggcttatgcatatggcttcattttatctgcaaatttctccaaatggagagagaagctgcctccaagaccatctttccacaactatgttgctgtaatgtttgtcttcagtgtgattaccttgtttgcttatggactagcagaaattgacgctggactcaacaattggttgtatgatctcactatgctttgttatcactgtgtcatcaacacgaatgccatctcacttgtggacaacgcatattacttcgctcttggaattctaaggaatagtgcttttgaaattgatcatatttttattaaccaaggacatacttactaa

SEQ ID NO: 19775 - DNA, 465 bp, Glycine max
  Peptide Sequence Number=SeqID_111460
atgaaaaggagtagaagtttttccttactcttttacctgtacttgttggtgattgtcttttctaccttctctatagtttccgtggaagcaaggaagactaacaccaagaaaaaacttcacaaacctcacaaaggtggtcacactcgagggtcacattctccatgtccaattctagcccctcaagggagcacctttgatgttttggcttttggcgccaagggaaatggagtttctgatgattcagaggcacttctagctgcatggaatcgtgcatgtaaagttgctggtgctacagttaaaattccagcacaactcaaaggcattgaggctaacactattagaaaaatacactttcaacatcggttatttacggcattctacgtcggttttaaaatcgatgttgaaagtactgatgttgaatgtattattgttaacattggttttgaaaaaccgatgttaacataa

SEQ ID NO: 19776 - DNA, 570 bp, Glycine max
  Peptide Sequence Number=SeqID_111461
atggcagggaggagtggaccatcctttgcattaaaaaccaggaatgaaggtttttttcaacaacattgtatgaaacaatggctccgtcaagtgtgtacttccttgaatatccctgcaccttctatagtgctttccgacattaagttcaacgacgaagtagagtttcgaaggtattgtgggacactcataaggagttttgatggcaaccaactttctcatgttagaagatatgcgttgacagactacgatgcacaagaagaccgcaaccagtcatgggagatggtttttcggatggatatgagcatgcacaagcaagtcaaggtggctatggaagctaacaaacagctcgaacatgaaactccaacccctgctttggaagtagatcaacaaaatgctagagctgaaaatggttgtgtctacactaacctccaagatgggaactttatcactattgatcattattacacgctggacactccgacgaacattggtgaccaaccagaaggtggtgctgatgaatatatcatgatgaacaccataagacacagtagtattttaagtgacttatag

SEQ ID NO: 19777 - DNA, 483 bp, Glycine max
  Peptide Sequence Number=SeqID_111462
atggaatgtggagttggaagaggaaatagggaggttattgaagtgttgaagagaaaagacatggaagactatgagaggttagggaatattgcactaaagataaacaagggttatgctgtttcagcacctttgctcacaggaattgctgcactagggtctgtgttttcaggagatggattagttcctgcccttgctagggcgttggccacggtggttaatgcttttgagcatggagtgcaagttggcatggtgtttgaaatgtacagaacctgtggtggattttttcagctgttggaggagacaattgaagccgcaattgaagagaaagacttggacaaaagagaaaatggaaagctaattgaaatgaagatggctttgcaattgggaagaagtgtgtcacagctgaggaaacttgccacgaaatctgcttcatgttgtattgaagggagggagatacatgaatttgccagcaaactcttctaa

SEQ ID NO: 19778 - DNA, 759 bp, Glycine max
  Peptide Sequence Number=SeqID_111463
atgcagagttcgtcgagaccacccagttgtgcacgtaactgcccccccataggtgatcagcttggggcccaaaggagttccctaccaggtgacacgcccactcagtacaaacaagtgtcaatgaccatggaccaattaaagcgcctaagcatcccctcagaaaggcttagattctttaatcacgcttgttacccacgtctgggtcatccgacaagaaaaatcaacatgcaacagggacaggcagttatcctcatagctaggttccctgaccctaactatggtgttaaaacgggtttcgttctctaccgaaaccgcaagccaagttggaagattccgcttcggttaaagggttcctctcggtgtggggtttcaacggagaaaaacgacagtttgtggtggctaatggtggctgtgggtgatgtagaaagtgcttgggacgttagaaatggttttggaagaaagaaggagaagaaaatgatgtttttcctaagctacttggactacaaggctcaaaacgcacaagtgagcaatgctctcgggaacggaaacttagcacacactccaggcatcttttcaacgatcccaacggccaaatttcgagaagatccaacggttaacgaaggctggacaacatttttactgaggcagcttcatgtagcttccttgagaagcttcattaagaggcttcctcaagaagcttcctcgtggcttctttcagaagctttctcaagagtcttctttgagaagctaatgctttaa

SEQ ID NO: 19779 - DNA, 153 bp, Glycine max
  Peptide Sequence Number=SeqID_111464
atggaatcattatcatcatcaaagactgctgctgaagtagatgtcacccttcattttttggctttgagcttcaacacttatcttcacaaagggtgtctggacatctcactgtcacccaaaagtgctgccagcggtaaagttgtgccttggtga

SEQ ID NO: 19780 - DNA, 405 bp, Glycine max
  Peptide Sequence Number=SeqID_111465
atgttgattgatgttagaaatgcattagcatgtgcatgttgtgtatgttcgtggggggcactgtgcactgaccctccagggtctttggcactagcttttggccgcgttcatacattggatgttgtgtatgttcatggggggcactgtgcactgaccttccagggtctttggcactatcttttggccacgaacatacgtcgtatggagtgtatgtcatggggggtagagtgcactgaccttttcggatggcccagacgcgctttaattggtccatggtctttggcacttacttttggccgtgatcatagctcatacgacacaggaaatagagtaactgtgggcaagtgtaactctgtactagggggttgtcacctggtagggaacacctttgggctccaaggctga

SEQ ID NO: 19781 - DNA, 332 bp, Glycine max
  Peptide Sequence Number=SeqID_111466
actgcaaaaggaaaagctaccatctcttcattccaccagttccagatgaatcgttgagtgaggcacttgaaagattcagaggtttattatggaagactcccactcacggtttttcagaaccaatacaactcaacatattcatagatgggttgagaccacaatctaagcagctcttggatgcttcagatggggttgcaggatgtataatttacggtggagctcatgaatctggatgttgtatccctaatgaagaacaaattccacatgaagtcaattatatgaggaatcaacccagaggaagattcaatacaagtggattcccaggattttag

SEQ ID NO: 19782 - DNA, 669 bp, Glycine max
  Peptide Sequence Number=SeqID_111467
atggtgggctcaggctccaaaaactgttactgctggctaggtctcctcaggagctggtgcaggggatggctctggcatgggatctggagaagtttcctcctcctgaaccataggctcatcatattcaggatcctgggctgtggatgccccaccccctccaacaggaaaaggctagactcctggccaggccacctgagtctgaaactccttcatagtcatgatgaaagcatagaatggagcatcttaggagaaaatgtaaaatctgatgcagaagcagttggtatctatataggaagttgtgaagtggatggtgaagcagaagtagatggggctgtaggagtaggcaaggtggatgaagaaggagctgaagtgtctggcactactgtagtagtgggggtctctaatcttctacccctggccttccttggccctctgaatgtcattgttggatcatatagattccaacagttcttcttaatgtatgccaagttaatggcagggctcaggctctctagggatctagaatctgattggactcctctagccttgcatagagctgtgatcaaggctgggaatccaagtctagagcaattgtgttgtgtagtaatagagatttggtgtgagatgtggtaccccatattcatatccatcttcatgatgatgccatag

SEQ ID NO: 19783 - DNA, 384 bp, Glycine max
  Peptide Sequence Number=SeqID_111468
atgttgcaacaaaaattgaagtttgtggtggaagggcatctggttatagtttcaggggaagaagatatactagtgagttgtctatcctctacaccccatgtggaagttgtgcaagagtcattggaaacatcttttcaagcgctagaaattgtgaacaatgcttatgtggaggctcatctggtgcaaccgcatctatctggtgcctccttgatggatgggtatgatcccgaaatgggtttaggccagaatggtgatcgcacgacaaacttggtgagatttgttgaaaactgtgaagatggcaccggaagatatggaaaagacaaccttcatcactctatatggaattgttggacaagtggcctcaataacttaagaggggggtga

SEQ ID NO: 19784 - DNA, 459 bp, Glycine max
  Peptide Sequence Number=SeqID_111469
atgggatcaagtcaaaatccttcgcttaaaaagaggttctatcaagtcaaaatcaagagcttagaggtcactagtttacgagagttggggaaattaatgggtcaacttcaatggcaagccttccgcaaagcctatggtaagatttgggacctagctagggacttccagctagtgccgactgtgaaagagtttgaagaaatccagggattcccactgggaggatggaagccatatcttttctctgggttctatccttccacgacaagagttgccaaggcaaatgggctttcttttattgacatcttggcgcttttgatctttggagttgtcctctttccgaatatggaagggttagtggacctagcagtgattgacgctttcttcgcctttcatcatggcaagaaaagcccggtcgtcgccattttggccatgtatgacacgtttcgaccggggatgtga

SEQ ID NO: 19785 - DNA, 216 bp, Glycine max
  Peptide Sequence Number=SeqID_111470
atgatgacaacaaaagatgatgacaaaggtgatgaacaaaaagcccaaagatcaaagaacatctcaagtgaatcaagaacaagtcaagagttcaagaatcaaggagaattcaagactcaagaagaaagcctagaatcaagaatcaagattcaaaatctcaagaatcaaaatcaagattcaagaatgaagaaaagactcaatcaagataaatattaa

SEQ ID NO: 19786 - DNA, 231 bp, Glycine max
  Peptide Sequence Number=SeqID_111471
actccgcgcgtattcctttcgtggaacacgcatcccgcgagtctcgcgtcgccctcccgccgaagggtaggttgcgacactgagcaagaggagaagtttttgttggggctcaagaagcacaagaaagccattggatggactttagcagacattcctggtattagcccatctacctgcatgcataggatacttttacaggatggagctaagccagtgaggcagccacaatag

SEQ ID NO: 19787 - DNA, 1091 bp, Glycine max
  Peptide Sequence Number=SeqID_111472
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaacgacggccagtgccaagcttgcatgcctgcaggtcgactctagaggatccccttcctcgttggaaagaaggcaaggaaggagttcttttctcgtgtggggactaccctaatattccattgatagggactagggggtgtattaattataatcccgcactcgccataagacaactagggtaccccatgaggggagcgccaaccgaagaaagtctctcgcctttccttacgaggaatctaggcacgcaaagtctcaaggcgatacaaagagtccacagggcgtggagaagtccgttaaggaaagatcaagaacttaggggcatccgtaatggcatcattggtggttaccatgaatggctgaaagttcatatacgaggtctagattggctcgccaagttaaaagtcgtcagcgaagagagtttcgaagcacctgaagaggacgaagaagtccaagccctcaaaagtgaattaggaaaggcgaaacttgccaaggagaagttcaagttagccgctacacaaacccggaaggaatgtgccggattacgggaagagaatgcaactaccgtaagagcccttgaacaagagaccaagagggctcgcaaggaagagtatggccgtaacaaatttcgcgaagctctgtggggtagcaacagtgaactcaagctgcgaagggaagagagggaccagtcgcgagcacatagcatggtcttgaaagagga

SEQ ID NO: 19788 - DNA, 423 bp, Glycine max
  Peptide Sequence Number=SeqID_111473
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccaggtggtagacagctggaagcctaaaccaaaacaggcactggtagaaagaagcatgttaggaaagggaaggtaccaccagaacaaagcatggtag

SEQ ID NO: 19789 - DNA, 240 bp, Glycine max
  Peptide Sequence Number=SeqID_111474
atgcccttacggagtaggattgcatcagcatggcccggagattggcccgaggaccagacagaggaggcacctgcagaggctcccggtgatggagaggaggcccgcatggatgaggagatgacggatttgctcgatttcttgggaggcagcggagccacaaatttttggtgttatggctctcagttatttcttcactattttcgtgcgtttttcgttcaccttgtggttagacataggtag

SEQ ID NO: 19790 - DNA, 514 bp, Glycine max
  Peptide Sequence Number=SeqID_111475
caacgcggcctttttacggttcctggccttttgctggccttttgctcacatggtctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctattctccatgatgatagtcgaggagttggggaaccacttgatgaacaacatccacaagcttggagctggttcacgctggcgtcgtacaactggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19791 - DNA, 382 bp, Glycine max
  Peptide Sequence Number=SeqID_111476
atgtcattgcctagcgctgttcatgtgtcctccattatcaagcgcgaagcctctggtgactgggaagcacaagaaaaaagaaggagtagagacgagagtcgtcatcacgaaaaggcagggcgaacgaaatcagtgtcctatctttgctttcctcttatctccgatgagagggggggtgcaaatagcaaccaagcccacttggaccctccagaagattcctccagaaggctgttgcttctggaggaagcaaccttgctcgcttgggcggcaagaagtgaagaagaaaaggacagcctcttaggcacttctctctctctcgaatttgctgaggaaaattatttccgtgaagaaaattcaagccgaggcgcttcctcttcaacgg

SEQ ID NO: 19792 - DNA, 222 bp, Glycine max
  Peptide Sequence Number=SeqID_111477
atggcagaaatcaaccaaggtaagacgatgaccggtcacgattggccgcgtattttgtttcctgtttacaggtacatagggacggatgcaagtgggggtggggtcacgaccgaccaatcgttgccccttcccggcgctaaacaagcagagaacgtcactgcggggcagcccagtatcctttgtgttcatagtttcttttactattttgttttaaataagtaa

SEQ ID NO: 19793 - DNA, 380 bp, Glycine max
  Peptide Sequence Number=SeqID_111478
gattcgcccggaccgctgcagggaggcgggtgtggatcatgcacaccagcatgaccaccttgacccagatgtggatgacattgctgctcagcaatgtcttgcctagtgatcataactctgatctccctctgccgaagtctcagctggtgtatgccatcctggcacggatgaacgtccacgtggctcagttgattgctgacgccatctatttgtttgcaggtatgccacccaccaggcaccctctggacccagataagtctaacagggccctggggttttcgacattgatcacgggcctctgccagtcattcggggttcccgtcacccttagtaagggtgatgcacctcaggccatagacgcaccgccaccgcctcattag

SEQ ID NO: 19794 - DNA, 258 bp, Glycine max
  Peptide Sequence Number=SeqID_111479
atgtcattgcctagcactgttcatgtgtcctccaccttcgagtttggagctatgcttcatgattgcctaagtgtggaccctctagtgcaatcctccattctccacttttttgcggagccccatgaatgtcattgcctagcgctgttcatgtgtcctccacgttcgagtctggagccccgagaatgtgattgtctagcgctattcaccaattctccattctccacttctattcggagccccttgaatgtcattgcctag

SEQ ID NO: 19795 - DNA, 582 bp, Glycine max
  Peptide Sequence Number=SeqID_111480
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaggatccccgttgcggaggcagtcggcgaggctggcgccggggacgaactcgttgacgaggaagatgacggcgccagagaccgacgcgccgaggagtttcaagaggctgctgtggtgactccggcagatgagggcgaggcggcggctgagctccgggatatcaatttgacggcggaagtcgcggcgcgaaacgacgacttcgcggtgacgaattacgcagcgccaggaggaagaggaaaggcgtggcgcggagaaattggcggttgcggcggagatctcagagaagtggtagatgttagggttttcagggagcgtgtctttgagacttga

SEQ ID NO: 19796 - DNA, 387 bp, Glycine max
  Peptide Sequence Number=SeqID_111481
atggttccgaagaaactttccacgaagaggtctagaagagacgccgcagcggaagggtccagtgccacccgcgagtttgatagtcatcgtttccggagcgccgagcaccagcagcgcttcgaggccatcaaaggatggtcgttccacagagagaggcgtgtccagctcagggaggatgagtatacggactttcaagaggagatagcttgtagacgttggacgtcactggtgactcccatggctaagtttgaccctaagatagtcctagagttctatgctaatgcttggcccacagaggagggaattaatgaagcattgtgcttgaatctagaattgggcttgggcttgaatccagaattgggcttggacttgaagacggcagactaa

SEQ ID NO: 19797 - DNA, 537 bp, Glycine max
  Peptide Sequence Number=SeqID_111482
atgacgcctaccaggcaccctctggacccagataagtccaacagggccctgggatttcccgccttgatcataggactctgccagtcgttcggcgtccccgtcacacctagcaaggtgattcggccgcccatcacccgagcttttattgagaagtactgcacgcagagacaggtccagggtgattcaccacaggccgcggacgcgccgccacctcatcaggctggtccagccggattgtttgatacagagcagtatttgcggcatttggtttgccagcgggcggccaaccaccgggcacatgtacagactcacgattgtctgtatcagatgagtctcagcctgcagagtcagggctttacttcttttccgtgccctactccggaccagttcagggcagaggtcgcgtggcctggggattggcctgaggcccaggcaggagaggcaccagcagaggctcccgatgaggcagatgaggcccgcgaggacgaagagatgaccgatttacttgatttcttaggagggagcggagccacatga

SEQ ID NO: 19798 - DNA, 207 bp, Glycine max
  misc_feature (16)..(16): n is a, c, g, or t
  Peptide Sequence Number=SeqID_111483
atggaggctggatctntgagcttcaatgaggtccttcaatggcgaagaggtgaggagaggcgccatccactagggaataatccatggaagaaggagcttcacgaccaagaatgtgtcttggataagaagcttggagaggattgtagaagcaagcttcatgatgatgaaccaagcaattttgatgatgccaaaagcccaagtgattga

SEQ ID NO: 19799 - DNA, 207 bp, Glycine max
  Peptide Sequence Number=SeqID_111484
atggaaacttctggacgagtcattgacctagcccaaaatggtatatctgttgtgatcatgccaaaaaagtcttttacatttgataaagtttttacaccagaggcatcacaagaagaagttttcactactacaaaaagcggattcaacatcggtgtgttaacatcggttgttaaaaaaaccgatgttaacatatgcgcggtggcataa

SEQ ID NO: 19800 - DNA, 174 bp, Glycine max
  Peptide Sequence Number=SeqID_111485
atggttatgcaatccgtgaaattctataatgcaacggaaactaggaggaggtattattacgcaatccgtggaagcaaactagctcgccttggcgagctaggtggcaaccacctcccccatttggttaaaaaatgggattccggggcttccgggacacccgtaatgcttccgtaa

SEQ ID NO: 19801 - DNA, 264 bp, Glycine max
  Peptide Sequence Number=SeqID_111486
gtgaaaattgcaaagaagaatgaaagctatgccaagcaagccaacaagaaaaggaaggaagtggtacttgaacccgatgatgatcctggacatttaagggcaaatgccttccaagaaggagggaatgatgagaatcctgaaactggtcaaatacaggctaaaggcccaagtggagaaggacaaagaccccgagtggagaaggatgaaggcctagaggcagagacactacctagactattaattgttgttgaaggcctagattaa

SEQ ID NO: 19802 - DNA, 157 bp, Glycine max
  Peptide Sequence Number=SeqID_111487
atggcacaacttccaccccatgaaaggactctaagggaaatggctgcgcctgatttcacctacgaaagcttgtgcatccaataccctgatgagggtgttccctatgttctcaagactggactaatacatttgctgcctaagtttcatggtcttgcag

SEQ ID NO: 19803 - DNA, 354 bp, Glycine max
  Peptide Sequence Number=SeqID_111488
atgccgccggtcaggccgatcaccgcgcaggcggtggcgtttcatgtgcgagaaattgcgcggcgcaccgcaactcaggccgggactttacataaagagttgagcaggctggctgaaggcggcatcttgctcaggcagcggcagggcaaccaaatttgctatcaggctaacgccgattgcctgatttttcccgagttggcggcgattttccgcaaggcttgcgggccggctgcgcgcttacggcaggtactgactggatttggggaagacatcgaacgggctttcatctttggttccgtcgccagtggcaaagcgacggcggccagtgatattgatgttctggggatcctctag

SEQ ID NO: 19804 - DNA, 258 bp, Glycine max
  Peptide Sequence Number=SeqID_111489
atggagatgtggtttcacatagacaagaatgtgaaggcaaagtgtaaatcacttgttggtcagaagaatgcttgggagtacgtaatggatagctggggtaacctggtagattgtccttcggaacaggagttctctgagcaccttcaaaggtttcaagtagcgtgttccccgtggccaatgttcactgactacgtatgtgagacatggattgtcccacacaaggagaaatttatcttggcctggacgaataaggattga

SEQ ID NO: 19805 - DNA, 481 bp, Glycine max
  Peptide Sequence Number=SeqID_111490
cggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagctactgccaagaaaattgtgaaagctgatgcttatgtagctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19806 - DNA, 354 bp, Glycine max
  Peptide Sequence Number=SeqID_111491
atgtctcactttcaaatcctgaagcttatccaacataaacttcctcttggattaagccatttagaaatgtggtttttgcattcattcgatacaacttcatgtttttacaagctgcaaatgaaagatcttcttcatcaatggattcctttgcttcttggaagacgaatggcagcggaatggagaaggaagagagagaggagacgccacttcaaggagaagataagtctagaagaagctcaccaccataggaggccatggataagagcttggaggaagaaggagatgaatgaagggagaggaagagaagagcatgaaattttatgctctaaaagagctctgaaatctgaagtttaa

SEQ ID NO: 19807 - DNA, 387 bp, Glycine max
  Peptide Sequence Number=SeqID_111492
atggtcattctgtgtcttttgtcatccagaggcggcgggcctgatgacatccggagacaaattatggtcattccgctcaccttttcgccattcagacacagttgtgtccgatggcacgtagagacaaattatggtcattctgcaacttttgtcatccagaggcggtgggcccgatggcatgcggagaaaaattatggtcattccgctcagcttttcgccattcagacacagtcatgtccgatggcacgcaaagaaaaattatggtcattctgcgtcttttgtcatccagaggcggcaagcccaatgacatgtgaagacaaattatggtcattccgctcgccttttcgccattcagacacagtcgtgtccgatggcacgcagagataa

SEQ ID NO: 19808 - DNA, 219 bp, Glycine max
  Peptide Sequence Number=SeqID_111493
atggtgcagttatggtttgggattagggtaaaacacttgcctgtgtgggaaaatatcggtggaccattcggtcctgccaacaaatcttattcggagccccatgaattgattatcattcatgcatcctccactaacgggtctggagccccgcgaattgattgcctagcgttgttcgcctatcctacaccctcgaatcttattcggagacccatgaattga

SEQ ID NO: 19809 - DNA, 456 bp, Glycine max
  Peptide Sequence Number=SeqID_111494
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcgaaattcagaagaaagctctactcagtggactactggtatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 19810 - DNA, 456 bp, Glycine max
  Peptide Sequence Number=SeqID_111495
ttagttgcttgtgcgaggtccaaatggagtttggctcaacacttggaagccatggagcaaagcatgctagccatcatagggcaatacaaggaagagttgaacaagtccatggcccatgaacaaaagctagtggaggattttgcacaagtgtatgccgaaaaggaagcaagagggagggtgattgatgcgctgcatcaagaagcgactatgtggatggatagattcgccttgaccttgaatggaagtcaagacctcccgcgtctattagtcaaagcaaaagccatggccgaagaacagatgaaggccgatctatcggccttaaaagatcaaatggcttccatctcggaggtcatgttaaaactccagaaaaccatagaggataaagccaccgcaaccgcctccagtacagttagggaagcgacgccggtgctgcaacccgccttgaatccgagctag

SEQ ID NO: 19811 - DNA, 375 bp, Glycine max
  Peptide Sequence Number=SeqID_111496
atggcgtttattcccccgttcgctgcggcaattggtgctgctggccttcctgttggtgctgctgccgctgctggtgctggcctatcaggcctaccagagcctggatcacctcagcgcgcaggcggcggacatcaaccgcaccacgctggtggacgcgcggcgcagcgaggcgatgaccagcgtggcgctggagatggagcgcagctatcgtcagtactgcgtgctggtcgatcccacgctgcaaaagctgtatcagaaccagcgcaagcagtattcgcagatgctggacgcccatgcgccgattctgccggacgagcgctattatcaaacgttgcgccagctgctgacccagctggcggcgatcaaatgccataa

SEQ ID NO: 19812 - DNA, 223 bp, Glycine max
  Peptide Sequence Number=SeqID_111497
gtggaggccagagacacacacctttcatttgacatgtggggaggtcatcatcacactacaagatgtgtctgtgttgctaggccaaatgccaatgcattggctgacggaaacacattgaaattaagctggttgacttcacaatttgcaaatatccaggactatgtggacgacgaagagcacctcaaaatgtttgcacatgcttggattttgagatttattggag

SEQ ID NO: 19813 - DNA, 432 bp, Glycine max
  Peptide Sequence Number=SeqID_111498
atggcagcgcagttgatccatgatcgcgtagtgatgaaatgcctagagggtgtttgggagaccctcgaaggcaatgagaggtgccgattccgtggcacaattcgactcactgctacttcgctagtacatccggaggaacccgcacgcacacttctgcaacctgtggaatggatactacctacacctactccatatcaactagttgagctggttcaagtgatagaggtgtcatcctctgaagaggatcttgaagaggacccagaggagttacctcctgaacctgctatggacgcccctgacttaccagaggatgatgaggacccgctccttgatcttgattctcccgaggatattatgtcagcatccgaggcagactctacagaggagagtggccctggagggacagcgcatagtgacgactcttcatcatag

SEQ ID NO: 19814 - DNA, 856 bp, Glycine max
  Peptide Sequence Number=SeqID_111499
gggactacacatcctcgccttgagaggactacacgtcctcaccatcaaaggactacacgtcctcgccttgagagggctacacgccctcatcttgggactacacgtcctcaccatcagagggctgcacgccctcacctctagaggactacatgtcctcgccttgagagggctacacgccctcaccttgggactacacgtcctcaccatcagagggctgcacgccctcacctctagaggactacatgtcctcgccttgagagggctacacgccctcaccttgggactacacgtcctcaccatcagagggttgcacgccctcacctccagaggactacatgtcctcgccttgagagggctacacgtcctcaccttgggtactagttaccttcaccttcagaggactacacgtcctcgccttcaaagggtcatgtaccttcaacttcagaggactacacgtcctcgccgtcaaaaggactacacgtcctcgccatcagaggactacatgttccccattttcaaaggggggcatgccctcaccttcagaggattgcacgtccttgccatcataggactacactccctcgccttcgaaaggcgacacgtcctgaacttcagggggctacacgccctcgcctttagaggactacgcgtcctcactttcaggaccagtagtttccttttaacggttcctgagcccccccctgatattggaggagggccaactgtgcgagcacaaccagagagggaggctatcacacaactactatgcataccggggcaagatttcacccgtgccgctgcaaaaagacgagtgcggatcatgcgcactaacatgaccactcttacacagatatag

SEQ ID NO: 19815 - DNA, 357 bp, Glycine max
  Peptide Sequence Number=SeqID_111500
atgacggtgaaaacctctgacacatgcagctcccggagacggtcacagcttgtatgtaagcggatgccgggagcagacaagcccgtcagggcgcgtcagcggatgcgtaaggagaaaataccgcatcaggcgccattcgccattcaggctgtgcaattgttgggaagggcgatcggtgcgggccttttcgatattacgccagctggcgaaagggggatgtgttgcaaggcgattaagttgggtaacgccagggttttcccagtcatgacgttgtcgactctagaggatccccataccagcactaatgcaccggatcccatcagaactccgcagttaagcgtgcttgggcgagagtag

SEQ ID NO: 19816 - DNA, 294 bp, Glycine max
  Peptide Sequence Number=SeqID_111501
atggcttctccacctgcctcccctcctcctgctccttcggacgcattggcttcgccgtttgccgtgaagcggacacgcaaagcctcacgtctacgatcgttgtctactagaccacctggtgctgagagaccagtggtccatgttgatcctgctaccagcaaggccgacggtccccacaggaagaaattaagaacatatttggggattgtggtgcgtgataaggtggacgtcacctacgagaactggaaggaggtccctactgctcataaggacctaatttgggaggatattcag

SEQ ID NO: 19817 - DNA, 246 bp, Glycine max
  Peptide Sequence Number=SeqID_111502
atgattgtgaagggccaagacatttatagtagccaagatgaggctactacttcaccttcctatagtgaaagtgaaaaagcaaaaggggaagaatctagtgaagaaatctacccccaacaagaacgacaaccattaatggttaaggaggagtgtaaggaggtatgtgtctcctccaagaggagtaatcaacacgagaatataaaaaaggtgttgagggaagaagtccagagtttcaagaacctctag

SEQ ID NO: 19818 - DNA, 129 bp, Glycine max
  Peptide Sequence Number=SeqID_111503
atgaagatcttaaaagggtatacagaggatctacaccatcctgaagcaaacattgttgaaaggatgaagaagaagaaggttgaagcagctggtgtctcgctaagcgaggcatatgcgcttagcgagtaa

SEQ ID NO: 19819 - DNA, 234 bp, Glycine max
  Peptide Sequence Number=SeqID_111504
atgattcccggacgaagatcggaaggggtggaaatggaaaagatcggaggcaaacagaataattctcgatcaatgaaagaaaaagatcagagaaccttccgaccagataaattttctgcaaggtcgttctcgactggcgatatcccaccccacctgaacaaagaggaaaagaccgaaacacccagcttcctctccaaaaaacactaccctcgagaaaatcctattggtccgtga

SEQ ID NO: 19820 - DNA, 521 bp, Glycine max
  misc_feature (85)..(85): n is a, c, g, or t
  Peptide Sequence Number=SeqID_111505
gggggcggagcctatggaaaaacgccagcaacgcggcctttttacggttcctggccttttgctggccttttgctcacatgttctntcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagggaaatcgattgctgcagccaccacttctgcttcgtttgcatcatggaataggcccaattttccgccaaaggttctcctacgttcgctggctccctatgcatggcgtcttttcttcctccagggacgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19821 - DNA, 588 bp, Glycine max
  Peptide Sequence Number=SeqID_111506
atgacacaaccatccaaaactatgaaactaactaaagatgaagtagaccgcctcatccaaagctatcaaaccaatcaagacgagcaggcgcagctcacgctggtcgaatgctatacaaacttggttgatatgctggcgaaaaaatattctaaaggaaaaagctttcatgaggaccttagacaagttggaatgataggtttacttggcgctattaaacgatacgacccgctcgtcggtaaatcatttgaagcctttgctattccaaccatcatcggggaaatcaaacgctttttacgagataagacatggagtgtccatgtaccaaggcggattaaagagcttggaccaagaatcaaaatggcagttgatcatttgacaacagagacacagaaatcacctaaagtccaagaaattgcagaatacctagatgtaacagaagaagaagtacttgaaaccatggagatgggcaaaagctatcaagcactgtctgttgaccaaggcgtagaggctgattctgaaggaagtactgtgacgattttagacgttgtcggctcacaggaagagggctacgaacgtgtgaatcaataa

SEQ ID NO: 19822 - DNA, 433 bp, Glycine max
  Peptide Sequence Number=SeqID_111507
cggtatcagctcactcaaaggcggtaatacggttatccacatgaatcagggtgataacgcaggaaagaacatgactataaagataccaggcgtttccccctggaagctccctcgtgcgctctcctgttccgaccctgccgcttaccggatacctgtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 19823 - DNA, 96 bp, Glycine max
  Peptide Sequence Number=SeqID_111508
atgttggctggttacgcatacacggagaagatgcactggcgacatcttggggatattcgtgggaataagcctagtgcagctgaatggcttgattaa

SEQ ID NO: 19824 - DNA, 135 bp, Glycine max
  Peptide Sequence Number=SeqID_111509
atgaagggtagagctaaccgagggttaaaaagtgagaatggtagtgataggagtggaaaagtgacttgtgggaaagcttgggctgagcaaatgaggaaaatcagtgaccaaagtgaaagcaagagccatttctag

SEQ ID NO: 19825 - DNA, 777 bp, Glycine max
  Peptide Sequence Number=SeqID_111510
cggccaccgttcatagatattctcgcactgttgatcttcagaggagtcctctttctgaatgtggatgggttggtggacctagcagtgatcgacgcttttctcgcctatcataaccacaaggaaagcccggtgaggcatgcttgccccctagaaagccaccgttcatgcacagagaaaggaggggcaaattgggaccaactcttagcaagcaaagaaggagcatctgtcaactggttccctcgattgaaggaagaaagaaccggagttcttattttgtgcgaaggatttccaaatgttcccttgatggggacaagggattgcataagttacaatctcgttcttgctataaggcaacttggctaccttatgagagaggcaccactagtggaagagatcgcgcctgtcatttcacgaggtttcaataagaccaacatggagacatttcaaaaggtcctcaaggcatgggaggtggtgcgaaagaaggacaaagaactcaggggcagtaacaatgggcccatcggtggctatcataaatggttaaaagcccacgtgcaaggtttggattggctcccgagtttgagaaccgctaaaagggaggaagttgaggcaccggaggaagacgaagaggagaataccgaactgagagatataaatgtggctaccaccaaagccttggaacgagaaaccaagagggcttgtcgggaagaacacggccggaacaagttccgaggggctctgtggggcaacaacagcgagctaagctcggggatcctctag

SEQ ID NO: 19826 - DNA, 147 bp, Glycine max
  Peptide Sequence Number=SeqID_111511
atgaagatgctcttgataccacattatgtagctcaatgtagagcttcagaatggagaaagaagaaagatgattggagatgccacttcaaggagaagatgagtcaagaagaagctcaccaacataggaagcgatggataagagcttga

SEQ ID NO: 19827 - DNA, 743 bp, Glycine max
  Peptide Sequence Number=SeqID_111512
atgacagctgagctactggttaatatcacaccgtctgaaacgcgggtcgcctatatcgatggcggcattctgcaagagatccatatcgaacgcgaatccaaacgcggcatcgtcggcaatatctataaagggcgcgtcagccgcgtcctgccggggatgcaggcggcgttcgtcgacatcggcctggacaaggccgccttcctgcacgcctccgacatcatgccgcataccgaatgcgtcgccggcgacgagcggaaaaacttccacgtgcgcgacatcgctgagctggtgcgccaggggcaagacctgatggtgcaggtggtgaaagatccgctcggcaccaagggcgcgcgcctgaccaccgacatcacgctgccttcgcgctatctggtcttcatgccgggcgcggcgcacgtcggcgtttcgcagcgcattgaaagcgaagccgagcgcgagcgcctgaaagccatcgttgcgccgcactgcgacgagctgggcggttttatcatccgcaccgcggcggaaggcatcggcgaggaagagctggcgcaggacgccgcgttcctcaaacgcctgtggaccaaggtgatggagcgcaagaagcgcaaccagaccaaatacaagctgtacggcgagctggcgctggcgcagcgcatcctgcgcgatttcgccggcgcggcgttggatcgcatccgcgtcgattcgcggctgacgcacgatctgctggtggagtttaccggcga

SEQ ID NO: 19828 - DNA, 1210 bp, Glycine max
  Peptide Sequence Number=SeqID_111513
atggctacctcaccaaaagatacttcatctcctggttcaccctctgtaccatcatctccatcatccaccaaagcaccatcaaaccaggaacaacctgaattccatatccaacccatacaaatgattcctggtcaagcccctgttcctgagaaactggttcccaaaagacaacagggagtgaagatttctgaaaaccctagccttgcaacaagtcctagggaagtagacccggagatggataagaagatccgcagtattgtgagtagcattctgaaaaatgcttctgtccctgatgctgatgaagatgttccaacatcttccaccccaaatgtttctgtccctgatgctgataaagatgttccaacatcttccaccccaaatgctgaagtactctcttcatccagaaaagaggaatcaacagaggaagaggatcaagccacagaggaaacccctgcaccaagggcaccagaacctgctccaggtgacctcattgacctagaagaagtagaatctgatgaggaacccattgccaacaagttggcacctggcattgcagaaagattacaaagcagaaaggggaaaacccccattactagaaattcctcatctgattctgatgatgatgtcgaactagatgttctcgacatcaagagggccaagaaatcaggaaaaaaggtgcctggaaatgtccctgatgcaccattggacaacatttcattccactccattggcaatgttgaaaggtggaaatttgtatatcaacgcagacttgctgttgaaagagaactgggaagagatgccttggattgcaaggagatcatggacctcatcaaggctgttggactgctgaaaactgtcaccaagttgggagattgctatgaaagtctagtcagggaattcattgtcaacattccctctgacataacaaacagaaagagtgatgattatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacag

SEQ ID NO: 19829 - DNA, 330 bp, Glycine max
  Peptide Sequence Number=SeqID_111514
atgaccatgattacgaattcgagctcggtaccccaggtgaaagctgatgtcacagagggttctgataagctagctgaggccattggtgacgattcagaagcagtagtatgtgccacaggctttcgcccggggtgggatttacttgctccctggaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19830 - DNA, 351 bp, Glycine max
  Peptide Sequence Number=SeqID_111515
atgcctcctaaggcatcaggagcctccctgagaggaggtcgaagtacaggaaaaggatctaggctggctctaccagagttgtccactaaaaaatcatcctcaacttcttctaggtcaccaacccaggctgggtcatccacccagaaaactaattttgaagggtcatcgacccaaattatctcagtcaaacctgagtcatccactcaggaatcccccaaaccggcaactgccaaacaaacatcggtcgactatgcctggccaattgaaaccctttcatttggccattttcagggttttgagaggaggtgctctgaaagaacaacttttggaagcgcttctttcaggttttaa

SEQ ID NO: 19831 - DNA, 267 bp, Glycine max
  Peptide Sequence Number=SeqID_111516
atgtcatatgaaccaagcttgttacaatgtggtaaacccaacagaaacaaagacggttccagttgtgtggttgtgccgaataaacctcagcagcagccaacgaatgcctgtagtggcgacgggtatttttccgctgtgaataaagcatgccctgaggcagaaggaggcggtttcaggccctgtgtggggtcactgtggcagtgtgctgagttggctgtgcacgtgggcagcatgacggtctttggaaaggacactggaaaagcttaa

SEQ ID NO: 19832 - DNA, 470 bp, Glycine max
  Peptide Sequence Number=SeqID_111517
cgttggagatgatttatggaaactaggaagatcatacgccaaactgccaaaacttttgggagctttgcaatcttgtgttcccgggactgtggtcgctgctcaaacaggatccgttacaagtagatggtacatggctttatgggaatatgggaagtatactggcatactgttgatagataccgcacaagatggagctaaccatatcttcccgattgcctacgccattgtagaaggggagacaacttcagcttggggttacgcatacacggagaagatgcactggcgacatcttggggatatccgtgcgaataagtcaagtgcagctgaatggcttgatcaattacccaaacaaaaatgggagacgtatttcaagaccgcacaactctttgctaatagaggtcgacaaactcaggcaatgatcaacttcggctcacagtattctgaagtcgtcttcgatgcaatgaataacg

SEQ ID NO: 19833 - DNA, 483 bp, Glycine max
  Peptide Sequence Number=SeqID_111518
atgccctcgccttcaaagggctacacgcccttgccttcagaggactacacgtcctcaccttcagaggagtacacgtcctccccttcagagggctacaggtcctcgccttcaaaggactacaggtcccttgcctttagaggactacatgtcctcaccttcaaaggactacacgtcctcaccttcagaggactacatgtcctcgccttcagaggactacacatcctcaccttcagaggactacacgtcctccccttcagaggactacacgtcctcgccttcatagggctacacgccctcgccttcagggggctacacgtcctcaccttcagaggactacatgtcctcgccttcatagggctacacgccctcgcctttagggggctacacgtcttcaccttcagaggactacacaccctcgacttcagaggactacacctcttcaccctcaaagggctacacgcccccgacttaagaggactacac

SEQ ID NO: 19834 - DNA, 379 bp, Glycine max
  Peptide Sequence Number=SeqID_111519
agcaaggatggacattctcaccctgggtcaaggtttacaacaagttgggattttggctcaaggcttgtagaacggctggacatgatatatgtcagggtgcgggtgcggtgacctcggtcacgtggctctgcttcctcccaagaaaccgagcaagtccgtcatctcctcatccatacgggcctcctctgcatcgccgagggatcctgcaggcgcctcccatgcctggtgtagcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaag

SEQ ID NO: 19835 - DNA, 430 bp, Glycine max
  Peptide Sequence Number=SeqID_111520
acaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgaacttatgatcaacttgcctcaaagctttgttaaagctgacattgtgctccatgatcaccttctcccgagaaccacgcattag

SEQ ID NO: 19836 - DNA, 297 bp, Glycine max
  Peptide Sequence Number=SeqID_111521
atgaagggcccttcagcgacccacacagaacacaactacagcaacggagacgaagtgggaagtgacgactttacaaaacaactttcgcgagttgcgattgatgagtatgggccagcccatgagcccaaactttttagtggtaaacgattccaaagccaaccaaaccaaggaattgcggccctccgtttaccacccccaaacccaccaacaagttctacttcttctacggccaccgcaacccctcccagaaccgccccaccgtccgcggcggcctcttctccaaccgacaaaccctaa

SEQ ID NO: 19837 - DNA, 432 bp, Glycine max
  Peptide Sequence Number=SeqID_111522
atggatgagaagacaaataaaaaactggaggaagctggtcaatccggaagcactgaagccatgattgatcctccatctcccatcagacaacacatcaaatggaagatggcccgcacaaagaaaactggccagatgacatccgaggcagcaaagcaaattgctgacaagattgattcgttaaaggagctgacgtcacagggttcctttgttgcccatggacgtcaggatgtactgactgctaccattgggcgaccagaacaccccggttgtgtgcgtgctgctggagtcaatgtgacgatcaagcaatactttggactgactccaaggacctcttgcacgtcttcctctatggctcccgaaggcctagagcacctgactcaacaaatcagggaccaactggaggagtcgatcacagaaaaagtgactcgatag

SEQ ID NO: 19838 - DNA, 177 bp, Glycine max
  Peptide Sequence Number=SeqID_111523
atggtgctggtagtggctattgcaaccacattgacctccattatctcctttatgctcatcatggcctccatcattgtggttatttgctctttcaaggcctccgtgtcggccttcacctgctcttgcacctcctccacttcacccattactctagcatgggttcggacatggggttga

SEQ ID NO: 19839 - DNA, 799 bp, Glycine max
  Peptide Sequence Number=SeqID_111524
ggaagttgagaggaggaactggcataaggagctcaccaacttctcagagggaagcattgatgttgctattgttaaagaattttatgctaacctctatgaccctgaagacaaatcgcttaagcaggtaagggtgcgagggaacctaattaaatttgatgttgacgccctcaacaccatcttgaagacaccagtggtcatagaggaaggggagagcttgcccgcctactccaggtttgctaatcagaggcctgttcctgaagagcttgcagcccatctatgtctccctgggagaggatttgagttgaatgcagacggcctacctctgaagatcttgaggaagaatctgactactctggcccagacctggagtgttctatccttttcaaacttagccacaacatcccacacttctgacattactctagatatggctaagttgatatgcgggctcgtcatgaagatggatattaaattggggtccctcatctcaggtcagatctctcttatagcacaacatgactcctcgaggctaggttttccagcccttattactgctttatgcaagggaacccgcaaatctagggccagaggatctgaggcaccatctactttagctctccctacctcatctccttctatatcagctccttctacctctcctctccctccaccaccaccagctccaattcttccagagtttgcaagatgtggtctagcggcggcaagttatgagtgtcgaggagtttcttcaggaggtggcctggccaagagtccagccttctcctttgggagggggtga

SEQ ID NO: 19840 - DNA, 645 bp, Glycine max
  Peptide Sequence Number=SeqID_111525
atggctccgagaaagctttccgcaaagagatctaggaaggacgccgcggctgaagggaccagtgcggctcccgagtttgacagccatcgtttcaggagcactgagcaccagcagcgtttcgaggccatcaaaggatggtcattccaccgagagagacgcttccagctcagggacgatgagtacacatattttcaggaagagatagctcgccggcgttggacgtcgctggtcactcccatggctaagtttgacccagatatagtcctagagttttacgctaatgcttggcccacggaggagggggtgcgggcatgcggtcatggccagttcctgggtgacccgttagtgttagaggagggccaggagtgcgagtttagtcagagaaggaaccgagccgatggatttgacgaggaggccattgcccagctcttatgcataccgggtcaggattttgcccggaccgctgccgagagacgggtgcggatcatgcgcaccagcatgaccaccttgactcagatgtggatgacgtgctgctcagcaacgtcccgcccagcggatcataactctgacctctttgcggaagtgtcagctagtgtatgccatcctgacacggatgagcgtccatgtggctcagtttaccgctga

SEQ ID NO: 19841 - DNA, 147 bp, Glycine max
  Peptide Sequence Number=SeqID_111526
atgaccacaatgatggaagccatgatgagtatgagaaaaatgatggaggtcaacatggctatagtcgttgccgcaagtatcaccatagaagtggactcgactcacccacctggcttcaatcaagtaaatcatccagcctcagatatg

SEQ ID NO: 19842 - DNA, 192 bp, Glycine max
  Peptide Sequence Number=SeqID_111527
atggataagagcttgaaggtaggagaagatgagtggagggagaggaagagaaggagcatgaaattttgtgcctcaaatgagctatggttcagcccactaatccaagatcaagtccaagattctccactaagtgtgcttaggtgcatgaagcatgtaaaacatgaaggacatgcacaaagtgcgactacatga

SEQ ID NO: 19843 - DNA, 138 bp, Glycine max
  Peptide Sequence Number=SeqID_111528
atggctctgggatggtggcctcagatgactcatcctccacatgctgaggtacctgggctgtgggaccttcatcttccctgtgaagaaaagtttgggtcccaagccagttttttttttaacgtgaacagtagcaattga

SEQ ID NO: 19844 - DNA, 45 bp, Glycine max
  Peptide Sequence Number=SeqID_111529
atgggagcagaatggcagtggcagggtgtagggagtaagattctg

SEQ ID NO: 19845 - DNA, 504 bp, Glycine max
  Peptide Sequence Number=SeqID_111530
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggttaatcgccttgcagcacatccccctttcgccagctggcgtaatagcgaagaggcccgcaccgatcgcccttcccaacagttgcgcagcctga

SEQ ID NO: 19846 - DNA, 372 bp, Glycine max
  Peptide Sequence Number=SeqID_111531
atgccgatctccccttgcggaagtattagttggtctgtgctatcccgacatagggatcacaccacaaagacacccagtggacccagagaagtcccacagggtcctggggtttccagctctggttatgggcctctatcagtcctacggagtgcccgtactccccagcaaggtcatgtcatcccattaagtatgcatatggttcacaagatttcagtcatctattgtgcccccaggcaggcagaggacgagacaccacaacagcctggggatggccagcaacaggcaacaaatgcaccgccgccacctccagagcccctcagctcatccacaaaaaggttagagtattgcctacgacacatagccgacaaatag

SEQ ID NO: 19847 - DNA, 482 bp, Glycine max
  Peptide Sequence Number=SeqID_111532
gactaagtcctctgatcacgtgttcagtagacactggcgatcggggacttttgtcctcgtttgtggagcggtggcaccgggagacgtctagttttcatctaccagtgggagagctcacgatcacgctggacaatgtctcctcgcttctccatctgcccgtggttggcgacttgcacgcctttcagcccttgcacgtggacgatgcggttcagatgctggtagacttattgatggtctctgcagagtctgccagggctgagataacccagtatcgtggatcgtacgtacgcctgcaatgggccctttgtgacctcagtatgacggagaggtatgcctggggagtggctgctctggtgcatatgtacgaccaactgaatgatgcatctatcagccacagccaacaacttggcggttacatcacattgttgcagtgttggatttacgagtattttccgtcagtcgcggactccactactgattag

SEQ ID NO: 19848 - DNA, 252 bp, Glycine max
  Peptide Sequence Number=SeqID_111533
atggattatgaaaatgaagaagcatgtggtgagaatgaaccacatgttgattgttccgatgcgttcaatacttctcaggttataatgtgtttgagtgttgagatgatgttttgcggtgggctcgatccgtttctcatgaaaacggatttgtggcggaaaaaagaatttatcagaagagacactgggattaggaaatgtgggtgtcccttcaagattcgttgcaagccagtggttggaggagaaggctggatg

SEQ ID NO: 19849 - DNA, 336 bp, Glycine max
  Peptide Sequence Number=SeqID_111534
atggagaggagtatgattgatgctgccagtggtggagctcttggtgatatgacccctgatgaagttaggaatttgattgagaagatggcttccaactcccaacaattcagtgcaagaaatgatgctattgttcttagaggagtgcatgaagtagccacaaattcatcttcatcacctgagactaagaagcttgaaggtacaaccccgggtggaggaatcatcctaaccttagatggtcgaatccttcacaacaacaacaacaacagcaacaacaatagccccagaaacaacaaacagttgaggcccctccgcaaccttcccttgaagaacttgtga

SEQ ID NO: 19850 - DNA, 518 bp, Glycine max
  Peptide Sequence Number=SeqID_111535
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 19851 - DNA, 678 bp, Glycine max
  Peptide Sequence Number=SeqID_111536
atgtctaacccttcagagcagtattggcaagctgtcaagagaatcctcagatatttgaatgcgactctaactctgggattaagtgatgcaattgttcttggggcagaaactttgcgggggttataccctgtagagactatttccactgttggaaaaatttgtgctgaggcagacattttcataaccagatgctctttacaggcagagaaagtttataatcaagatttgtatttcaagaaggctgtcaaatttgttggagagccgatgactcatttggaatcaatagcttcctctgcggtacgggcagccatcaaggttaaggcttctgttattatttgctttacttcatctggcagggctgcaaggttgattgctaagtaccgtccaaccatgcctgtgatatccgttgtcattcctcaactaaagacaaatcaacttcgatggactttcactggagcttttgaggcaaggcaatcacttattgtgagaggtcttttccctatgcttgcagatccacgacatccagctgagtctaaaagtgcaacaaatgaatcaattttgaaggttgctttagaccatggcaaggcttttggtatcataaaggcacatgatcgagttgttgtatgccagaaagttggtgactcctcagttgtgaagattattgagcttgacgaatag

SEQ ID NO: 19852 - DNA, 216 bp, Glycine max
  Peptide Sequence Number=SeqID_111537
acttatcaaggtaatccttgtggcgtctacccagacttatcttccttcaccggaagtggcgtctacccggacttatcttccttcaccggaagtggcgtctaccctgacttatcttcattcaccggaagtggcgtcatccaaaccttcgtagcctgtatcaaacgatccgctcctactcaggttcacatcatctggtatcagagcttcggctcttga

SEQ ID NO: 19853 - DNA, 432 bp, Glycine max
  Peptide Sequence Number=SeqID_111538
atgtggctacgtctagacgattcatctaccagtcgctgcaggcagcatgcatggtctctcgtggcggagacgaaagtgacgaatgtctgtgtcatctcggggaatcacacgacatggaaacctgccccacggtggaagagttacttcaacggctcatggactgggggtagctcgaagaatgtgaccggctccgggtccaagtaccccccgatagtacccaagccaacatcgttttcctatcaaagcaataaggttgttccatggaagtatacccctcccgcttttggagaaagggttgcaaccgaggttgactccttgtcagccaaggtgaccaacattaccggccttagcggcgtaacccgtagtggccgagtgttcgctccccctcactcggcggaattgccctccaaggggaaagcacccatgatctaa

SEQ ID NO: 19854 - DNA, 558 bp, Glycine max
  Peptide Sequence Number=SeqID_111539
atgccaatctccccctgcagatggatcgcacccacaagacgcccagtggacccaaagaagtccaacagggctctggggtttccagctctagttacgggcctctgtcagtcctacaaggtgcccgtcaccccagcgaggtcatgccatcgtgacatagggatcgcgcccacaagacacccagtggacccgaagaagtccaacagggccctagggtttccatctctggaatcgcacccacaaagacacccagtggacccggagaagtccaacagggccctagggtttccagctctggttgtgggcctctgtagtcctacagggtgtccgttccccccggcaaggtcacgtcatcgtgacatagggatcgcgcccgtaagacacccagtggacccggagaagtccaacagggccttgggatttccaactctgattacgggcctctgtctgttttacagagtgtctatcgcccccagcatggtcatcaggccccctactaatcgagctttcatcaagaagtactgcgtcccaaggcaggcgcagggcgagacaccgcagtag

SEQ ID NO: 19855 - DNA, 393 bp, Glycine max
  Peptide Sequence Number=SeqID_111540
atgccttccaaggttattttgatgatgccaaagaatcaagagttaagcaaagtttcaagaaccaagtttcaagtttcaagattcaagattcaagaatcaagattcaagaataatcaagatcaagattcaagactcaagattcaagaatcaagaagaagactcaatcaagataacacaagaagttttcacaaaatcattaccaaagagttttactctctggtaatcgattaccggaaggtagtgtcataccctaatttcgtccggggactattgcttgatggcatgcaacctttgattgaccgcttcgaagtacttagcaccctttgttgcacaatatgtgaagtcccgagacgcgtcagaaatcaaaagaaagcatggttacgcgatccgtga

SEQ ID NO: 19856 - DNA, 171 bp, Glycine max
  Peptide Sequence Number=SeqID_111541
atgaaatttggcggtgctgttccatttctcattcctatgacgaggggtgggggtcacaacccactctttgaggattcacctagtgagtctggtagtggggccggcactgtgagatatgggctaatctccaatgacactcgcgaagcaagatgcaagtgcatggctgtgtaa

SEQ ID NO: 19857 - DNA, 324 bp, Glycine max
  Peptide Sequence Number=SeqID_111542
atgtgttctatgtcacgtacatgccaccttgaagtggagtatatcagcttatccttgaatgttagatataagggtttcaatttgttgaggaagggactgaaaaataacttagaaagcatttttctgaagaaaaaaaatagtctttttgcaaagcgcaagcctcgcgctaagcgcatctttggtcatgcgctaagccgcgagtctcaagcgcttagtgcccaacccttgcatctgaggctgatttggtccactaagctagccaaggctgagctaagccaacttcaattcgatttggatttggctaagcgaaagcctaaccgctaa

SEQ ID NO: 19858 - DNA, 480 bp, Glycine max
  Peptide Sequence Number=SeqID_111543
atggacatgaacatcggagcccttatctcagccttgatcacttccctatgtagagctagaggagttacctctgacagtctgacctatgagagcctgagcctggctattaacttggcctacattaagaaaaactattggaatgtggatgatctaatagttaacttcagaggggcaaggaagccaagagttcgaccagctgatgttccttcttcttctactctaccagctccttccacttctgctactcctacaccagctcctccagactcatctactcaagactctcagcactttgagttcatgcttcagagtcttcataaaggacaaattttgttaatgcagagcttgcaggttgtagctcctctaggatccattctgacaatggagcagtttttagagagggtatcctggccaggaaccctgccttctcttgagagaaaaggtgggggtctcagtgctcagctacctcagcaggtatag

SEQ ID NO: 19859 - DNA, 174 bp, Glycine max
  Peptide Sequence Number=SeqID_111544
atgttgcttgttcgcgattgcttgggcaatgttagtgatggaccattggagtttaagtatagtcttaccatcattcatgcatgtaaatcaaatgttgctgagaagcatggaacaattgaagaggccaggaaggttttctcaaacttgagggagcgcaacttggggatcctctag

SEQ ID NO: 19860 - DNA, 177 bp, Glycine max
  Peptide Sequence Number=SeqID_111545
atggctctagggtttgatggacttcaaacctatgttggtgaaaggtttgatgctttggaacaacaagtggacatgcgattcgacgagatggactcaaggatcaccaaggttgaaggagatgtcactttcatccgcacatactttgatctaccaccaccgccgccgccatcatcttag

SEQ ID NO: 19861 - DNA, 195 bp, Glycine max
  Peptide Sequence Number=SeqID_111546
atggagagaagtatgatagatgctgctagtggtggagcccttggagacatgactcctgctgaagccaaaaatttaattgagaagatggctccatctgcatcatctgaaactaagaagcttgaaggcaaactggatgcattggttaacttggtaacccagctggccttgaatcagaaatctgtacctgtcgcaagg

SEQ ID NO: 19862 - DNA, 81 bp, Glycine max
  Peptide Sequence Number=SeqID_111547
atgaacaagaaggttaagtggtggctggacagaaatatagaaatggcaataactcaagctacagggctccaaatgaggtga

SEQ ID NO: 19863 - DNA, 421 bp, Glycine max
  Peptide Sequence Number=SeqID_111548
aatcataatcattgtaaccaaagagaaagatcacgctttacgacacccttaccagacacgtgccaaggctataataatgagcgaaatcgaagaagtacaggaacaagtgaaggctgatatggaggccatgaaggaacagatgacaacaatgacggaagcaatgatgagcacgagaaagatgaaggaggataacactactacagttgttgctgcgagtactgctactgagatggacccaattcactcggccggtcaaggaggcgaggcagcgaagaatgcatgtgggcctcatcatgttcaggttcagagcaagcatttcttcccaccatatgggttgcctcctaattacacaccgcccactgttgtgtacgcttttggtgagaatattagcaattctacacccgtactcattgagaattaa

SEQ ID NO: 19864 - DNA, 633 bp, Glycine max
  Peptide Sequence Number=SeqID_111549
gtcgactctagaggatcccccttgatcaagattcttcaagatcaagccttgcctcacaatgaaaggattcctgaacacaagggatgggttgtccctgtgtggtttagactttgtaatggattttacaaagatagtggaaatctcaagccacaaggtccaacagaggcttattctacatcagcagctcctcatctagcttctacatcagcagctcctcctccagctcgtattgtagcagctccttctaccctacctcctgcagattttcaatgtttcgaagccatgattcaaagcatacatcaggggcagattattttgctacaaagtctccagctggtaccacatcagccagcggatgagtcatcagagtcttccactcctgagcccttgatcaggaagaggagggtagagttaactcaggaagccgcaaacactcctaaaaagtctcctaaagagtcctttaatggtggttttccaccatggagatgcagcggaagacaaaggagaagaggggagaggaggtgccatcctctagggaataagccatggaagaaggagcttcaccaccaagatgagccttggataagaagcttggaaggatgcttcaatggaggaaaagaaagagggagataa

SEQ ID NO: 19865 - DNA, 177 bp, Glycine max
  Peptide Sequence Number=SeqID_111550
atgacgactctttgcaaatccagaagaagggtatcaaagggcaataattgtcaattttgtgaaattgagacatttccaaaagaattgcctaaagtagattccttacattcatgtaccataagcccaaatgagaagttcatttttatggggtatgaagtgaaagctccagggaaatag

SEQ ID NO: 19866 - DNA, 615 bp, Glycine max
  Peptide Sequence Number=SeqID_111551
aaaaggaaaacaccttctacatctgcccaagccatatttgatagatctaggttcacatcccaagaggcttgggagaggtataccgacattgtggtacctaggaagatttttcctgaaaggaatgtcattctccattacattgagtttgatgaatttactgaagaactcgagcatagaaattggcacaaggagttgaaaaactttgcggatggtagtattgatgtggccatcgtaaaggagttttatgggaacctctatgaccccgaggataaacctaagcaggtgagggtgagaggtcgtttggtgaaattcgatgcagacaccttgaactcattcctaaagaccctagtaatacttgaggagggggagaactttccagtatactccaggttttgtcgttcgaagccagaaccacaggaaatggcagctcgattatgcatccctagaaggggattcgagttaaacgctgatggactgccattaaagatcttacggaagaatctgatcatgcttgctcagacatggagcattctatctttctctaacctggtccctacctctcacacctcgaatatcacattagacagggccaggttgatttatggaatcatttag

SEQ ID NO: 19867 - DNA, 997 bp, Glycine max
  Peptide Sequence Number=SeqID_111552
atggctgagctaagccaaattcagctcggtctgaattgggctaagctagagccattcgctaagcgcatgacatcaaggaaaaggaagagcactgcttctaggccacaggctcagtatgataccaggagattccaatccttggaagcctggaaccgatatacagataacattttggaccagaggatccttccgaaaaggaatgttaagatttatcatactaaattcgacgagtttaaggcagagttggagaggcttaacctacacaaacgcctcgccaaccttcaagagggaagcatagatgtggcggaggttaaagaattctatgccaatttatacagcctagaagaccagagccctaagcaagtgagggtgagaggacacttaatcaggattgatgctgacagcctgaataccttcttagagaccccagtagttttggaggagggtgagacactgcctacctattccagatttacgaggatgaggattgatcctcaagagtttgttgcccctctttgcatccctggtaggggttttgttctgaatgcagagggccatccttggaagcttttgaggaaagatctcaccactcttgcacatacatggagtgtcctctcctactacaacctgactcacacttcccacacctctgatcttagtatggacagagccaagttggtttacagcttagtcacaggcatggacatgaatatcagagccctaatctcaggtcagatttctatcattgcccagagtaactcctctaggcttggatttccagccttggtcactgccttatgcagagctagcggagttacctctggcaatgttccttcttcttctgcaccaccagctcctcccacttctgccacgcctacactagctgcctatgactctcagcactttgaagccatgcttcagaggtccattctatcagtagagcagttcattgagaaggtatcctggcctggaaccttactttctactgtgggagagg

SEQ ID NO: 19868 - DNA, 1371 bp, Glycine max
  Peptide Sequence Number=SeqID_111553
atggttaagactagaggattaggccatgcattaggtagggttgttgccagaggtctggggagaggggagggtgatgattctaatggtgttccccagcaacgaaggccgaccgcatcggcacgtaggcgacgggtacctatcattgttgacgatgttgtgcctgcgctggggatgagcccagagactaacgcacaggatattggtgcacaggatgctgcagatgagcctgagggatttcctggtggacccagggacccatcagtgcttacggagtatgctgatcatgttgcggccagcgtatggtctgaacaagaacatcttgagttgaagctatcctcccatgggaggaaggtgcataacttgggcaggcctgttcttgcaattgaggacatggttgctgggacaggattaagtcctttgatcgtgtgttcgatagacaccggcaatcggggacttatatcctcttttgtcgagaggtggcaccgggagacttctagtttccatcttcctgtggtggagcagaggtggccatggtcgagacaggccaatgtggtggaccatatgtacgcctgcagtagctgcgagacgtatactagcgcaaatgtcagatgcagcactagacagctgtcgctcgtgcttatcttctacatcttttgggttgcactctttttgctaataggagtgcaacccatgttcatgtctcacacttataggccctgtgtgacctcactcttgctgggcgatatgcatggggaactgctggcctcgcccatatgtacgatcaacttaatgatgccagtctcagcaccagccaacagcttgctggagcactttccgtcagttgcggagtgcaatgctgatccggactacgacgagcgcctggatcgtctgagaatcctagatgtctgctggatgtcacatgcgaagcaccgacctgtgcaggactttcatccgatttcgtgcttctcgggacaaatccgctgggggcctgttgttgtcagatacagaccgaagagggttatgcgccagttcggctacgtccagtgcattcctgcacaccctgtccattcatgggtgtcatatgatgacatgggcgatacttggacgcactactcagaccatctggcgatagcaggtgatctatgtgttgtgccaggtcagtgtgcacctaactacatagactggttctttgtcatatcgcatccattcatgactgcgccactgacgaatcctcctcgagatgcatatgcgacgcaacccagtcatatccctcatgaggcaacaccggcatcgacacatgcggatcttgatgcggacgagcccagacatgcagtggaagcttgtcatgcgatcgtggatgcgttggagtag

SEQ ID NO: 19869 - DNA, 609 bp, Glycine max
  Peptide Sequence Number=SeqID_111554
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccctctatcgagggaaggggatgccgatgctgatgatgattatgttgtggacatcatggtagctcagagagctttggatccgtggcccgcacaggacggggatcctctagagtcacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19870 - DNA, 527 bp, Glycine max
  Peptide Sequence Number=SeqID_111555
gagctaccaacttctttttccgaaggtaactggcttcagcagagcgcagataccaaatactgttcttctagtgtagccgtagttaggccaccacttcaagaactctgtagcaccgctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 19871 - DNA, 417 bp, Glycine max
  Peptide Sequence Number=SeqID_111556
atgggtgaaacagatgaggtgcaagagcggataaaggctgacttagaggccacgaaagaacaaatgggcacaatgatagaggccatgatgagcatgaagaagataatgaaggtcaatgcggctgcagtttccgctactagtgtcgttgttgaggtggactggactcctacatctggcctcaaccaaataaatcatgccatctcagatatggtagggcagaaaggcaaagaattgggaagtacaagcggcccccattttgtgcaagttcaaaacaagcattccattccaccatatggcttggctcccaaccatacactacccaatgttgcacacactcccaatgaggatgtcaacaaccctgcacccatacccattgagagccaacaaccccaagctgatcatgcacatgtctcttaa

SEQ ID NO: 19872 - DNA, 372 bp, Glycine max
  Peptide Sequence Number=SeqID_111557
acaagcccgtcagggcgcgtcaccggttttgccgggtgtcggggctggctaaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccacaaggaaggatcatctaaggctacatga

SEQ ID NO: 19873 - DNA, 279 bp, Glycine max
  Peptide Sequence Number=SeqID_111558
atggaggtcgtcactgatgcggcgtcgttggacctcgaattgttgcagcttccagagttttccggtttggctctcaagtctaacctcaatttcatcgagaagctcttcgaccagtggttgtcgcttccagaagtaatcgattgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaa

SEQ ID NO: 19874 - DNA, 376 bp, Glycine max
  Peptide Sequence Number=SeqID_111559
gtccccctgcggctgcggagggcccccctcacaatgaggtctcgttgttcttggaggagggccctcctcctttcttccagaccgcgaatgcggtccaggatccgttgcatggctgcagccacaagcgctggatcgatgggaggcaggtgctcccaaaaggcagccaggatggagcaatcctcactcgacagctcgaaagcggatcagtacaaacccacgtgatccgtattcgcttacgtaccaggcgtgcttcgtcgtaccctgacaactcctctttcactggcttctacttgtcttttactgggcttatttgtacccagcttcatgatggaactcccctcggccaatcgtcactcgacagcagctccgtcctagc

SEQ ID NO: 19875 - DNA, 528 bp, Glycine max
  Peptide Sequence Number=SeqID_111560
ctccagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtgactgctcgagctgcttccgcggcgagagcgggtcgtcgcgtgccg

SEQ ID NO: 19876 - DNA, 369 bp, Glycine max
  Peptide Sequence Number=SeqID_111561
gttatgtgggatgctaccgtgtttggggtgtttaatgacaacttccacttgtacataaagcatgaagatctgtttgaaattgcacacagtgatcaatgtctcaacatctctattatacaattgtggattctgcatatgactaagacaagtatgcaagtggggaatgccgatgtgtatggattcctcgagccgcattccatccagagatttggacaatcacaatttgaatcagaaagttacattaagaacttgatgcagaattcaaagcgggatgtgtacctaagagcctacctgaatggtgctttgaaaggacttgatgatactccacaaagtaaatccaaggttgctactaggtggattgttgttaaa

SEQ ID NO: 19877 - DNA, 407 bp, Glycine max
  Peptide Sequence Number=SeqID_111562
atggctgaatccactcactcgaaaacgaacctggaacggatggaggaagtaattgccgaattggcttccaatcagcttcacatcactaccaagctcaatgagcttatccagcgcatcacggttctcgagaccaaccagcaacaatcagcctcgccttcgtcttcctccaccaacccttcccacattgctccttcttctcagcttcctcgcatgaagctagaagtgccccgtttcgatggaacagacccctccggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 19878 - DNA, 105 bp, Glycine max
  Peptide Sequence Number=SeqID_111563
atgcaaccaatgaaaagcacggataggaaaatgcaaggatcatgcatgagcgaacatgaaaatagaaggtgtacaagaaacatgttagatgcagatgcacggtga

SEQ ID NO: 19879 - DNA, 708 bp, Glycine max
  Peptide Sequence Number=SeqID_111564
atggttaggaccagaggattaagtcatgccttaggtcaggttactggtagaggtgtgggcagaggagatcgtgatgattctgatgatgctccgcagcgtcgacggcctactgcatccgcacggaggcagcgagtcgctgtgactgcggatcacatcgatgagtcagtcatccctgtgccagatgttcaggatgacctgatggaggcactagctgctgtagaggacattcctgcggacgatgcggttcagatgctggtggacttgttgatggtctctccagagtctgctagggctgagacagtccagtgtcgcggaccgtacgtacgcctgcaatgggcaggtcattggacagctgcggctcgcgcatatcttcttcacctactgggttgcactctgtttgctaacaagagtgcaaccaatgtccatgttgtctacttggaggcccttcgtgaccttagtatgacagagaggtacgcctggggagtggctgctttggttcatatgtacgaccagctgaacgatgcatctatgagccacagtcgacagcttggcggttacatcacactgctgcagcactttccctcggtcgcggagtccaccgcagatcaggactacgacgaggcttctccgcgtgcgtgtaggtggattgcgatgaagaagaccgtgaagagcattcgcacgccgtcatacagggagcgcctggactga

SEQ ID NO: 19880 - DNA, 422 bp, Glycine max
  Peptide Sequence Number=SeqID_111565
gagttaactccatataatcagtatgaagaggaaagagtccgtgatcttgataataagattatcaaggggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 19881 - DNA, 308 bp, Glycine max
  Peptide Sequence Number=SeqID_111566
ctgtcccctcctgttcagctactgacggggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 19882 - DNA, 702 bp, Glycine max
  Peptide Sequence Number=SeqID_111567
gtgtgatccatgctcagaaaattaaaaaagattcaattcccgtcactattcagacggtagaaattacagggcgaaaatccaaagattatatttccgattattcatttgcagccactaagattgcgatgaaaaacaaagatcttccgctcacgctgaatacggttaccaaagaactcatcaacgacaggcaggcgttcaggctgggagatgtactgaaaaatgttgcaggcgtttccaatgtaagtttttataatcagtacagcatccggggaatcagccagaatgaagaaggccagatcattaatggaatgcgcaccaggcaatattattttcttcagccgatgaccccacatatcgagcgtgtggaggtttttaaaggtccggcaagtattaccatgtccagcgtagacccaggaggaaccatcaacatggtaactaaaaaacctttggcaaattcccgttacgaagtaagtttatcgggaggaagctttgatacctatcgcctttccgcagatgtaaccggacctttgaataccactccctcgatctcctttatccctaatgatagaacatcggtgaatgtagaaatgatttacaacgaaatgaacggaaacctcgacagaggacagcctatctttggagcagttgccggaaaaaccgatctcaacagtactcctgtcagtttaaatctgggggctccgg

SEQ ID NO: 19883 - DNA, 687 bp, Glycine max
  Peptide Sequence Number=SeqID_111568
atgcgtagtgattgcttagtgcaattctccattctcaaccctttttcggagcccatgaattgcgttttcgttcatgagtcctccaccttcgagtttggagccatgcgtagtgattgcttagtgcaattctccattcttatcctttttcggagccccatgaattgcgttttcgttcatgtgtcctcctcctttgagtttggagctttgcgtagtgattgcttagttcaattctccatcctcaaccctttttcaaagcccatgaattgtgttttcattcatgtgtcctccaccttcgagtttggagctatgcgtagtgattgcttagtgcaattctccattcttaacctatttcggagccccatgaatttcattttcgttcatgtgtcctccacctacgagtttggagctatgcgtagtgattgcttagtgcaattctccattctcaacctttttcggagccccatgaattgcgttttcgttcatgtgtcctccacattcgagtttggagccatgcgtagtgattgcttagtgcaattctccattctcaacctttttcggagccccatgaattgcgttttcgttcatgtgtcctcctccttcgagtttggagctacgcgtagtgattgcttagtgcaattctccatcctcaaccctttttcaaagcccatgaattgcgttttcattcat

SEQ ID NO: 19884 - DNA, 447 bp, Glycine max
  Peptide Sequence Number=SeqID_111569
atggctccaaaaaagatttccacgaagaggtctcgaagagacgccgcggcggaagggttcagtgccacccccgagtttgatagtcaccatttccggagcgccgagcaccagcagcgcttcgaggccatcaaaggatggtcattccacagagagagccacgtccagctcagggaggatgagtatacatacgttcaggaggagatagctcacagacattggacgtcgctggtgactcccacggctaagtttgaccctgagattgtcctggagttctatgccaatgcttggcccacggaggagaaggccagcaatgtgagttcagccagaggaggaacagggccgatgggtttgacgaggaggccattgcctagttgttatgcacactggggcaggatttcacctggaccgctgcagggaggcgggtgtggatcatgcgcaccagcatga

SEQ ID NO: 19885 - DNA, 342 bp, Glycine max
  Peptide Sequence Number=SeqID_111570
atggatagaaggcctcaagaggttaacattagcctcccatatttccatggaaaagataacgttgaggcctacctagattgggaaatgaaggggactgcccttgctcctacgtatcctcaggcaaaaggccactttggggcaattgcagctcgcccaggtgagctgaaccttatccctgaagtaattagctcgcccaggaaatcagccaaaaacacaaatatgggtgaactgatcaatttaggggttgtacttagccctgggtcaatcaggaacgttctggaggaaacaacagctcgcctgggcgagcatattgcttcaggtggaagctacgagctcgcttag

SEQ ID NO: 19886 - DNA, 159 bp, Glycine max
  Peptide Sequence Number=SeqID_111571
atggcgggcacaatgtccgacgacgagtcctgtgaaggtactaatatcgaggacccaaccgtcgattttgaacgagaagcggatcgacttgaggatgaagaagacaaagatatggggttttccccagagctagaaaggatggtcgctcaggaagactga

SEQ ID NO: 19887 - DNA, 648 bp, Glycine max
  Peptide Sequence Number=SeqID_111572
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatggtccatactattgtggtattggtgctaacaaggcttttggacgtgacattgttgactctcatttcaaagcctgtctttatgcagacatcaacattactggaattaatgcagaagtgatgcctggtcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19888 - DNA, 300 bp, Glycine max
  misc_feature (238)..(238): n is a, c, g, or t
  Peptide Sequence Number=SeqID_111573
atgcataaggcattacgggccaatgcacctctgccttatcctcaccttgttactctttttcttcatcatttcaatattcctttggatgatgaaccatatgtcaaagttaagtggtcattttctattggtgccggtgcggttacctcctttcattaccgaaaggatgttgatggtcagtgggttcgcaaacaagacttgcctccgcctattcctgacgagcgtaccccatctcctccancacaaaggaatgattccacttctcttttgactgaagtcctcacagaactttgcattctttaa

SEQ ID NO: 19889 - DNA, 240 bp, Glycine max
  Peptide Sequence Number=SeqID_111574
atgatgttgattgggctggttgtccagacacaagaaaatctactactggatggtagcttggattctctcaagcacaaccaacttcgttgcatgctgacaacaccagtgccatacagattgcagcaaatccagtttaccatgaacggactaaacatattgaggttgactatcactctatttgcgatgcctatgatcgaagagtcatcagtctaccacacatctcaacttccattcaaatag

SEQ ID NO: 19890 - DNA, 518 bp, Glycine max
  Peptide Sequence Number=SeqID_111575
gcttagagcttcaacattcaatttcgagcgtgcccgatatattacgagactcaatcggacatccgagtaaaaagttattgtcgtttgaattggctcagagcttaacattcaatttcgagcgtttcgttatattacgggactcaatcaaacatacgagtaaaaagttattgtcgtttgaatttgctaagaggttcaacattcaatttcgagcgtctcgatatattagcgggactgattcagacatccgaggaaaaaaggttaaacatgcaatttcgagcgtctcgatatgttacaggactcaatcagacatccgagaaaaaggttattgtcgtttgaattggctcagagcttcaacattcaatttcgagcgtctcgatatattacgggactcaatcagacatccgagtaaaaagttattgtcgtttgaattggctcataagttcaacattcaattccgagcgtctcgatatataacgggactcaatcagacatccgaggaaaaagttattgtctcttga

SEQ ID NO: 19891 - DNA, 318 bp, Glycine max
  Peptide Sequence Number=SeqID_111576
atggtaaccatcatcagcaagtaccaagaaaaattaaatctagccatggcccacgagcacaaagtggcggacgaatatgcccgagtgtacgcggaaaaggaggctagaggaagggtgattgactcgttacatcaagaagcaacgatgtggatggatcggtttgctcttactttgaacgggagtcaagaacttccccgattgctggcaaaggccaaagctatggcagacacctactctgcccccgaggagatccacgggctcctccactattgtcagcacatgatagacttgatggcctatataattaggagccgttag

SEQ ID NO: 19892 - DNA, 180 bp, Glycine max
  Peptide Sequence Number=SeqID_111577
atggagaatgaccttaaaagtcatgtttgctgcaatgtttatggtctcctttatctgtcagagagagaataccgggaggcgatcaagtgctatcgaaatgcactgagaattgatcccgacaatattgaaattgtttctgacctatcacacctaaaggtagcatctttaatgcatttgtaa

SEQ ID NO: 19893 - DNA, 240 bp, Glycine max
  Peptide Sequence Number=SeqID_111578
atgggttacatgggaataggaatgacgagggatgggaattgggtgaaagaggaaaaaggaaaaaggaaacggaaagttttcgtctctccgaatccagcagtgggcagttcctccaactccctccgtcgccgccgcctccctcctcctctcctctgtgtcttctcttccctccatcgccgactccttctatttcctcctctccgcgccgtcgtcgccgtcttctcttccataatcccatag

SEQ ID NO: 19894 - DNA, 324 bp, Glycine max
  Peptide Sequence Number=SeqID_111579
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccatgcaaaaaggaagaaggaaatacctgaaggtgagtgtgttgtggcggagaaagagaaatgtgaatccgaaaaagaagaggtaaatgtggcaatggaggctgagatataccctacaggaacgaccgcgatatag

SEQ ID NO: 19895 - DNA, 126 bp, Glycine max
  Peptide Sequence Number=SeqID_111580
atgtacctgcttggtggcatagatagatatgaggatttaaagcattcattacttgttgatggattatccatggttaccatgaataagtggatgaataaccgatatgggttatgcgattgcatcaag

SEQ ID NO: 19896 - DNA, 162 bp, Glycine max
  Peptide Sequence Number=SeqID_111581
atgatgatgcaatcctacctcgcaagggcattggatagaaaactccaagtagattgggccagagatgcaagagaaggtcctagggttcttatgagcctcagggtagggtaccctagaaatataggatttttcagcccttgtatttcagggcacctagactag

SEQ ID NO: 19897 - DNA, 177 bp, Glycine max
  Peptide Sequence Number=SeqID_111582
atggccatgatcatttcaatgcatacgattgcaatcaatctacaagagattcagtcaaagtctactgatcattcactcaccgggctaggtctacaagttgctttatttgctttcaatttttcatgcaaaactcattacacatctcaatcaagcaaaatcaatggttttcacttttag

SEQ ID NO: 19898 - DNA, 375 bp, Glycine max
  Peptide Sequence Number=SeqID_111583
atgtacaactatcatgagaaaggaagagctcctgatcttaaaagtgtattggcagacttcatgacataccaagctagctctaaagagattgaagcacatcaagaaagcattcttcaagataccacaatccatcatcaattggtcaacaaagaagaacaggatgaagtctccagtactccagaatatccctgcatggcaactactggctatgttgtagggaaagataaaggtcatttggaactcagtgtggaggatcagaaaatctcttttgacctctttgaagccatgaaacactcagatacgggtgatgcctatgttgaagaagaagaggtggatcatgaaatagcattatcagcttcaaccatggtactatag

SEQ ID NO: 19899 - DNA, 390 bp, Glycine max
  Peptide Sequence Number=SeqID_111584
atgattatgaggggccaagacatttatagtagccaagatgaggctactacttcaccttcctctagtgaaagtgaagaagcaaaaggggaagaatctagcgaagaaatctacccccaagaagaaggacaacctttaatggttagggaggagtgtaaggaggtaagtgtctcctccaacaggttagctaagaaggaaagtgttgagggaagaagcctagagcttcaagaacctctggatttaaggtcaaatccttttcaagggggaggaaatgatgaaatcctaccccccaagggcattgatagaagactccaagaagattgggccagagatgcaagagaaagccttagggttcttatgagccttaaggtagattttgggcctatgggctaa

SEQ ID NO: 19900 - DNA, 321 bp, Glycine max
  misc_feature (89)..(89): n is a, c, g, or t
  Peptide Sequence Number=SeqID_111585
atgttggtgagtttcccctcctccgcaccatatgtagaagcagcagaagaatcattggaaacaactttccaatccttcgaggtggtganttgtacctctgtggaaacgagtccgttgctaccttgtctctctaatgcggccctaatggtggcacgggtgatgctcaggcacggttatgaacccgggacaaacgtacaaatatgggttggggtcgacaaaagcgagactcttgctcctacgtaccctccatcgaagaggaaatcagacctacgtagttcttttttaagggtgaatcaaggattctttttacttggaagatga

SEQ ID NO: 19901 - DNA, 417 bp, Glycine max
  Peptide Sequence Number=SeqID_111586
atgattacatggcaccgggttagatgcatatccgatttgatatgtgacccgagccggtgctatgcccgggttctgttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgttgcaagtcacaaattaatcacatgtatttcatgcttcgatgagcgttcacttgcatatcatgctgttggatatggaagaggatctcacattccagcagtagccattacatcatcaggcactgcagtttccaaccttcttcctgctggggatcaaaattgcggattgagcattataggggaccaatag

SEQ ID NO: 19902 - DNA, 369 bp, Glycine max
  Peptide Sequence Number=SeqID_111587
atgctgccccagcatgcaccccatcaactcgtccaaaactgtcatgtacaggatgagaggtctcccaggcaccgacgacataagtacgtgagggttcatgaggcgctgtttgatctttccaaatgcctcttgacagtcctcgtcccagtggatggactggttcttgtacttggcgatcatgttgtctacgtagacttcgatctctcagtgcatcatgtcgtggaacaaagccaccatagcccgttgataggtcgccctggcgttcttgagcccaaaggacatcaccttatagcagaacgttccccacagggtgatggacgtggtcttttccatatcctctggcgtcatctttatttgattgtagcctga

SEQ ID NO: 19903 - DNA, 309 bp, Glycine max
  Peptide Sequence Number=SeqID_111588
atggctaaagcacgtcaaaagagcaaaataggggagaagcttgccgcccagctcgcccaggcgagcaaggttgcttcctccagaagcaacagccttctggagggcccaagtgggcctggttgctatttgcacccccctctttcgaagaagttacggaaactcacggattgcgcaaaaacacctcttttcgatttccgccacattacggaatttcacgaatcacgcaagcctgcttcctttcgatttctgagacgtctcgggacttcatttattgcatgtcatctagtaataatccccggacaaaattag

SEQ ID NO: 19904 - DNA, 234 bp, Glycine max
  Peptide Sequence Number=SeqID_111589
atggcgatgaacacgctaagtgtgtcttgctgcgctaagcgaatgaactcattaagccggccctatcccgctaagaaaaggaaagccacagcttccaggccccagcctcactacgatactcacagattcacctctgagtggaaccgctatgctgacaacattcttagtcggaacatccttccggaaaggagcatgaagctttttgtcacagagtttgatgagttcaggacatag

SEQ ID NO: 19905 - DNA, 264 bp, Glycine max
  Peptide Sequence Number=SeqID_111590
atgtcatcacgcgctcaacgcgtcatcagctcattcagcgagaagattgtctcttctgtgcttagcgcgagaatggcgctaagccaaatttcacttactcacgctaagcgcgccttcatggacaaaaagtcctttttaagcctgaattgcaaagaatggaaaagagaggctaagtttatcaagagacatctgagaacgaagtttaatttgaatttggccaaactcgcgagacatcggtgtttggtatttgtgccttcagcatag

SEQ ID NO: 19906 - DNA, 309 bp, Glycine max
  Peptide Sequence Number=SeqID_111591
atggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtccatcactttcattacatagatgtggattgccccgcgaaatag

SEQ ID NO: 19907 - DNA, 491 bp, Glycine max
  Peptide Sequence Number=SeqID_111592
tgttactgctcccgtttatctggagttgtacaagcctggaagtactgacccttattttggatcacaaacgattagagtaaaaataaaacaggatatcggagctaatatgatcgtgctgcaggaaaaagcggaaggcggtactgttcagattattggtgatattgacatcgcagactacctctcagcagttatcgtttcctgccgttctgaggaagaatctgttcctgattttcccgacggaagcgtagagtctgtcaatgtctgggttcatgaaaacatgaaacgttattatttctgggaggatcagatgcctgcaaaaccggattatcatcttcctgtaaagaaattttttgcaagccttctatctcagaatgacctattgcagcttgctaacgggcagataacggctgtgataaaattggtattacaggattctccggctcagaatgccggcctgaaaagagggatgatcattaagaagatcaatggaa

SEQ ID NO: 19908 - DNA, 261 bp, Glycine max
  Peptide Sequence Number=SeqID_111593
atggagaatggcactaagcaatcactacgcatagctccaaactcgaaggtggaggaaatgaatgagaacgcatttcatggggctccgaaaagatggagattggagaattgcactaagcaatcattacgcatagctccaaactcgaaggtggaggaaatgaatgaaaacgcatttcatggggcactgaaaagatggagaatggagaattgcactaagcaatcattacacatagctccaaactcgaaggtggaggacacatga

SEQ ID NO: 19909 - DNA, 402 bp, Glycine max
  Peptide Sequence Number=SeqID_111594
atgagtcatcattcatctagtgttaatggcgagggtactagtcataaggaccctctatctagaatcttagatgagttgagttccctcaagttatggaaagaaaaacaagagagaaaagaaaaaggaaaaaaaagagtggaagaaataagtcaagataaaagagagaaaataagagaggaagaaagaagaaaaataatgaaagaaatgaaaagagaaaaacatgccttctatagtagtcatgactcttgcaagagtttaagtgaagaacttagcgactattttagagggcgtcatagttcacatactaaacatcattcccaaaaaagagaaaagcatagaaggcctcaagaggttaacattagcctcccatatttccatggaaaagataatgttgaggcctag

SEQ ID NO: 19910 - DNA, 180 bp, Glycine max
  Peptide Sequence Number=SeqID_111595
atgcccgggttgggtcgggattggtcaagcttggttttgggcaatagcaccccacctgacgtccccaaggattatggggtacccatcacatgtggtactaggtggcggtcgggcgatggtgcacaacaagttttccacatccacaatgatgcaatcctaccccccaagggcattggatag

SEQ ID NO: 19911 - DNA, 153 bp, Glycine max
  Peptide Sequence Number=SeqID_111596
atgtgcgctagaagttggttgtggagtgctgaaaatacaggttctacgagctacaaagttgttgctgaatgtgctaatgtaatgaatgaaatggtttcagatgatgaaggtgaaatgatgggtgctgctggtgtcactaatttggaggaatga
